United States Patent 9,238,822 (COMPOSITIONS AND METHODS FOR CONTROL OF INSECT INFESTATIONS IN PLANTS) - sequence listing, part 9

SEQ ID NO: 32335 - protein, 273 aa, Diabrotica virgifera
  misc_feature: Coding regions on vcDNA: vcDNA=SeqID_12032; Strand=+; Position=3-821
  misc_feature (2)..(9): Xaa can be any naturally occurring amino acid
  misc_feature (12)..(19): Xaa can be any naturally occurring amino acid
  misc_feature (22)..(41): Xaa can be any naturally occurring amino acid
  misc_feature (44)..(54): Xaa can be any naturally occurring amino acid
  misc_feature (56)..(82): Xaa can be any naturally occurring amino acid
  misc_feature (85)..(206): Xaa can be any naturally occurring amino acid
  misc_feature (215)..(222): Xaa can be any naturally occurring amino acid
  misc_feature (226)..(272): Xaa can be any naturally occurring amino acid
LXXXXXXXXLFXXXXXXXXLNXXXXXXXXXXXXXXXXXXXXVPXXXXXXXXXXXSXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLKTRLFXXXXXXXXPTDXXXXXXXXXXXXXXXXXXXXXXXXXXXXXXXXXXXXXXXXXXXXXXXA

SEQ ID NO: 32336 - protein, 73 aa, Diabrotica virgifera
  misc_feature: Coding regions on vcDNA: vcDNA=SeqID_12033; Strand=-; Position=158-379
LPRSYFTTSFIIMIYTLLDSTTFSTTSLLLTISTPILSWYTNNISPPTPHFMSSLFTHHSYRPPVEPSIIMYI

SEQ ID NO: 32337 - protein, 55 aa, Diabrotica virgifera
  misc_feature: Coding regions on vcDNA: vcDNA=SeqID_12034; Strand=-; Position=322-489
SSLLFYCDLVIFLILSDAGGGDSIGKVQIRNGCHKLIYIKGDFIKLITCCMSYVS

SEQ ID NO: 32338 - protein, 111 aa, Diabrotica virgifera
  misc_feature: Coding regions on vcDNA: vcDNA=SeqID_12035; Strand=+; Position=3-338
  misc_feature: Homolog annotation: Hit_ID=CAC51707.1; Match level="QueryCoverage =90%, HitCoverage=22%, E-value=1e-18, Identity=43%"; Hit description =NADH dehydrogenase subunit 4 [Tribolium castaneum] ref|NP _203163.1|ND4_15766 NADH dehydrogenase subunit 4
  misc_feature (29)..(35): Xaa can be any naturally occurring amino acid
  misc_feature (48)..(55): Xaa can be any naturally occurring amino acid
  misc_feature (58)..(64): Xaa can be any naturally occurring amino acid
  misc_feature (76)..(83): Xaa can be any naturally occurring amino acid
  misc_feature (105)..(111): Xaa can be any naturally occurring amino acid
QIFFYERIHSRRIYLNKGLLNIIPNLRLXXXXXXXSNIAAPPSLNLMXXXXXXXXIVXXXXXXXLFLSLISFFRAXXXXXXXXYSQHGIFFSGAYSFYNGLIREXXXXXXX

SEQ ID NO: 32339 - protein, 36 aa, Diabrotica virgifera
  misc_feature: Coding regions on vcDNA: vcDNA=SeqID_12036; Strand=-; Position=1-108
  misc_feature (3)..(10): Xaa can be any naturally occurring amino acid
  misc_feature (28)..(28): Xaa can be any naturally occurring amino acid
SNXXXXXXXXPTINLIHIEGRNLYYRLXLSNKITLL

SEQ ID NO: 32340 - protein, 153 aa, Diabrotica virgifera
  misc_feature: Coding regions on vcDNA: vcDNA=SeqID_12037; Strand=+; Position=363-821
LYNPKYMLSHRYMIPRELPTYDLSTKNVTFEPTISFDSIDPHYALSYNMPHMHVHLMSLMFQMMRVLMYPQLYLQYMYRGPSQVMLNSYLLQRLMMIMLSMMYNNLACPLMMNHGLMDNNMTPQHLIFQIMMQPDMMMKNEMMTDFMMMPPHM

SEQ ID NO: 32341 - protein, 218 aa, Diabrotica virgifera
  misc_feature: Coding regions on vcDNA: vcDNA=SeqID_12038; Strand=+; Position=2-658
  misc_feature (6)..(13): Xaa can be any naturally occurring amino acid
  misc_feature (19)..(38): Xaa can be any naturally occurring amino acid
  misc_feature (41)..(85): Xaa can be any naturally occurring amino acid
  misc_feature (89)..(158): Xaa can be any naturally occurring amino acid
  misc_feature (164)..(217): Xaa can be any naturally occurring amino acid
PTPASXXXXXXXXSPTPVXXXXXXXXXXXXXXXXXXXXPLXXXXXXXXXXXXXXXXXXXXXXXXXXXXXXXXXXXXXXXXXXXXXDFIXXXXXXXXXXXXXXXXXXXXXXXXXXXXXXXXXXXXXXXXXXXXXXXXXXXXXXXXXXXXXXXXXXXXXXKYFFQXXXXXXXXXXXXXXXXXXXXXXXXXXXXXXXXXXXXXXXXXXXXXXXXXXXXXXI

SEQ ID NO: 32342 - protein, 60 aa, Diabrotica virgifera
  misc_feature: Coding regions on vcDNA: vcDNA=SeqID_12039; Strand=-; Position=357-539
SNIHRYRCMHLKTISVIQFTKCVLKCTLLTLNSSIIQHPQLTSDYLSLNPLRIEQRLFLA

SEQ ID NO: 32343 - protein, 301 aa, Diabrotica virgifera
  misc_feature: Coding regions on vcDNA: vcDNA=SeqID_12040; Strand=+; Position=3-900
  misc_feature: Homolog annotation: Hit_ID=XP_395969.1; Match level="QueryCoverage =100%, HitCoverage=47%, E-value=1e-150, Identity=84%"; Hit description=similar to ENSANGP00000021733 [Apis mellifera]
  misc_feature (26)..(26): Xaa can be any naturally occurring amino acid
  misc_feature (57)..(57): Xaa can be any naturally occurring amino acid
  misc_feature (294)..(294): Xaa can be any naturally occurring amino acid
GLDVNQQLITPFSENYIPVNRRSSLXEGVWNFAYQNRFKFTGECSNPDAQIRSCQTXAGSQFLITNQKFNITYKKCDGMTGTFDGVVEYSCLGDWFVGKNLYFAVANTKESRKDEKYRCFLKNRDDDLYIGVSITAECNTLKTVEKSPERLHITPVKSEIVEPGCRLPQNFSGEWINTANIDADIFINETHIIETWYPDEGRYRRTIYVCREQRDSRVMMARLTVDGCQKDFICFDFVPQHHNVIRYRRGIAVIKDDFSTVCSWVQFQNKVKWKYDLYLKKNPVPVKCPVAGKXHFTQKGD

SEQ ID NO: 32344 - protein, 234 aa, Diabrotica virgifera
  misc_feature: Coding regions on vcDNA: vcDNA=SeqID_12041; Strand=+; Position=42-746
  misc_feature: Homolog annotation: Hit_ID=EAA07613.2; Match level="QueryCoverage =87%, HitCoverage=95%, E-value=1e-62, Identity=51%"; Hit description =ENSANGP00000010975 [Anopheles gambiae str. PEST] ref|XP_563167.1| ENSANGP00000010975 [Anopheles gambiae st
  misc_feature: Gene Ontology Annotation: Molecular function=translation factor activity, nucleic acid binding; Cellular component=nucleus; Biological process=regulation of translation
  misc_feature: Pfam annotation: Pfam_ID=IF4E; Match level="Score=237.1, E-value=3.3e- 68, Copies=1"; Pfam description=Eukaryotic initiation factor 4E
MQLLYKVWLTSFEFKHTINQERPPIKKLKHHVDDDSGSGDEDSGPNITDLGPIDYPPGEHRLQHPYCLWFSKRPQQIQGLQGYSQALRLVGQVGTVEQWWALYSHMVRLQDIPAHRDIHLFKKGIKPMWEDAANKKGGKWVIRLRKEQAGRAWENLCMAMLGEQFMAGNEICGVVVSTRYQEYLLSIWNRTASDQATTARIRDALKRLLNIPSGATMEYKTHNDCLKYGATKTI

SEQ ID NO: 32345 - protein, 122 aa, Diabrotica virgifera
  misc_feature: Coding regions on vcDNA: vcDNA=SeqID_12042; Strand=+; Position=92-460
SELVTLIGSNGFEIDIFKSVTDPSIVDVILRSPRGPTRSFQIDEVNNIREVSDRNVFGYSRYHDFNQADILAQIFRQYQGSIAENQYYSLLNRIQLLVEGGVLNEAIYDVLREWEPVQFARC

SEQ ID NO: 32346 - protein, 44 aa, Diabrotica virgifera
  misc_feature: Coding regions on vcDNA: vcDNA=SeqID_12043; Strand=-; Position=249-383
  misc_feature (38)..(38): Xaa can be any naturally occurring amino acid
NEYDNSDCLLRKIEDNHFRQYVHEAIMRSSNKRLYFTXDAIKSN

SEQ ID NO: 32347 - protein, 40 aa, Diabrotica virgifera
  misc_feature: Coding regions on vcDNA: vcDNA=SeqID_12044; Strand=-; Position=1-120
  misc_feature (2)..(25): Xaa can be any naturally occurring amino acid
  misc_feature (29)..(39): Xaa can be any naturally occurring amino acid
SXXXXXXXXXXXXXXXXXXXXXXXXSNPXXXXXXXXXXXL

SEQ ID NO: 32348 - protein, 225 aa, Diabrotica virgifera
  misc_feature: Coding regions on vcDNA: vcDNA=SeqID_12045; Strand=-; Position=3-677
  misc_feature (10)..(161): Xaa can be any naturally occurring amino acid
  misc_feature (165)..(202): Xaa can be any naturally occurring amino acid
  misc_feature (205)..(225): Xaa can be any naturally occurring amino acid
SIKKLNDMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXXXXXXXXXXXXXXRYXXXXXXXXXXXXXXXXXXXXX

SEQ ID NO: 32349 - protein, 107 aa, Diabrotica virgifera
  misc_feature: Coding regions on vcDNA: vcDNA=SeqID_12046; Strand=+; Position=418-739
  misc_feature: Homolog annotation: Hit_ID=AAL04511.1; Match level="QueryCoverage =87%, HitCoverage=42%, E-value=9e-17, Identity=50%"; Hit description =ATPase 6 [Anastrepha suspensa] gb|AAL04509.1| ATPase 6 [Anastrepha suspensa]
  misc_feature (31)..(31): Xaa can be any naturally occurring amino acid
  misc_feature (73)..(73): Xaa can be any naturally occurring amino acid
MCTEEYVRRHHILSQLVPEGTPPILMPFIAXTQTMRHVRRPGTLAGRLTANISSGDSLITHLRYTVTILCTLXPDILIRAQVVLLILDTAVCIFLSYVFAVLEHDIL

SEQ ID NO: 32350 - protein, 334 aa, Diabrotica virgifera
  misc_feature: Coding regions on vcDNA: vcDNA=SeqID_12047; Strand=-; Position=0-1001
  misc_feature (4)..(332): Xaa can be any naturally occurring amino acid
KKMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGR

SEQ ID NO: 32351 - protein, 176 aa, Diabrotica virgifera
  misc_feature: Coding regions on vcDNA: vcDNA=SeqID_12048; Strand=-; Position=1-528
  misc_feature (1)..(29): Xaa can be any naturally occurring amino acid
  misc_feature (36)..(43): Xaa can be any naturally occurring amino acid
  misc_feature (47)..(170): Xaa can be any naturally occurring amino acid
XXXXXXXXXXXXXXXXXXXXXXXXXXXXXFKLIGGXXXXXXXXKKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRITISL

SEQ ID NO: 32352 - protein, 66 aa, Diabrotica virgifera; identical to SEQ ID NO: 26808
  misc_feature: Coding regions on vcDNA: vcDNA=SeqID_12049; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32353 - protein, 250 aa, Diabrotica virgifera
  misc_feature: Coding regions on vcDNA: vcDNA=SeqID_12050; Strand=+; Position=1-750
  misc_feature (1)..(16): Xaa can be any naturally occurring amino acid
  misc_feature (19)..(55): Xaa can be any naturally occurring amino acid
  misc_feature (59)..(179): Xaa can be any naturally occurring amino acid
  misc_feature (188)..(195): Xaa can be any naturally occurring amino acid
  misc_feature (199)..(221): Xaa can be any naturally occurring amino acid
  misc_feature (227)..(248): Xaa can be any naturally occurring amino acid
XXXXXXXXXXXXXXXXPRXXXXXXXXXXXXXXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLKTRLFXXXXXXXXPTDXXXXXXXXXXXXXXXXXXXXXXXGNGRVXXXXXXXXXXXXXXXXXXXXXXIS

SEQ ID NO: 32354 - protein, 32 aa, Diabrotica virgifera
  misc_feature: Coding regions on vcDNA: vcDNA=SeqID_12051; Strand=-; Position=3-98
  misc_feature (5)..(5): Xaa can be any naturally occurring amino acid
  misc_feature (9)..(29): Xaa can be any naturally occurring amino acid
YPPQXKIIXXXXXXXXXXXXXXXXXXXXXFLV

SEQ ID NO: 32355 - protein, 192 aa, Diabrotica virgifera
  misc_feature: Coding regions on vcDNA: vcDNA=SeqID_12052; Strand=+; Position=241-816
  misc_feature (14)..(21): Xaa can be any naturally occurring amino acid
  misc_feature (29)..(43): Xaa can be any naturally occurring amino acid
  misc_feature (46)..(67): Xaa can be any naturally occurring amino acid
  misc_feature (90)..(131): Xaa can be any naturally occurring amino acid
  misc_feature (151)..(172): Xaa can be any naturally occurring amino acid
  misc_feature (178)..(191): Xaa can be any naturally occurring amino acid
SKRYSFFKYHLIFXXXXXXXXYLTISFIXXXXXXXXXXXXXXXRAXXXXXXXXXXXXXXXXXXXXXXFKIRYLITFKSSIYLLFFIKFFXXXXXXXXXXXXXXXXXXXXXXXXXXXXXXXXXXXXXXXXXXLLKTRLFGFKYKGLARPPIXXXXXXXXXXXXXXXXXXXXXXLEWKEXXXXXXXXXXXXXXL

SEQ ID NO: 32356 - protein, 258 aa, Diabrotica virgifera
  misc_feature: Coding regions on vcDNA: vcDNA=SeqID_12053; Strand=+; Position=94-870
  misc_feature: Homolog annotation: Hit_ID=AAO67521.1; Match level="QueryCoverage =81%, HitCoverage=54%, E-value=2e-22, Identity=30%"; Hit description =SINA [Schistosoma mansoni] sp|Q86MW9|SINA_SCHMA Ubiquitin ligase SINA (Seven in absentia homolog) (SmSINA)
  misc_feature: Gene Ontology Annotation: Molecular function=transcription co -repressor activity; Cellular component=cytoplasm; Biological process= small GTPase mediated signal transduction
  misc_feature: Pfam annotation: Pfam_ID=Sina; Match level="Score=-9.2, E-value=1.6e -06, Copies=1"; Pfam description=Seven in absentia protein family
YNSWYNFGIWLAEQIMQCPLCLETTSPPIIQCKVGHSMCGSCIKESGIKMCPTCREKLTTTRNYQLEQLIEGIKDVLKFDCAYQHKGCKFAVNKQDKENHERECKFRKFTCEGKRFAKWSCNWSGDYSEIYQHFKRDHKDNTRLEFKTDAVMKVSLKTSFNNVYLISLFSGQSYLYCKHRVDTSNKKIYFHFQFIGLKSQAQHYYYEFEVYKGTRKFKITEICTSDTSNIDITFAEKCFVMSFIAVKNYLNEEGELPF

SEQ ID NO: 32357 - protein, 277 aa, Diabrotica virgifera
  misc_feature: Coding regions on vcDNA: vcDNA=SeqID_12054; Strand=+; Position=1-831
  misc_feature (4)..(40): Xaa can be any naturally occurring amino acid
  misc_feature (43)..(80): Xaa can be any naturally occurring amino acid
  misc_feature (84)..(220): Xaa can be any naturally occurring amino acid
  misc_feature (225)..(248): Xaa can be any naturally occurring amino acid
  misc_feature (254)..(277): Xaa can be any naturally occurring amino acid
YLFXXXXXXXXXXXXXXXXXXXXXXXXXXXXXXXXXXXXXVPXXXXXXXXXXXXXXXXXXXXXXXXXXXXXXXXXXXXXXTKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHWIXXXXXXXXXXXXXXXXXXXXXXXXWRGVDXXXXXXXXXXXXXXXXXXXXXXXX

SEQ ID NO: 32358 - protein, 235 aa, Diabrotica virgifera
  misc_feature: Coding regions on vcDNA: vcDNA=SeqID_12055; Strand=-; Position=1-705
  misc_feature (1)..(1): Xaa can be any naturally occurring amino acid
  misc_feature (5)..(25): Xaa can be any naturally occurring amino acid
  misc_feature (31)..(38): Xaa can be any naturally occurring amino acid
  misc_feature (43)..(52): Xaa can be any naturally occurring amino acid
  misc_feature (57)..(63): Xaa can be any naturally occurring amino acid
  misc_feature (73)..(193): Xaa can be any naturally occurring amino acid
  misc_feature (196)..(233): Xaa can be any naturally occurring amino acid
XNLSXXXXXXXXXXXXXXXXXXXXXTPSFRXXXXXXXXCYLSXXXXXXXXXXNRWAXXXXXXXQKDVFLINGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRY

SEQ ID NO: 32359 - protein, 264 aa, Diabrotica virgifera
  misc_feature: Coding regions on vcDNA: vcDNA=SeqID_12056; Strand=-; Position=3-794
  misc_feature (10)..(262): Xaa can be any naturally occurring amino acid
TLYPPKVIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTF

SEQ ID NO: 32360 - protein, 99 aa, Diabrotica virgifera
  misc_feature: Coding regions on vcDNA: vcDNA=SeqID_12057; Strand=+; Position=2-298
  misc_feature (2)..(15): Xaa can be any naturally occurring amino acid
  misc_feature (22)..(22): Xaa can be any naturally occurring amino acid
  misc_feature (27)..(34): Xaa can be any naturally occurring amino acid
  misc_feature (37)..(44): Xaa can be any naturally occurring amino acid
  misc_feature (66)..(98): Xaa can be any naturally occurring amino acid
NXXXXXXXXXXXXXXRPRCWIXVYNWXXXXXXXXVRXXXXXXXXFKPCEPGWVSSLFYNIFLNERXXXXXXXXXXXXXXXXXXXXXXXXXXXXXXXXXP

SEQ ID NO: 32361 - protein, 230 aa, Diabrotica virgifera
  misc_feature: Coding regions on vcDNA: vcDNA=SeqID_12058; Strand=+; Position=64-753
  misc_feature (10)..(19): Xaa can be any naturally occurring amino acid
  misc_feature (22)..(58): Xaa can be any naturally occurring amino acid
  misc_feature (62)..(78): Xaa can be any naturally occurring amino acid
  misc_feature (80)..(88): Xaa can be any naturally occurring amino acid
  misc_feature (92)..(127): Xaa can be any naturally occurring amino acid
  misc_feature (131)..(199): Xaa can be any naturally occurring amino acid
  misc_feature (202)..(228): Xaa can be any naturally occurring amino acid
LISTARESFXXXXXXXXXXTSXXXXXXXXXXXXXXXXXXXXXXXXXXXXXXXXXXXXXNRNXXXXXXXXXXXXXXXXXLXXXXXXXXXFILXXXXXXXXXXXXXXXXXXXXXXXXXXXXXXXXXXXXYYLXXXXXXXXXXXXXXXXXXXXXXXXXXXXXXXXXXXXXXXXXXXXXXXXXXXXXXXXXXXXXXXXXXXXXAHXXXXXXXXXXXXXXXXXXXXXXXXXXXRV

SEQ ID NO: 32362 - protein, 101 aa, Diabrotica virgifera; identical to SEQ ID NO: 29675
  misc_feature: Coding regions on vcDNA: vcDNA=SeqID_12059; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 32363 - protein, 80 aa, Diabrotica virgifera
  misc_feature: Coding regions on vcDNA: vcDNA=SeqID_12060; Strand=-; Position=1-240
FFCRRCCSFCLCGSPLGSASFCLCLCFPVSCFVLLVCACVVWLLCVSCFFVLPLCLVLCVLLVVLPSCLCAVFFVFCLSF

SEQ ID NO: 32364 - protein, 107 aa, Diabrotica virgifera
  misc_feature: Coding regions on vcDNA: vcDNA=SeqID_12061; Strand=+; Position=129-452
SSKKLFSPNNIGLLDRRALRHFHGTRGKTSQISSRKGRRSYHFFSRNINIRFLSLTQRTGSVNRHQKLNFSGSNHRSRSSARKNIASGLRIKQTVSKIYKDGRVKIP

SEQ ID NO: 32365 - protein, 162 aa, Diabrotica virgifera
  misc_feature: Coding regions on vcDNA: vcDNA=SeqID_12062; Strand=-; Position=1-486
  misc_feature (29)..(38): Xaa can be any naturally occurring amino acid
  misc_feature (45)..(51): Xaa can be any naturally occurring amino acid
YNNTFITKFTHYVRYLIKYFIPNLLKFSXXXXXXXXXXTNNSLSXXXXXXXTLSFYSTSHITIKNPSALSTLLTRSYSLFNSLFIVFFILFISLRCYLHQSIIYQHLSQTFYLFIKISRLILRNSLLSSLSSPFFFPFPFSLPVLFKEIGSKHVKNSDVLGR

SEQ ID NO: 32366 - protein, 164 aa, Diabrotica virgifera
  misc_feature: Coding regions on vcDNA: vcDNA=SeqID_12063; Strand=+; Position=1-492
  misc_feature: Homolog annotation: Hit_ID=AAV34817.1; Match level="QueryCoverage =100%, HitCoverage=61%, E-value=1e-16, Identity=37%"; Hit description= ribosomal protein L7A [Bombyx mori]
  misc_feature: Gene Ontology Annotation: Molecular function=structural constituent of ribosome; Cellular component=cytosolic ribosome (sensu Eukarya); Biological process=protein biosynthesis
PLAVLWVARCFVVFPLFVGWPCGFGLGRGVLPPRVFSRFVFWPVFLRLRCRVAVLPVGLVVPPPVFRFSPPFGSLAASLFFWVLVGSWPVSALPLCGWFAGPAVALVARLAGAPALFPLALWAGAFSVPSLFGLVSAPLGVVALAVVPVVLVLFLPALCRFVGV

SEQ ID NO: 32367 - protein, 195 aa, Diabrotica virgifera
  misc_feature: Coding regions on vcDNA: vcDNA=SeqID_12064; Strand=+; Position=68-655
  misc_feature: Homolog annotation: Hit_ID=XP_392004.1; Match level="QueryCoverage =78%, HitCoverage=33%, E-value=3e-26, Identity=37%"; Hit description =similar to ENSANGP00000023239 [Apis mellifera]
  misc_feature: Gene Ontology Annotation: Molecular function=permease activity; Cellular component=cellular_component unknown; Biological process =biological_process unknown
MWPQVYFKTASIASLATPFGCFFAGPFADRYGRRMALFFVNIVCLLGWITIAVFCYAKPSHFWILLLGRVLTGLSTGLCSSPATVYMAEISSPDLRGIFTTWASVSFSLGVLVVYFLGFLFQSNLGAICLITAVFPCVGILFSIFLIPESPTWLVGRYRTEEARSSLCRIFNTGLTPDVQAELDHLIKWQRSGRT

SEQ ID NO: 32368 - protein, 221 aa, Diabrotica virgifera
  misc_feature: Coding regions on vcDNA: vcDNA=SeqID_12065; Strand=-; Position=2-664
  misc_feature (19)..(39): Xaa can be any naturally occurring amino acid
  misc_feature (44)..(217): Xaa can be any naturally occurring amino acid
LKNEILYRLNRDCFFFMQXXXXXXXXXXXXXXXXXXXXXTRPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAGG

SEQ ID NO: 32369 - protein, 169 aa, Diabrotica virgifera
  misc_feature: Coding regions on vcDNA: vcDNA=SeqID_12066; Strand=+; Position=151-657
  misc_feature: Homolog annotation: Hit_ID=NP_033567.1; Match level="QueryCoverage =54%, HitCoverage=12%, E-value=4e-11, Identity=40%"; Hit description =zinc finger and BTB domain containing 17 [Mus musculus] gb|AAA64848.1| polyomavirus late
  misc_feature: Gene Ontology Annotation: Molecular function=ATP binding; Cellular component=nucleus; Biological process=regulation of transcription, DNA-dependent
  misc_feature: Pfam annotation: Pfam_ID=zf-C2H2; Match level="Score=28.3, E-value =2.3e-05, Copies=1"; Pfam description=Zinc finger, C2H2 type
MELTQEVSVKTYKIEIDNNQVCDDPLSTFKIEIKEEPKREHTYDAFDYSEFHQLAENTELEQDEYKFNLFEENQTKNDEGCPKEENKMETLPAHSSREENYRGQHVEVVKQFTISDSLKQHLRVHTVEKPHKCEICVKQFMQAGDLKRHLRVHTGEKSRKGDVYLNQIF

SEQ ID NO: 32370 - protein, 106 aa, Diabrotica virgifera
  misc_feature: Coding regions on vcDNA: vcDNA=SeqID_12067; Strand=+; Position=243-563
GQDETCSNTWINNSAKYTPSYKVLERDLTQNGYIQFLKYINDVPPITDYTFCIWLRSHNLTHNHPILSYSKNEEESLIRVWIAQYGKSINLEISGGTYFRISVKFY

SEQ ID NO: 32371 - protein, 308 aa, Diabrotica virgifera
  misc_feature: Coding regions on vcDNA: vcDNA=SeqID_12068; Strand=+; Position=1-923
  misc_feature: Homolog annotation: Hit_ID=XP_392968.1; Match level="QueryCoverage =98%, HitCoverage=16%, E-value=7e-57, Identity=41%"; Hit description =similar to ENSANGP00000008519 [Apis mellifera]
  misc_feature: Gene Ontology Annotation: Molecular function=translation factor activity, nucleic acid binding; Cellular component=ribosome; Biological process=regulation of translation
  misc_feature (92)..(97): Xaa can be any naturally occurring amino acid
  misc_feature (208)..(208): Xaa can be any naturally occurring amino acid
SRGPGPQFLPKQLEAQPNQKLKEQTIRSRLTELNTTVQECLSMIQAAARGNPFHLSLHFKDLLPTLLQDLQSPLAAPLICKLFTSLRKTVFXXXXXXLGELVANLTLRLANPQCDLDSNWESENINKAMVRAVALIHDKTVPKKTEDHSEMCFTVPAFCYIFPFLKYSLVSNYARNHDELVHDGLQIIAEHAKLRGTEENGVKDIYHXRYLPTKQILSLLVGIINSTHGRVQSQCEACLLEVASCISGQLGCAKASTDEIDVLLGALQSPFSVLRDAALRGLTIDILALPTFEKDYAYVIKVFKRVWI

SEQ ID NO: 32372 - protein, 205 aa, Diabrotica virgifera
  misc_feature: Coding regions on vcDNA: vcDNA=SeqID_12069; Strand=+; Position=112-728
  misc_feature: Homolog annotation: Hit_ID=NP_958889.1; Match level="QueryCoverage =99%, HitCoverage=24%, E-value=4e-66, Identity=66%"; Hit description =valosin containing protein [Danio rerio] gb|AAH67384.1| Valosin containing protein [Danio rerio]
  misc_feature: Gene Ontology Annotation: Molecular function=protein binding; Cellular component=microsome; Biological process=microtubule cytoskeleton organization and biogenesis
  misc_feature: Pfam annotation: Pfam_ID=CDC48_N; Match level="Score=72.3, E-value =1.3e-18, Copies=1"; Pfam description=Cell division protein 48 (CDC48), N-te
  misc_feature (66)..(66): Xaa can be any naturally occurring amino acid
  misc_feature (115)..(115): Xaa can be any naturally occurring amino acid
  misc_feature (133)..(133): Xaa can be any naturally occurring amino acid
  misc_feature (148)..(148): Xaa can be any naturally occurring amino acid
MDENENPEDLATAILRKKDRPNRLLVEEADNDDNSVVALSQAKMDELRLFRGETGLLKGKRGRETXVCIVLCDDTCSDEKIRMNRNVRNNLRDRLSNVVCIQGWPGVKYGERIHXLPMDDTVEGLTGNLFEVXLKPYSPGELSTSTQXDVFGVRGGRRAGEFKGVETDPAPDSKVAPDSGIHRDGDPNKREEEEEVRNAEVYGDI

SEQ ID NO: 32373 - protein, 234 aa, Diabrotica virgifera
  misc_feature: Coding regions on vcDNA: vcDNA=SeqID_12070; Strand=+; Position=226-927
  misc_feature: Homolog annotation: Hit_ID=XP_396730.1; Match level="QueryCoverage =76%, HitCoverage=79%, E-value=2e-55, Identity=56%"; Hit description =similar to hypothetical protein FLJ90798 [Apis mellifera]
  misc_feature: Pfam annotation: Pfam_ID=zf-CCHC; Match level="Score=14.5, E-value =0.0055, Copies=1"; Pfam description=Zinc knuckle
  misc_feature (147)..(162): Xaa can be any naturally occurring amino acid
  misc_feature (216)..(216): Xaa can be any naturally occurring amino acid
MAPTATIISPSSTLSSPFALSRTQQDYGCNGSLNSLLSSFPATNWCHYQNNDQYQTKLLSPTWSAYSTNQQYSFNLYSPTYSNLSACDHLGDITEQLADLSLDRRQIKRPPPSYLCHLCFQKGHYIKDCPQARPKGEGKTPYQGRKXXXXXXXXXXXXXXXXSGNSWSNMGQECIKCHINVFPHKQRPLENPMGLDVSDQSKVHPQHLCQKCKELXYYCRRVHTEIPPPVFVSF

SEQ ID NO: 32374 - protein, 66 aa, Diabrotica virgifera
  misc_feature: Coding regions on vcDNA: vcDNA=SeqID_12071; Strand=-; Position=2-199
  misc_feature (2)..(13): Xaa can be any naturally occurring amino acid
  misc_feature (15)..(15): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXXXPXLGSTGLNXXXXXXXXSNXXXXXXXXXXXXXXPTSRSXXXXXXXXXXXXXXV

SEQ ID NO: 32375 - protein, 216 aa, Diabrotica virgifera
  misc_feature: Coding regions on vcDNA: vcDNA=SeqID_12072; Strand=-; Position=1-648
  misc_feature (2)..(33): Xaa can be any naturally occurring amino acid
  misc_feature (35)..(43): Xaa can be any naturally occurring amino acid
  misc_feature (58)..(67): Xaa can be any naturally occurring amino acid
  misc_feature (70)..(102): Xaa can be any naturally occurring amino acid
  misc_feature (105)..(157): Xaa can be any naturally occurring amino acid
  misc_feature (162)..(201): Xaa can be any naturally occurring amino acid
  misc_feature (204)..(216): Xaa can be any naturally occurring amino acid
SXXXXXXXXXXXXXXXXXXXXXXXXXXXXXXXXTXXXXXXXXXILYNLNQASFSFIQXXXXXXXXXXNDXXXXXXXXXXXXXXXXXXXXXXXXXXXXXXXXXQVXXXXXXXXXXXXXXXXXXXXXXXXXXXXXXXXXXXXXXXXXXXXXXXXXXXXXNNHIXXXXXXXXXXXXXXXXXXXXXXXXXXXXXXXXXXXXXXXXDEXXXXXXXXXXXXX

SEQ ID NO: 32376 - protein, 235 aa, Diabrotica virgifera
  misc_feature: Coding regions on vcDNA: vcDNA=SeqID_12073; Strand=+; Position=158-865
  misc_feature: Homolog annotation: Hit_ID=XP_317256.1; Match level="QueryCoverage =84%, HitCoverage=41%, E-value=4e-49, Identity=44%"; Hit description =ENSANGP00000021816 [Anopheles gambiae]
  misc_feature (90)..(90): Xaa can be any naturally occurring amino acid
MEFVKENLGLVLFLTIFLLIYIYYKNAYKYWKNMGVPQLDPEFPFGDMYDTIFRKQNMGDKIKEIYDKMKGRRFVGLYFFSRKAFLPLDXDFQYFYDRGIYYNEKKDPLSAHLFSIAGTKWKNLRSKLTPAYSPGKLKYMFGTIDKCGHTMTKKLQEIANEKGEVEIKEILARYTTDVIGSCAFGLECHCMTDPEAEFRLMGKRAFTQTWNSEFSTHSRFIRSLVYFSGNVTDFF

SEQ ID NO: 32377 - protein, 204 aa, Diabrotica virgifera
  misc_feature: Coding regions on vcDNA: vcDNA=SeqID_12074; Strand=+; Position=171-786
  misc_feature: Homolog annotation: Hit_ID=NP_572448.1; Match level="QueryCoverage =100%, HitCoverage=40%, E-value=6e-37, Identity=39%"; Hit description= CG2263-PA [Drosophila melanogaster] gb|AAF46332.1| CG2263-PA [Drosophila melanogaster]
  misc_feature: Gene Ontology Annotation: Molecular function=phenylalanine-tRNA ligase activity; Cellular component=soluble fraction; Biological process=morphogenesis
  misc_feature (17)..(17): Xaa can be any naturally occurring amino acid
  misc_feature (29)..(29): Xaa can be any naturally occurring amino acid
  misc_feature (73)..(73): Xaa can be any naturally occurring amino acid
  misc_feature (147)..(147): Xaa can be any naturally occurring amino acid
  misc_feature (156)..(156): Xaa can be any naturally occurring amino acid
LTSAFNENHHKVIGALXSILAHGDLVVPXPVCNNKLELTEEGKSIAEKGSYEAMIYNILDENGLPQAEVMILXNAINMSFRRAMTSGWEEIDKSVTPPMEKKKVPQINDVIHEHLKQILTEDISSIISDEEKQEYYKRKLIQQVAVXPLINRKDRXLNLTLTQLQTHLTCERINSGAWNNLKFTEYNFNALCAPLSSEYLHALL

SEQ ID NO: 32378 - protein, 263 aa, Diabrotica virgifera
  misc_feature: Coding regions on vcDNA: vcDNA=SeqID_12075; Strand=+; Position=1-789
  misc_feature (1)..(200): Xaa can be any naturally occurring amino acid
  misc_feature (203)..(228): Xaa can be any naturally occurring amino acid
  misc_feature (231)..(258): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHXXXXXXXXXXXXXXXXXXXXXXXXXXMKXXXXXXXXXXXXXXXXXXXXXXXXXXXXRRETL

SEQ ID NO: 32379 - protein, 98 aa, Diabrotica virgifera
  misc_feature: Coding regions on vcDNA: vcDNA=SeqID_12076; Strand=+; Position=250-546
  misc_feature (47)..(62): Xaa can be any naturally occurring amino acid
SMLKDIYLFIMPSSPICTIYLYAYIDSYDLMLDYSYPRTYEEPISPXXXXXXXXXXXXXXXXIMELPVSISDTSHVPSMLQYIIHHNLFSEVTMNLLI

SEQ ID NO: 32380 - protein, 74 aa, Diabrotica virgifera
  misc_feature: Coding regions on vcDNA: vcDNA=SeqID_12077; Strand=+; Position=744-965
  misc_feature (39)..(39): Xaa can be any naturally occurring amino acid
  misc_feature (48)..(48): Xaa can be any naturally occurring amino acid
LLDQPQTSLLHWHLATLAFYRLIKLYRQFFVFSALFLLXYIFRPLLYXKQLFLEIFRKYIYLWDYHIEGRHDHQ

SEQ ID NO: 32381 - protein, 114 aa, Diabrotica virgifera
  misc_feature: Coding regions on vcDNA: vcDNA=SeqID_12078; Strand=+; Position=3-347
  misc_feature (15)..(43): Xaa can be any naturally occurring amino acid
TRKYNALLLSMFTSXXXXXXXXXXXXXXXXXXXXXXXXXXXXXVAEEKRQDVYEGELTDSAEEDYPHRTSSLREEKYTVEKLYIALAPQGQNTMELPRRYGRSREAGKEQLKRQ

SEQ ID NO: 32382 - protein, 179 aa, Diabrotica virgifera
  misc_feature: Coding regions on vcDNA: vcDNA=SeqID_12079; Strand=+; Position=295-834
  misc_feature: Homolog annotation: Hit_ID=XP_312920.1; Match level="QueryCoverage =81%, HitCoverage=26%, E-value=7e-19, Identity=38%"; Hit description =ENSANGP00000024669 [Anopheles gambiae]
AVNMDHLLLENMVYLAAFPDPRHPSGPTGAYSEQNGEVVPAPQAQTSSSSTSNPPNLSSPAPQVSAQTGTGDPLASPTTSRSPWAYITLVKRKSNIGEEFEGNLATLGGRPRLIENLPSELQGVRRRRSPEVMAVVVSHVVQTRSSRNGLEVILTVLIQVVVSWRWSLCPQFWSKQRNW

SEQ ID NO: 32383 - protein, 262 aa, Diabrotica virgifera
  misc_feature: Coding regions on vcDNA: vcDNA=SeqID_12080; Strand=+; Position=13-796
  misc_feature: Homolog annotation: Hit_ID=XP_310665.1; Match level="QueryCoverage =92%, HitCoverage=34%, E-value=1e-132, Identity=92%"; Hit description= ENSANGP00000020753 [Anopheles gambiae]
  misc_feature: Gene Ontology Annotation: Molecular function=dolichyl-diphospho -oligosaccharide-protein glycosyltransferase activity; Cellular component=integral to plasma membrane; Biological process=N-linked glycosylation
  misc_feature (208)..(208): Xaa can be any naturally occurring amino acid
  misc_feature (245)..(245): Xaa can be any naturally occurring amino acid
MFVVVITVLLISYTFHCTWVTSEAYSSPSIVLSARSHDGGRIIFDDFREAYYWLKMNTPEDARIMSWWDYGYQITAMANRTILVDNNTWNNTHISRVGQAMASTEEKAYEIMKELDVDYVLVIFGGLTGYSSDDINKFLWMVRIGGSTDRGAHIKEWDYYSPSGEFRVDKEGSQTLLNCLMYKMGYYRFGQVYTEGGKPPGYDRVRGXAEIGNKDFELDVLEEAYTTEHWLVRIYKVKDLPNRGXFGIFFFSNVLYTKFFYY

SEQ ID NO: 32384 - protein, 242 aa, Diabrotica virgifera
  misc_feature: Coding regions on vcDNA: vcDNA=SeqID_12081; Strand=+; Position=46-774
  misc_feature: Homolog annotation: Hit_ID=NP_723587.1; Match level="QueryCoverage =72%, HitCoverage=87%, E-value=3e-12, Identity=27%"; Hit description =CG5183-PC, isoform C [Drosophila melanogaster] ref|NP_723586.1| CG5183-PB, isoform B [Drosophila
  misc_feature: Gene Ontology Annotation: Molecular function=KDEL sequence binding; Cellular component=membrane; Biological process=protein targeting
  misc_feature: Pfam annotation: Pfam_ID=ER_lumen_recept; Match level="Score=-63.2, E- value=5e-09, Copies=1"; Pfam description=ER lumen protein retaining receptor
MDFILCSLLAIATLYLISAILKHKSYVGVSAKTQLLYTVALVVQGEISILYILLIAFPSIVAFTLAFKMRDTYEKEVDSFWAEILLIAAFILSVYVQPHFSSFGVLSTFSDYLETVAFIPQLYMIWNSKGTTKHMKVYIQLLFLYKLVNLLWLIYLILIHNLDWLTRQYNIKYSTVVILNFLVLSVAVLTVRSKRILHCEEENMDTKAQNIFVVTSGLAPPITLTKPNAITDVTNEANKPLV

SEQ ID NO: 32385 - protein, 193 aa, Diabrotica virgifera
  misc_feature: Coding regions on vcDNA: vcDNA=SeqID_12082; Strand=+; Position=362-941
  misc_feature: Homolog annotation: Hit_ID=XP_320884.1; Match level="QueryCoverage =97%, HitCoverage=82%, E-value=1e-53, Identity=42%"; Hit description =ENSANGP00000019179 [Anopheles gambiae]
  misc_feature: Gene Ontology Annotation: Molecular function=structural constituent of bone; Cellular component=collagen type I; Biological process =epidermal differentiation
  misc_feature: Pfam annotation: Pfam_ID=Collagen; Match level="Score=50.8, E-value =3.9e-12, Copies=2"; Pfam description=Collagen triple helix repeat (20 copi
  misc_feature (17)..(17): Xaa can be any naturally occurring amino acid
  misc_feature (43)..(43): Xaa can be any naturally occurring amino acid
  misc_feature (59)..(59): Xaa can be any naturally occurring amino acid
  misc_feature (79)..(79): Xaa can be any naturally occurring amino acid
  misc_feature (113)..(113): Xaa can be any naturally occurring amino acid
  misc_feature (119)..(119): Xaa can be any naturally occurring amino acid
  misc_feature (127)..(127): Xaa can be any naturally occurring amino acid
  misc_feature (180)..(180): Xaa can be any naturally occurring amino acid
GIAWVKERLGLGEPGKXGEAGPLGPAGPSGDAGKDGNPGPQGXPGPPGVERRKKAPGGXGARGFQASGAGGNPGSPGKXMGEQGVQGPIGWVSGPQGQRGERGFPGERGLPGXSGLPGXKGATGAQXADGPLGPDGPPGPKGHPGLPGAIGLPGLRGAPGSQGEKGEHGSVGPIGPDGAXGRKGERGPMGSLG

SEQ ID NO: 32386 - protein, 264 aa, Diabrotica virgifera
  misc_feature: Coding regions on vcDNA: vcDNA=SeqID_12083; Strand=+; Position=1-792
  misc_feature (1)..(15): Xaa can be any naturally occurring amino acid
  misc_feature (18)..(55): Xaa can be any naturally occurring amino acid
  misc_feature (59)..(194): Xaa can be any naturally occurring amino acid
  misc_feature (198)..(211): Xaa can be any naturally occurring amino acid
  misc_feature (215)..(223): Xaa can be any naturally occurring amino acid
  misc_feature (226)..(252): Xaa can be any naturally occurring amino acid
  misc_feature (254)..(263): Xaa can be any naturally occurring amino acid
XXXXXXXXXXXXXXXVPXXXXXXXXXXXXXXXXXXXXXXXXXXXXXXXXXXXXXXRNRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPLXXXXXXXXXXXXXXANHXXXXXXXXXWKXXXXXXXXXXXXXXXXXXXXXXXXXXXEXXXXXXXXXXG

SEQ ID NO: 32387 - protein, 66 aa, Diabrotica virgifera
  misc_feature: Coding regions on vcDNA: vcDNA=SeqID_12084; Strand=-; Position=2-199
  misc_feature (3)..(13): Xaa can be any naturally occurring amino acid
  misc_feature (15)..(15): Xaa can be any naturally occurring amino acid
  misc_feature (21)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTXLAHTGXXXXXXXXXXSNXXXXXXXXXXXXXXPTSRSXXXXXXXXXXXXXXV

SEQ ID NO: 32388 - protein, 275 aa, Diabrotica virgifera
  misc_feature: Coding regions on vcDNA: vcDNA=SeqID_12085; Strand=-; Position=1-825
  misc_feature (2)..(274): Xaa can be any naturally occurring amino acid
VXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 32389 - protein, 305 aa, Diabrotica virgifera
  misc_feature: Coding regions on vcDNA: vcDNA=SeqID_12086; Strand=-; Position=1-915
  misc_feature (1)..(305): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32390 - protein, 453 aa, Diabrotica virgifera
  misc_feature: Coding regions on vcDNA: vcDNA=SeqID_12087; Strand=-; Position=0-1358
  misc_feature (15)..(23): Xaa can be any naturally occurring amino acid
  misc_feature (37)..(98): Xaa can be any naturally occurring amino acid
  misc_feature (101)..(178): Xaa can be any naturally occurring amino acid
  misc_feature (187)..(207): Xaa can be any naturally occurring amino acid
  misc_feature (214)..(232): Xaa can be any naturally occurring amino acid
  misc_feature (253)..(295): Xaa can be any naturally occurring amino acid
  misc_feature (339)..(346): Xaa can be any naturally occurring amino acid
  misc_feature (354)..(363): Xaa can be any naturally occurring amino acid
  misc_feature (369)..(385): Xaa can be any naturally occurring amino acid
FLSSPFLFPPLPPRXXXXXXXXXGGGRGERGEGREVXXXXXXXXXXXXXXXXXXXXXXXXXXXXXXXXXXXXXXXXXXXXXXXXXXXXXXXXXXXXXXWGXXXXXXXXXXXXXXXXXXXXXXXXXXXXXXXXXXXXXXXXXXXXXXXXXXXXXXXXXXXXXXXXXXXXXXXXXXXXXXKKGREGLFXXXXXXXXXXXXXXXXXXXXXEGRRASXXXXXXXXXXXXXXXXXXXAGARGRRSPPPKYILFSVGAXXXXXXXXXXXXXXXXXXXXXXXXXXXXXXXXXXXXXXXXXXXFFPSSPPLVRPPPSLCGCLYIITPTTPPPSLWGGVSLFSHNPLXXXXXXXXAAPLSWGXXXXXXXXXXPFLGGXXXXXXXXXXXXXXXXXVMYFPGSASLFRGVGGGGSGFFPSRSLLVAPFPFVVVGFFVGRLVVSSSSFFSCYRGRGGRPGYSGPV

SEQ ID NO: 32391 - protein, 37 aa, Diabrotica virgifera
  misc_feature: Coding regions on vcDNA: vcDNA=SeqID_12088; Strand=-; Position=0-110
  misc_feature (3)..(9): Xaa can be any naturally occurring amino acid
  misc_feature (28)..(35): Xaa can be any naturally occurring amino acid
TIXXXXXXXIRKRIIYVRTDTLLVWKVXXXXXXXXIS

SEQ ID NO: 32392 - protein, 289 aa, Diabrotica virgifera
  misc_feature: Coding regions on vcDNA: vcDNA=SeqID_12089; Strand=-; Position=1-867
  misc_feature (1)..(187): Xaa can be any naturally occurring amino acid
  misc_feature (190)..(227): Xaa can be any naturally occurring amino acid
  misc_feature (230)..(237): Xaa can be any naturally occurring amino acid
  misc_feature (251)..(259): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRYXXXXXXXXKEKILSRILINYRXXXXXXXXXEEVFIILKGRRIGRGGGRREFSDPVPSKAY

SEQ ID NO: 32393 - protein, 284 aa, Diabrotica virgifera
  misc_feature: Coding regions on vcDNA: vcDNA=SeqID_12090; Strand=-; Position=187 -1041
  misc_feature (1)..(31): Xaa can be any naturally occurring amino acid
  misc_feature (33)..(91): Xaa can be any naturally occurring amino acid
  misc_feature (93)..(106): Xaa can be any naturally occurring amino acid
  misc_feature (114)..(257): Xaa can be any naturally occurring amino acid
  misc_feature (262)..(268): Xaa can be any naturally occurring amino acid
XXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXPXXXXXXXXXXXXXXTLPRSKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIPFXXXXXXXTIYCPIISLFLWFFCI

SEQ ID NO: 32394 - protein, 280 aa, Diabrotica virgifera
  misc_feature: Coding regions on vcDNA: vcDNA=SeqID_12091; Strand=-; Position=0-839
  misc_feature (1)..(222): Xaa can be any naturally occurring amino acid
  misc_feature (225)..(262): Xaa can be any naturally occurring amino acid
  misc_feature (265)..(277): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRYXXXXXXXXXXXXXLSR

SEQ ID NO: 32395 - protein, 272 aa, Diabrotica virgifera
  misc_feature: Coding regions on vcDNA: vcDNA=SeqID_12092; Strand=+; Position=100-918
  misc_feature: Homolog annotation: Hit_ID=EAL51907.1; Match level="QueryCoverage =75%, HitCoverage=14%, E-value=4e-11, Identity=28%"; Hit description =Viral A-type inclusion protein repeat, putative [Entamoeba histolytica HM-1:IMSS]
ATSNTIPNQRLLVLLLTNLCRLELFQVDPQFDHRDKNGKDFKSLERDSHKLKSDRESTDKIKYLEDNLQELNKDYSKLKLECDQKENQLSELRNKFDFEVVFKKLEIEYSKKVEEAEKLQEALENAQTNSKNIRNSKLEELEKTLAKCKMELLQTKDKLKQSELAKEEAADESIKVKLQESRNTIEAIKSDLENKVKQINQLKDIIKSEGETKTKLLHDNTELAHSLELVRQIIRSFVSEMGNKEKELHAECGNMLRNTPKKWSKILNYLVS

SEQ ID NO: 32396 - protein, 143 aa, Diabrotica virgifera
  misc_feature: Coding regions on vcDNA: vcDNA=SeqID_12093; Strand=-; Position=3-431
  misc_feature (14)..(30): Xaa can be any naturally occurring amino acid
  misc_feature (36)..(64): Xaa can be any naturally occurring amino acid
  misc_feature (75)..(92): Xaa can be any naturally occurring amino acid
  misc_feature (103)..(143): Xaa can be any naturally occurring amino acid
FHFSIKHIIKILPXXXXXXXXXXXXXXXXXLILSSXXXXXXXXXXXXXXXXXXXXXXXXXXXXXHNIIILLILIXXXXXXXXXXXXXXXXXXLKIIPYFFYLXXXXXXXXXXXXXXXXXXXXXXXXXXXXXXXXXXXXXXXXX

SEQ ID NO: 32397 - protein, 172 aa, Diabrotica virgifera
  misc_feature: Coding regions on vcDNA: vcDNA=SeqID_12094; Strand=-; Position=538 -1056
  misc_feature (3)..(27): Xaa can be any naturally occurring amino acid
  misc_feature (32)..(69): Xaa can be any naturally occurring amino acid
  misc_feature (72)..(142): Xaa can be any naturally occurring amino acid
KRXXXXXXXXXXXXXXXXXXXXXXXXXKCYSXXXXXXXXXXXXXXXXXXXXXXXXXXXXXXXXXXXXXXDEXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 32398 - protein, 299 aa, Diabrotica virgifera
  misc_feature: Coding regions on vcDNA: vcDNA=SeqID_12095; Strand=-; Position=2-898
  misc_feature (5)..(58): Xaa can be any naturally occurring amino acid
  misc_feature (60)..(84): Xaa can be any naturally occurring amino acid
  misc_feature (89)..(224): Xaa can be any naturally occurring amino acid
  misc_feature (228)..(265): Xaa can be any naturally occurring amino acid
  misc_feature (268)..(297): Xaa can be any naturally occurring amino acid
PPQLXXXXXXXXXXXXXXXXXXXXXXXXXXXXXXXXXXXXXXXXXXXXXXXXXXXXXXLXXXXXXXXXXXXXXXXXXXXXXXXXNRWAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXXXXXXXXXXXXXXEVXXXXXXXXXXXXXXXXXXXXXXXXXXXXXXEK

SEQ ID NO: 32399 - protein, 238 aa, Diabrotica virgifera
  misc_feature: Coding regions on vcDNA: vcDNA=SeqID_12096; Strand=-; Position=60-776
  misc_feature (13)..(31): Xaa can be any naturally occurring amino acid
  misc_feature (39)..(48): Xaa can be any naturally occurring amino acid
  misc_feature (54)..(174): Xaa can be any naturally occurring amino acid
  misc_feature (178)..(215): Xaa can be any naturally occurring amino acid
  misc_feature (220)..(226): Xaa can be any naturally occurring amino acid
SRFFFHPPLPFQXXXXXXXXXXXXXXXXXXXLHINPWAXXXXXXXXXXVFLITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXXXXXXXXXXXXXXEVRKXXXXXXXSEGLSHGTNSRC

SEQ ID NO: 32400 - protein, 64 aa, Diabrotica virgifera
  misc_feature: Coding regions on vcDNA: vcDNA=SeqID_12097; Strand=-; Position=358-552
EVLSKKDTVASLTDNTRHTYMWVHSDTLAIAINHFYLSNGMPYKLYQRYFCLLISLPYRFQDKN

SEQ ID NO: 32401 - protein, 284 aa, Diabrotica virgifera
  misc_feature: Coding regions on vcDNA: vcDNA=SeqID_12098; Strand=-; Position=1-852
  misc_feature (12)..(57): Xaa can be any naturally occurring amino acid
  misc_feature (65)..(201): Xaa can be any naturally occurring amino acid
  misc_feature (204)..(242): Xaa can be any naturally occurring amino acid
  misc_feature (244)..(256): Xaa can be any naturally occurring amino acid
  misc_feature (260)..(274): Xaa can be any naturally occurring amino acid
  misc_feature (277)..(283): Xaa can be any naturally occurring amino acid
SIGVSRLLKKFXXXXXXXXXXXXXXXXXXXXXXXXXXXXXXXXXXXXXXXXXXXXXXLQINRWAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXSLTXXXXXXXXXXXXXXXEKXXXXXXXK

SEQ ID NO: 32402 - protein, 70 aa, Diabrotica virgifera
  misc_feature: Coding regions on vcDNA: vcDNA=SeqID_12099; Strand=-; Position=26-238
TDPNVATKHSSGKLLIYINRTPCTNTTTQRFLCQNIQSDLFFNENKKFCCASHPDCQSSFLEVVSPGVLF

SEQ ID NO: 32403 - protein, 84 aa, Diabrotica virgifera
  misc_feature: Coding regions on vcDNA: vcDNA=SeqID_12100; Strand=+; Position=2-256
  misc_feature (1)..(69): Xaa can be any naturally occurring amino acid
XXXXXXXXXXXXXXXXXXXXXXXXXXXXXXXXXXXXXXXXXXXXXXXXXXXXXXXXXXXXXXXXXXXXXHYLNPSSDDNNSIKK

SEQ ID NO: 32404 - protein, 197 aa, Diabrotica virgifera
  misc_feature: Coding regions on vcDNA: vcDNA=SeqID_12101; Strand=-; Position=0-590
  misc_feature (10)..(23): Xaa can be any naturally occurring amino acid
  misc_feature (27)..(51): Xaa can be any naturally occurring amino acid
  misc_feature (58)..(64): Xaa can be any naturally occurring amino acid
  misc_feature (73)..(80): Xaa can be any naturally occurring amino acid
  misc_feature (86)..(101): Xaa can be any naturally occurring amino acid
  misc_feature (103)..(127): Xaa can be any naturally occurring amino acid
  misc_feature (142)..(160): Xaa can be any naturally occurring amino acid
  misc_feature (168)..(194): Xaa can be any naturally occurring amino acid
KKLGTKNWFXXXXXXXXXXXXXXSPPXXXXXXXXXXXXXXXXXXXXXXXXXSIGVFSXXXXXXXFCFRNEILXXXXXXXXFHAALXXXXXXXXXXXXXXXXRXXXXXXXXXXXXXXXXXXXXXXXXXHTQDEKDVAEFRSYXXXXXXXXXXXXXXXXXXXRIIIIYSXXXXXXXXXXXXXXXXXXXXXXXXXXXFNL

SEQ ID NO: 32405 - protein, 44 aa, Diabrotica virgifera
  misc_feature: Coding regions on vcDNA: vcDNA=SeqID_12102; Strand=+; Position=3-134
  misc_feature (3)..(28): Xaa can be any naturally occurring amino acid
GDXXXXXXXXXXXXXXXXXXXXXXXXXXIIYLGIQRIFIGEFNR

SEQ ID NO: 32406 - protein, 63 aa, Diabrotica virgifera
  misc_feature: Coding regions on vcDNA: vcDNA=SeqID_12103; Strand=-; Position=59-250
  misc_feature (5)..(15): Xaa can be any naturally occurring amino acid
NNTSXXXXXXXXXXXNKHIHSIDHVTFNNHKSITFIHKYIIGQIQKRKSPIKKTKYSHSMRIY

SEQ ID NO: 32407 - protein, 34 aa, Diabrotica virgifera
  misc_feature: Coding regions on vcDNA: vcDNA=SeqID_12104; Strand=-; Position=1-105
  misc_feature (1)..(32): Xaa can be any naturally occurring amino acid
XXXXXXXXXXXXXXXXXXXXXXXXXXXXXXXXNK

SEQ ID NO: 32408 - protein, 276 aa, Diabrotica virgifera
  misc_feature: Coding regions on vcDNA: vcDNA=SeqID_12105; Strand=+; Position=3-830
  misc_feature (1)..(32): Xaa can be any naturally occurring amino acid
  misc_feature (35)..(229): Xaa can be any naturally occurring amino acid
  misc_feature (231)..(240): Xaa can be any naturally occurring amino acid
  misc_feature (243)..(259): Xaa can be any naturally occurring amino acid
  misc_feature (261)..(270): Xaa can be any naturally occurring amino acid
XXXXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXRGXXXXXXXXXXXXXXXXXKXXXXXXXXXXDPYRVL

SEQ ID NO: 32409 - protein, 74 aa, Diabrotica virgifera
  misc_feature: Coding regions on vcDNA: vcDNA=SeqID_12106; Strand=-; Position=293-517
PSLMVRIRKEVGAFLYDMLKITETPWLLAAKAQSLKMFLLCVRMGSLCAFILQRLLPYRGDCEYVTDVERVAYM

SEQ ID NO: 32410 - protein, 39 aa, Diabrotica virgifera
  misc_feature: Coding regions on vcDNA: vcDNA=SeqID_12107; Strand=-; Position=0-116
  misc_feature (9)..(38): Xaa can be any naturally occurring amino acid
NFPLFSLRXXXXXXXXXXXXXXXXXXXXXXXXXXXXXXP

SEQ ID NO: 32411 - protein, 32 aa, Diabrotica virgifera
  misc_feature: Coding regions on vcDNA: vcDNA=SeqID_12108; Strand=-; Position=0-95
EDGRYSFLKHLSTKKIVSMRSNALRRNISHLP

SEQ ID NO: 32412 - protein, 284 aa, Diabrotica virgifera
  misc_feature: Coding regions on vcDNA: vcDNA=SeqID_12109; Strand=+; Position=85-939
  misc_feature: Homolog annotation: Hit_ID=XP_393769.1; Match level="QueryCoverage =97%, HitCoverage=57%, E-value=3e-97, Identity=59%"; Hit description =similar to ENSANGP00000010487 [Apis mellifera]
  misc_feature: Pfam annotation: Pfam_ID=PhyH; Match level="Score=193.8, E-value=3.5e- 55, Copies=1"; Pfam description=Phytanoyl-CoA dioxygenase (PhyH)
  misc_feature (137)..(137): Xaa can be any naturally occurring amino acid
  misc_feature (224)..(224): Xaa can be any naturally occurring amino acid
KESLKLEGFAVIENLFTPEEVEEMKNEAQNLIKSMPGESKRTVFSTTHSESQQNKDKYFLDSGDKIAYFYEQGALGPNGELLVEPENSLNKIGHALHELNPVFKKHTFSEKIKEAAFQLGFEEPVIPQSMYIFKNPXIGSEVTAHQDASYLHTDPLKVAGFWIALDDATVENGCLWFSRRSHNGGIHRRFIRNPDPNADELLIYNSAAPYYQKSSFSPVPVTKXCILIHGQVVHYSEANKSDKSRHAYTFHIVESKNTTYSKDNWLQPTNRQFFNLYRNYFAII

SEQ ID NO: 32413 - protein, 24 aa, Diabrotica virgifera
  misc_feature: Coding regions on vcDNA: vcDNA=SeqID_12110; Strand=-; Position=1-75
  misc_feature (1)..(22): Xaa can be any naturally occurring amino acid
XXXXXXXXXXXXXXXXXXXXXXPL

SEQ ID NO: 32414 - protein, 79 aa, Diabrotica virgifera
  misc_feature: Coding regions on vcDNA: vcDNA=SeqID_12111; Strand=+; Position=181-420
SFIPVVSKCTRSLFGNEFTSVFGCTSESIQFLSYFHRFPPLGYHQENSSNSIFIIIISCQIGIIILDIVIDRDQSLGFL

SEQ ID NO: 32415 - protein, 55 aa, Diabrotica virgifera
  misc_feature: Coding regions on vcDNA: vcDNA=SeqID_12112; Strand=+; Position=300-467
  misc_feature (34)..(39): Xaa can be any naturally occurring amino acid
APGGPNKATVKYNSRGVQWCQSIIPYRTIIIIFXXXXXXIGFRLLVQKTNSLLFF

SEQ ID NO: 32416 - protein, 222 aa, Diabrotica virgifera
  misc_feature: Coding regions on vcDNA: vcDNA=SeqID_12113; Strand=+; Position=191-859
  misc_feature (197)..(197): Xaa can be any naturally occurring amino acid
  misc_feature (210)..(210): Xaa can be any naturally occurring amino acid
  misc_feature (219)..(219): Xaa can be any naturally occurring amino acid
RQRGCHSKSNKLSSETVSLMKHQIETIQKTSGCKRHYNLHESQRIYLSDELNVRKLWDHYIEKNPDNKVSYEAYRKYFNENFNISFGSPRMDTCSSCDQFLAEIKCINSQLRTCTGETVKEEFNQESKKLEVENKLHILKAEKFYAIKKSARLCARKDNTVTSITMDFQKNLYIANITTNDVYYKRQLVYDETTGKXGADAVVSHLLDFXVCIFCDSCXGSE

SEQ ID NO: 32417 - protein, 70 aa, Diabrotica virgifera
  misc_feature: Coding regions on vcDNA: vcDNA=SeqID_12114; Strand=-; Position=0-209
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (52)..(64): Xaa can be any naturally occurring amino acid
PFXXXXXXXXXXXTNLAHTGLNXXXXXXXXSNXXXXXXXXPIINCNPTSRSXXXXXXXXXXXXXLRDNKV

SEQ ID NO: 32418 - protein, 57 aa, Diabrotica virgifera
  misc_feature: Coding regions on vcDNA: vcDNA=SeqID_12115; Strand=-; Position=203-376
KYVISTIYQSLLINIQFINNYTFFRKELALSNDAYAIYPSNIYHWQVSVDYHKISVL

SEQ ID NO: 32419 - protein, 135 aa, Diabrotica virgifera
  misc_feature: Coding regions on vcDNA: vcDNA=SeqID_12116; Strand=+; Position=10-414
RPREHKRTRNPFSRSNGQKTAKKKKQKRTARERNTPENEEETGEPLTARSKNDKTQPQQRRHHKEQDKPRKRSGQPPKRRKQRQQKSGEEGHTRKHRTDEKTEKTRTKQTQTDGAPRTRQRRPATGRATNPGEEQ

SEQ ID NO: 32420 - protein, 45 aa, Diabrotica virgifera
  misc_feature: Coding regions on vcDNA: vcDNA=SeqID_12117; Strand=-; Position=159-296
  misc_feature (2)..(26): Xaa can be any naturally occurring amino acid
GXXXXXXXXXXXXXXXXXXXXXXXXXIRINYLRDNSVILLESSNR

SEQ ID NO: 32421 - protein, 59 aa, Diabrotica virgifera
  misc_feature: Coding regions on vcDNA: vcDNA=SeqID_12118; Strand=+; Position=279-458
  misc_feature (49)..(58): Xaa can be any naturally occurring amino acid
SYTSLGTRVNLYIPWRMRTPTVWHSSLHIISHVLQIRLCENRIYYYSFXXXXXXXXXXL

SEQ ID NO: 32422 - protein, 67 aa, Diabrotica virgifera
  misc_feature: Coding regions on vcDNA: vcDNA=SeqID_12119; Strand=-; Position=2-202
  misc_feature (3)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
VLXXXXXXXXXXXXPTWAHTGLNXXXXXXXXSNXXXXXXXXXXXXXXPTSRSXXXXXXXXXXXXXXV

SEQ ID NO: 32423 - protein, 20 aa, Diabrotica virgifera
  misc_feature: Coding regions on vcDNA: vcDNA=SeqID_12120; Strand=-; Position=0-59
  misc_feature (1)..(19): Xaa can be any naturally occurring amino acid
XXXXXXXXXXXXXXXXXXXP

SEQ ID NO: 32424 - protein, 310 aa, Diabrotica virgifera
  misc_feature: Coding regions on vcDNA: vcDNA=SeqID_12121; Strand=+; Position=3-935
  misc_feature: Homolog annotation: Hit_ID=XP_393145.1; Match level="QueryCoverage =93%, HitCoverage=47%, E-value=4e-98, Identity=61%"; Hit description =similar to ENSANGP00000004072 [Apis mellifera]
  misc_feature: Gene Ontology Annotation: Cellular component=nucleus; Biological process=RNA processing
  misc_feature (282)..(282): Xaa can be any naturally occurring amino acid
GLSSPTIPVVLLGDIFETLTLDICENMFGFVEQNVNVWKEELFFSYCKNNLLRLCNDLLRRLSRTTATVFCGKILLFLAKFFPFSERSGLNIVSEFNLENVTEYGTDPPDDEIAEIKIGEQKNLIDFTFYCKFWQLQDFFRNPIQCYNKVQWKLFSSHATNVLNTFQGIKLDYVNSGTSTQNSSNLGYFAKYLTSQKLLELQLHDVNFRRSVLLQFLILFQYFTSTVRFKTDAHELKNDQKEWISTNTEKVYSLLKETRQMGEEFAEIVKNVLSREELLDAXKNESCPEIKKHYHSPRKFRKGKGIQINP

SEQ ID NO: 32425 - protein, 64 aa, Diabrotica virgifera
  misc_feature: Coding regions on vcDNA: vcDNA=SeqID_12122; Strand=+; Position=373-567
QLTFMNISSLSIRTLLKKQRTLLNLKKNRRIVYDSMNFRILMLLSHARLYRSRKRICPIKTLFP

SEQ ID NO: 32426 - protein, 183 aa, Diabrotica virgifera
  misc_feature: Coding regions on vcDNA: vcDNA=SeqID_12123; Strand=+; Position=1-552
  misc_feature (36)..(42): Xaa can be any naturally occurring amino acid
EDADNTEIKEPFEKVVLQHYNIEDIWKEANSNVAKXXXXXXXLLKNINNTPYGKNKSSSHNISRGINISPQNNASLSNMRHNIQQSSCSNFLLPNINHISTHNQNRNNMPENFSLEKGIAQHESKKKFDFKKVGTDVSPTKPTNAENVVISCSEMSVTADKKDSEIWKSVLEDVDSESLFGDF

SEQ ID NO: 32427 - protein, 47 aa, Diabrotica virgifera; identical to SEQ ID NO: 26759
  misc_feature: Coding regions on vcDNA: vcDNA=SeqID_12124; Strand=+; Position=1-144
  misc_feature (1)..(15): Xaa can be any naturally occurring amino acid
  misc_feature (17)..(24): Xaa can be any naturally occurring amino acid

SEQ ID NO: 32428 - protein, 22 aa, Diabrotica virgifera
  misc_feature: Coding regions on vcDNA: vcDNA=SeqID_12125; Strand=-; Position=1-66
  misc_feature (1)..(18): Xaa can be any naturally occurring amino acid
  misc_feature (21)..(21): Xaa can be any naturally occurring amino acid
XXXXXXXXXXXXXXXXXXLNXF

SEQ ID NO: 32429 - protein, 17 aa, Diabrotica virgifera
  misc_feature: Coding regions on vcDNA: vcDNA=SeqID_12126; Strand=-; Position=2-52
  misc_feature (2)..(12): Xaa can be any naturally occurring amino acid
  misc_feature (14)..(15): Xaa can be any naturally occurring amino acid
IXXXXXXXXXXXKXXKL

SEQ ID NO: 32430 - protein, 30 aa, Diabrotica virgifera
  misc_feature: Coding regions on vcDNA: vcDNA=SeqID_12127; Strand=-; Position=3-92
  misc_feature (25)..(25): Xaa can be any naturally occurring amino acid
NIAATPIINLIPHRGRNLYYRLTLXIKLRC

SEQ ID NO: 32431 - protein, 83 aa, Diabrotica virgifera
  misc_feature: Coding regions on vcDNA: vcDNA=SeqID_12128; Strand=-; Position=1-249
  misc_feature (3)..(43): Xaa can be any naturally occurring amino acid
  misc_feature (45)..(69): Xaa can be any naturally occurring amino acid
  misc_feature (73)..(83): Xaa can be any naturally occurring amino acid
ENXXXXXXXXXXXXXXXXXXXXXXXXXXXXXXXXXXXXXXXXXFXXXXXXXXXXXXXXXXXXXXXXXXXIGGXXXXXXXXXXX

SEQ ID NO: 32432 - protein, 130 aa, Diabrotica virgifera
  misc_feature: Coding regions on vcDNA: vcDNA=SeqID_12129; Strand=-; Position=1-390
FCVMGISKHNSTPIGEAITQIYRFLIIQKREIIHLNITKSSQRIHVQVVSATRSIPITVRATWSKIYLSQLQRFSYSLSINASYIDKIVPWITRYFQISLVNMCVCGVNMNRTVTPVAPGGGEEPRVRPG

SEQ ID NO: 32433 - protein, 94 aa, Diabrotica virgifera
  misc_feature: Coding regions on vcDNA: vcDNA=SeqID_12130; Strand=+; Position=3-287
  misc_feature (6)..(36): Xaa can be any naturally occurring amino acid
EEQGTXXXXXXXXXXXXXXXXXXXXXXXXXXXXXXXTPKPYSLLSNFTWSPSNKETLRYMNFKLDLEMSEHPRQYSQVKEIKEKYMEPPYVVFT

SEQ ID NO: 32434 - protein, 98 aa, Diabrotica virgifera
  misc_feature: Coding regions on vcDNA: vcDNA=SeqID_12131; Strand=+; Position=1-294
  misc_feature (1)..(11): Xaa can be any naturally occurring amino acid
  misc_feature (16)..(95): Xaa can be any naturally occurring amino acid
XXXXXXXXXXXAHGLXXXXXXXXXXXXXXXXXXXXXXXXXXXXXXXXXXXXXXXXXXXXXXXXXXXXXXXXXXXXXXXXXXXXXXXXXXXXXXXXLGG

SEQ ID NO: 32435 - protein, 257 aa, Diabrotica virgifera
  misc_feature: Coding regions on vcDNA: vcDNA=SeqID_12132; Strand=-; Position=2-772
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(255): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXND

SEQ ID NO: 32436 - protein, 23 aa, Diabrotica virgifera
  misc_feature: Coding regions on vcDNA: vcDNA=SeqID_12133; Strand=+; Position=1-69
  misc_feature (5)..(20): Xaa can be any naturally occurring amino acid
KTRNXXXXXXXXXXXXXXXXLFI

SEQ ID NO: 32437 - protein, 66 aa, Diabrotica virgifera; identical to SEQ ID NO: 26808
  misc_feature: Coding regions on vcDNA: vcDNA=SeqID_12134; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32438 - protein, 297 aa, Diabrotica virgifera
  misc_feature: Coding regions on vcDNA: vcDNA=SeqID_12135; Strand=+; Position=21-914
  misc_feature: Homolog annotation: Hit_ID=XP_322015.1; Match level="QueryCoverage =81%, HitCoverage=26%, E-value=1e-48, Identity=43%"; Hit description =ENSANGP00000012023 [Anopheles gambiae]
  misc_feature: Gene Ontology Annotation: Molecular function=snoRNA binding; Cellular component=nucleus; Biological process=processing of 20S pre-rRNA
  misc_feature: Pfam annotation: Pfam_ID=Utp12; Match level="Score=82.9, E-value=8.7e- 22, Copies=1"; Pfam description=Dip2/Utp12 Family
  misc_feature (58)..(58): Xaa can be any naturally occurring amino acid
ESKAKVLSVLHTRTLKLEDSVLCVKISPNGKFIAVGLLDSTVKIFFVDTLKGHAGEAXDGQFVVSCGADRVLRMYEKSDQILVLEDEQEEEREQQEELATGEQTVIPGQPGLNLPSRKTIGSEKATENILECLAICEKYKEHLVEHAALQAASSQTLPLPVPPSLMLALNVSTPGDFFLETIKRIRPSDLEESMMILPFSAVCEILQILPTLLSRGVQTELICKISMFLLKLHYAPIIANQYLLGALEKLLRIKRSNWLQLLWHKVYSKKIEAADSVHWLEMPLEQKPKLIRKQKQP

SEQ ID NO: 32439 - protein, 87 aa, Diabrotica virgifera
  misc_feature: Coding regions on vcDNA: vcDNA=SeqID_12136; Strand=-; Position=2-262
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(82): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXINYAV

SEQ ID NO: 32440 - protein, 161 aa, Diabrotica virgifera
  misc_feature: Coding regions on vcDNA: vcDNA=SeqID_12137; Strand=+; Position=1-486
  misc_feature (1)..(9): Xaa can be any naturally occurring amino acid
  misc_feature (11)..(121): Xaa can be any naturally occurring amino acid
  misc_feature (125)..(138): Xaa can be any naturally occurring amino acid
XXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYKXXXXXXXXXXXXXXEPSLRYIIIRLLIDNRNEYLDEK

SEQ ID NO: 32441 - protein, 197 aa, Diabrotica virgifera
  misc_feature: Coding regions on vcDNA: vcDNA=SeqID_12138; Strand=+; Position=184-774
MFFYSSVTMRDLIRKYKLIIQGKHLPDADSELLISSTSSPGNTYNMEVGNPRLFQQGYSSTESEDDSPKKSSYLNSQQYMPKKEQVLSRSYNNSLIMDKHDNALYDVLQHSSLNEIISETTKLLPSKSKMSDSVQQSKNVSNDIKKHYNHSLVTILLDLQYGILQLAHHFWLWLGEWKKLVYFLVFLSICLWRRYAC

SEQ ID NO: 32442 - protein, 84 aa, Diabrotica virgifera
  misc_feature: Coding regions on vcDNA: vcDNA=SeqID_12139; Strand=+; Position=329-583
ESLLLGKMLFYCKIKSGQYFLIRVYIKPEIKYKVFRITRLNQRLLKKQHGVRFGHSKYFVLFSSLIYPCCQILLVNICFLYFRL

SEQ ID NO: 32443 - protein, 82 aa, Diabrotica virgifera
  misc_feature: Coding regions on vcDNA: vcDNA=SeqID_12140; Strand=-; Position=1-246
  misc_feature (3)..(52): Xaa can be any naturally occurring amino acid
  misc_feature (57)..(82): Xaa can be any naturally occurring amino acid
PQXXXXXXXXXXXXXXXXXXXXXXXXXXXXXXXXXXXXXXXXXXXXXXXXXXPPSIXXXXXXXXXXXXXXXXXXXXXXXXXX

SEQ ID NO: 32444 - protein, 53 aa, Diabrotica virgifera
  misc_feature: Coding regions on vcDNA: vcDNA=SeqID_12141; Strand=+; Position=2-163
  misc_feature: Homolog annotation: Hit_ID=EAL24946.1; Match level="QueryCoverage =98%, HitCoverage=23%, E-value=2e-12, Identity=61%"; Hit description =GA10234-PA [Drosophila pseudoobscura]
  misc_feature: Gene Ontology Annotation: Molecular function=translation initiation factor activity; Cellular component=eukaryotic translation initiation factor 3 complex; Biological process=translational initiation
DDSTLKLWVKKYGWKDMTGNLIFIANQDENIKTKNINEKIDFENVGAIMASCR

SEQ ID NO: 32445 - protein, 24 aa, Diabrotica virgifera
  misc_feature: Coding regions on vcDNA: vcDNA=SeqID_12142; Strand=-; Position=1-72
  misc_feature (15)..(23): Xaa can be any naturally occurring amino acid
HDLSLNRCEPGWFLXXXXXXXXXR

SEQ ID NO: 32446 - protein, 212 aa, Diabrotica virgifera
  misc_feature: Coding regions on vcDNA: vcDNA=SeqID_12143; Strand=-; Position=1-636
  misc_feature (6)..(212): Xaa can be any naturally occurring amino acid
LFLFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32447 - protein, 297 aa, Diabrotica virgifera
  misc_feature: Coding regions on vcDNA: vcDNA=SeqID_12144; Strand=-; Position=1-891
  misc_feature (3)..(297): Xaa can be any naturally occurring amino acid
KWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32448 - protein, 234 aa, Diabrotica virgifera
  misc_feature: Coding regions on vcDNA: vcDNA=SeqID_12145; Strand=-; Position=1-702
  misc_feature (8)..(49): Xaa can be any naturally occurring amino acid
  misc_feature (55)..(63): Xaa can be any naturally occurring amino acid
  misc_feature (69)..(176): Xaa can be any naturally occurring amino acid
  misc_feature (178)..(212): Xaa can be any naturally occurring amino acid
  misc_feature (216)..(230): Xaa can be any naturally occurring amino acid
DSFSFIHXXXXXXXXXXXXXXXXXXXXXXXXXXXXXXXXXXXXXXXXXXHNNQVXXXXXXXXXNPIYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXPQGXXXXXXXXXXXXXXXNPNY

SEQ ID NO: 32449 - protein, 242 aa, Diabrotica virgifera
  misc_feature: Coding regions on vcDNA: vcDNA=SeqID_12146; Strand=+; Position=71-792
  misc_feature: Homolog annotation: Hit_ID=XP_392496.1; Match level="QueryCoverage =89%, HitCoverage=31%, E-value=6e-72, Identity=64%"; Hit description =similar to ENSANGP00000018542 [Apis mellifera]
  misc_feature: Gene Ontology Annotation: Molecular function=solute:cation symporter activity; Cellular component=integral to plasma membrane; Biological process=transport
  misc_feature: Pfam annotation: Pfam_ID=efhand; Match level="Score=28.9, E-value =1.5e-05, Copies=5"; Pfam description=EF hand
  misc_feature (138)..(138): Xaa can be any naturally occurring amino acid
  misc_feature (150)..(150): Xaa can be any naturally occurring amino acid
  misc_feature (171)..(171): Xaa can be any naturally occurring amino acid
  misc_feature (217)..(217): Xaa can be any naturally occurring amino acid
  misc_feature (219)..(219): Xaa can be any naturally occurring amino acid
  misc_feature (232)..(232): Xaa can be any naturally occurring amino acid
FSFPCIKFDLKLLRECLIVWTVTDKFNLFKKVNCQEGGGFLRRANEGSLHEIFNRYATVDKNGEKFMTAEDFVIKYLKLLDDQNYNKDTVKLLAAIVDTSKDGLISYPEFQAFEGLLCFPDALYKTAFQLFDTNGNGXMVSFSEFVEVMXRKLNWHRKIPFNRDSPFIQLXYFGKDKSRVVSYNEFSQFLHDFHEEYAIEGFRRADTKSSGFISLSXFXEIYDSIKSHLLTXTSQSHLIEAA

SEQ ID NO: 32450 - protein, 101 aa, Diabrotica virgifera; identical to SEQ ID NO: 29675
  misc_feature: Coding regions on vcDNA: vcDNA=SeqID_12147; Strand=-; Position=204-509
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 32451 - protein, 60 aa, Diabrotica virgifera
  misc_feature: Coding regions on vcDNA: vcDNA=SeqID_12148; Strand=+; Position=411-590
YGGLEGVLCYLDALNKTALQLCYTKVDVMLSSTECNDVTKRIELLRSIPLTMDTPIIQLY

SEQ ID NO: 32452 - protein, 72 aa, Diabrotica virgifera
  misc_feature: Coding regions on vcDNA: vcDNA=SeqID_12149; Strand=-; Position=2-217
  misc_feature (29)..(36): Xaa can be any naturally occurring amino acid
  misc_feature (39)..(52): Xaa can be any naturally occurring amino acid
  misc_feature (58)..(71): Xaa can be any naturally occurring amino acid
LFYIFSLSVLIYIYNIKIDAHLAHTGLIXXXXXXXXSNXXXXXXXXXXXXXXPTSRSXXXXXXXXXXXXXXV

SEQ ID NO: 32453 - protein, 107 aa, Diabrotica virgifera
  misc_feature: Coding regions on vcDNA: vcDNA=SeqID_12150; Strand=+; Position=501-824
  misc_feature (10)..(31): Xaa can be any naturally occurring amino acid
  misc_feature (38)..(63): Xaa can be any naturally occurring amino acid
  misc_feature (72)..(99): Xaa can be any naturally occurring amino acid
PNSYITIRTXXXXXXXXXXXXXXXXXXXXXXNSLLSYXXXXXXXXXXXXXXXXXXXXXXXXXXVIQAFRNIXXXXXXXXXXXXXXXXXXXXXXXXXXXXYFNRAHEA

SEQ ID NO: 32454 - protein, 96 aa, Diabrotica virgifera
  misc_feature: Coding regions on vcDNA: vcDNA=SeqID_12151; Strand=-; Position=384-674
  misc_feature (1)..(5): Xaa can be any naturally occurring amino acid
XXXXXIRRKEVGGDLVSNLSIGGYINTFIYITYKLFVTVHKVNQRYIIEHSVYTRDYSVKYFILLFCYILKFSTIQLTSKIDVNHVSMYSSDLSIK

SEQ ID NO: 32455 - protein, 316 aa, Diabrotica virgifera
  misc_feature: Coding regions on vcDNA: vcDNA=SeqID_12152; Strand=+; Position=1-952
  misc_feature: Homolog annotation: Hit_ID=XP_308477.1; Match level="QueryCoverage =94%, HitCoverage=46%, E-value=5e-61, Identity=34%"; Hit description =ENSANGP00000017902 [Anopheles gambiae]
  misc_feature: Gene Ontology Annotation: Molecular function=structural constituent of cytoskeleton; Cellular component=extracellular matrix; Biological process=heart development
  misc_feature (259)..(259): Xaa can be any naturally occurring amino acid
  misc_feature (277)..(277): Xaa can be any naturally occurring amino acid
  misc_feature (284)..(285): Xaa can be any naturally occurring amino acid
  misc_feature (288)..(289): Xaa can be any naturally occurring amino acid
GGSTGAPGLTPGQTVGAGQDGGWPGHVGAPGQTGGGAGQVGGWPGHLGAPGQTGGWPGQVGTPGQTGGWPSQSGPGSFVTVPGQTGGGTGNVPGLIGGPGQAVGGQISAVESDDSDSQVQTSVQHTENGTTAEAQAQGVFGGGTAQSQVSGTYSGSGSFSASAGSDDGKRGAQTQVSGAKEGAQSSAQGRGGVGQSQSQVVFSHETGQTSSSAQSGGITHGTQSQVQASEKGGLADAQSNGPGSTSSQAQIGFLPYDEXTLITAQNHLLGGGTAGAXSGTHSGXXPSXXSGRFKYGVNIQELHKLLREELDLVKFY

SEQ ID NO: 32456 - protein, 24 aa, Diabrotica virgifera
  misc_feature: Coding regions on vcDNA: vcDNA=SeqID_12153; Strand=-; Position=3-74
GKSRTNLHMSILNIQFRYTNNIIL

SEQ ID NO: 32457 - protein, 154 aa, Diabrotica virgifera
  misc_feature: Coding regions on vcDNA: vcDNA=SeqID_12154; Strand=-; Position=102-566
  misc_feature (26)..(33): Xaa can be any naturally occurring amino acid
  misc_feature (46)..(52): Xaa can be any naturally occurring amino acid
  misc_feature (60)..(91): Xaa can be any naturally occurring amino acid
  misc_feature (97)..(104): Xaa can be any naturally occurring amino acid
  misc_feature (110)..(117): Xaa can be any naturally occurring amino acid
  misc_feature (122)..(133): Xaa can be any naturally occurring amino acid
  misc_feature (139)..(148): Xaa can be any naturally occurring amino acid
YYPFFYFHISYTYILIINLYPTKNNXXXXXXXXYSKILKFSSLLFXXXXXXXQISFQISXXXXXXXXXXXXXXXXXXXXXXXXXXXXXXXXIYNILXXXXXXXXHIIYHXXXXXXXXLFHIXXXXXXXXXXXXPNPQVXXXXXXXXXXGKLSLQ

SEQ ID NO: 32458 - protein, 120 aa, Diabrotica virgifera
  misc_feature: Coding regions on vcDNA: vcDNA=SeqID_12155; Strand=-; Position=288-650
GMSDTKHTCYDHQEKKLDLPIFTCGNLLLNSSYSSHPVITMIRFSNYLFIVHLFLILFIHLRYQESGVLCHLDRKISRQELSFMQIHVHVLLLVCLIPKTQYQLHHFQVYLGQQFSCVGY

SEQ ID NO: 32459 - protein, 18 aa, Diabrotica virgifera
  misc_feature: Coding regions on vcDNA: vcDNA=SeqID_12156; Strand=-; Position=1-54
  misc_feature (7)..(16): Xaa can be any naturally occurring amino acid
YAVSPKXXXXXXXXXXIK

SEQ ID NO: 32460 - protein, 50 aa, Diabrotica virgifera
  misc_feature: Coding regions on vcDNA: vcDNA=SeqID_12157; Strand=+; Position=151-303
VLFLIPHYLIKPNMKYFTYPLVYVMTVMGALRIGKMTYYVFRHFRNFSCY

SEQ ID NO: 32461 - protein, 233 aa, Diabrotica virgifera
  misc_feature: Coding regions on vcDNA: vcDNA=SeqID_12158; Strand=-; Position=1-699
  misc_feature (1)..(233): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32462 - protein, 134 aa, Diabrotica virgifera
  misc_feature: Coding regions on vcDNA: vcDNA=SeqID_12159; Strand=-; Position=3-407
  misc_feature: Homolog annotation: Hit_ID=AAL73401.1; Match level="QueryCoverage =100%, HitCoverage=100%, E-value=4e-37, Identity=63%"; Hit description=ribosomal protein 49 [Apis mellifera] sp|Q8WRF3|RL32 _APIME 60S ribosomal protein L32 (Ribosomal protein
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L32e; Match level="Score=70.3, E -value=5.2e-18, Copies=1"; Pfam description=Ribosomal protein L32
MAIRPVFRPPILKKGAKKFPRPPSDRYGKLKGNRRKPKGFAPRVRRRFQGPYLMPNIGYGSHFKARPMLPPGFRKILGPHVKEPEVPPMPNRKYWAEIAPGVSPKKPQDFVERAPPLSFRVPKGNARFRTPEKE

SEQ ID NO: 32463 - protein, 43 aa, Diabrotica virgifera
  misc_feature: Coding regions on vcDNA: vcDNA=SeqID_12160; Strand=-; Position=2-130
  misc_feature (3)..(13): Xaa can be any naturally occurring amino acid
  misc_feature (23)..(30): Xaa can be any naturally occurring amino acid
  misc_feature (33)..(41): Xaa can be any naturally occurring amino acid
PFXXXXXXXXXXXTNLAHTGLNXXXXXXXXSNXXXXXXXXXNY

SEQ ID NO: 32464 - protein, 318 aa, Diabrotica virgifera
  misc_feature: Coding regions on vcDNA: vcDNA=SeqID_12161; Strand=-; Position=1-954
  misc_feature (1)..(318): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32465 - protein, 277 aa, Diabrotica virgifera
  misc_feature: Coding regions on vcDNA: vcDNA=SeqID_12162; Strand=-; Position=3-833
  misc_feature (16)..(277): Xaa can be any naturally occurring amino acid
KNLIIIYKLYRVSRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32466 - protein, 56 aa, Diabrotica virgifera
  misc_feature: Coding regions on vcDNA: vcDNA=SeqID_12163; Strand=-; Position=1-168
  misc_feature (4)..(24): Xaa can be any naturally occurring amino acid
  misc_feature (27)..(49): Xaa can be any naturally occurring amino acid
  misc_feature (54)..(55): Xaa can be any naturally occurring amino acid
KMGXXXXXXXXXXXXXXXXXXXXXLNXXXXXXXXXXXXXXXXXXXXXXXSLVFXXN

SEQ ID NO: 32467 - protein, 122 aa, Diabrotica virgifera
  misc_feature: Coding regions on vcDNA: vcDNA=SeqID_12164; Strand=+; Position=1-369
  misc_feature (3)..(11): Xaa can be any naturally occurring amino acid
  misc_feature (15)..(38): Xaa can be any naturally occurring amino acid
  misc_feature (40)..(48): Xaa can be any naturally occurring amino acid
  misc_feature (70)..(76): Xaa can be any naturally occurring amino acid
  misc_feature (78)..(108): Xaa can be any naturally occurring amino acid
  misc_feature (110)..(116): Xaa can be any naturally occurring amino acid
GGXXXXXXXXXGKGXXXXXXXXXXXXXXXXXXXXXXXXWXXXXXXXXXPLGMGKKGGRGKEIFNYWGGKXXXXXXXPXXXXXXXXXXXXXXXXXXXXXXXXXXXXXXXPXXXXXXXPWNLGP

SEQ ID NO: 32468 - protein, 93 aa, Diabrotica virgifera
  misc_feature: Coding regions on vcDNA: vcDNA=SeqID_12165; Strand=+; Position=286-564
  misc_feature: Homolog annotation: Hit_ID=XP_321756.1; Match level="QueryCoverage =49%, HitCoverage=46%, E-value=8e-13, Identity=71%"; Hit description =ENSANGP00000025384 [Anopheles gambiae]
  misc_feature: Gene Ontology Annotation: Cellular component=basal lamina
  misc_feature (79)..(84): Xaa can be any naturally occurring amino acid
MKMYQFSFAFWLLLIQITSRIREFNGEYIGARQRIFHPSRGYEPKKLHPCEQSSCYPATGNLLIGRESQLYASSTCGVXXXXXXCIVSHLDAE

SEQ ID NO: 32469 - protein, 47 aa, Diabrotica virgifera
  misc_feature: Coding regions on vcDNA: vcDNA=SeqID_12166; Strand=-; Position=0-140
  misc_feature (1)..(43): Xaa can be any naturally occurring amino acid
XXXXXXXXXXXXXXXXXXXXXXXXXXXXXXXXXXXXXXXXXXXPGGG

SEQ ID NO: 32470 - protein, 46 aa, Diabrotica virgifera
  misc_feature: Coding regions on vcDNA: vcDNA=SeqID_12167; Strand=-; Position=268-408
NLLYNKTCTSFSFAECQGSKHFQADVFALTVHLYRKFSSHFHIKST

SEQ ID NO: 32471 - protein, 270 aa, Diabrotica virgifera
  misc_feature: Coding regions on vcDNA: vcDNA=SeqID_12168; Strand=-; Position=39-851
  misc_feature: Homolog annotation: Hit_ID=AAH85669.1; Match level="QueryCoverage =98%, HitCoverage=53%, E-value=2e-34, Identity=34%"; Hit description =Unknown (protein for IMAGE:7048060) [Danio rerio]
  misc_feature: Pfam annotation: Pfam_ID=LRR_1; Match level="Score=20.1, E-value =0.0067, Copies=2"; Pfam description=Leucine Rich Repeat
  misc_feature (8)..(8): Xaa can be any naturally occurring amino acid
QIRSDHNXRRLKYLDLEGNEIRRWSEINKLSVIKTLEHMTIENIKLESIRFEENSIPVNCFNNLETLNLNDNLLSEWRSIGELNKLEKFRHLRLLKNPVLETENLATREQIIIAKIKHLQSLNGRHIRDDERRGAEYDYIKKYALEWMKIENAVDRENFLLEHNRFLQLIEMYGLPEEAELIVKPNIIQSSLVNLIFRYNGTEKIKSLPQNILVQKLILLVKKMFKLRERPVLIYSSALQPDIKIELCDEFKELHYYSVQDGDTIIVQDF

SEQ ID NO: 32472 - protein, 100 aa, Diabrotica virgifera
  misc_feature: Coding regions on vcDNA: vcDNA=SeqID_12169; Strand=+; Position=326-628
SKNPQHVLSPEMKSSSSLLLKYMRSSLPTNETYVSVITDLPTAVSLQRNAFFIARIEHKYHLQTDQIKRIDPDLTRKSTYLSSNTSKTHTLLPAPIYSTR

SEQ ID NO: 32473 - protein, 96 aa, Diabrotica virgifera
  misc_feature: Coding regions on vcDNA: vcDNA=SeqID_12170; Strand=-; Position=1-288
  misc_feature (1)..(13): Xaa can be any naturally occurring amino acid
  misc_feature (15)..(15): Xaa can be any naturally occurring amino acid
  misc_feature (17)..(96): Xaa can be any naturally occurring amino acid
XXXXXXXXXXXXXKXTXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32474 - protein, 136 aa, Diabrotica virgifera
  misc_feature: Coding regions on vcDNA: vcDNA=SeqID_12171; Strand=+; Position=179-589
  misc_feature: Homolog annotation: Hit_ID=CAA10770.1; Match level="QueryCoverage =88%, HitCoverage=35%, E-value=2e-13, Identity=28%"; Hit description =reverse transcriptase-like [Bos taurus]
NCLICERILTILMGILTLKCYMWSLLLYGCETWTFKQYDVNKLNSLEMWMYHRILRISWTSRTTNEEVLEIMNTRPHLVNTIKIRKTSYLGHIICHKEFEQLQVILEGKIEGKRDIGRKKKILTPKHQRLNPHNRK

SEQ ID NO: 32475 - protein, 190 aa, Diabrotica virgifera
  misc_feature: Coding regions on vcDNA: vcDNA=SeqID_12172; Strand=-; Position=1-570
  misc_feature (1)..(167): Xaa can be any naturally occurring amino acid
  misc_feature (169)..(190): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXX

SEQ ID NO: 32476 - protein, 45 aa, Diabrotica virgifera
  misc_feature: Coding regions on vcDNA: vcDNA=SeqID_12173; Strand=-; Position=3-137
  misc_feature (3)..(10): Xaa can be any naturally occurring amino acid
  misc_feature (33)..(33): Xaa can be any naturally occurring amino acid
FKXXXXXXXXSTRLNKYTATPIINLIQHRGRNXYYRLTSPIKLRC

SEQ ID NO: 32477 - protein, 43 aa, Diabrotica virgifera
  misc_feature: Coding regions on vcDNA: vcDNA=SeqID_12174; Strand=+; Position=2-133
  misc_feature (2)..(15): Xaa can be any naturally occurring amino acid
  misc_feature (22)..(22): Xaa can be any naturally occurring amino acid
  misc_feature (27)..(34): Xaa can be any naturally occurring amino acid
  misc_feature (39)..(39): Xaa can be any naturally occurring amino acid
NXXXXXXXXXXXXXXRPRCWIXVYNWXXXXXXXXVRLLXFYMI

SEQ ID NO: 32478 - protein, 72 aa, Diabrotica virgifera
  misc_feature: Coding regions on vcDNA: vcDNA=SeqID_12175; Strand=-; Position=1-216
  misc_feature (22)..(30): Xaa can be any naturally occurring amino acid
  misc_feature (38)..(47): Xaa can be any naturally occurring amino acid
  misc_feature (57)..(63): Xaa can be any naturally occurring amino acid
PKKIIRKSNIKVMLLKGKQLYXXXXXXXXXHYYNQNTXXXXXXXXXXAYHINIVEQXXXXXXXDNRYEIYVN

SEQ ID NO: 32479 - protein, 309 aa, Diabrotica virgifera
  misc_feature: Coding regions on vcDNA: vcDNA=SeqID_12176; Strand=+; Position=2-934
  misc_feature: Homolog annotation: Hit_ID=XP_308743.1; Match level="QueryCoverage =93%, HitCoverage=54%, E-value=6e-45, Identity=36%"; Hit description =ENSANGP00000015016 [Anopheles gambiae]
  misc_feature: Gene Ontology Annotation: Cellular component=microsome; Biological process=xenobiotic metabolism
  misc_feature (10)..(16): Xaa can be any naturally occurring amino acid
  misc_feature (194)..(194): Xaa can be any naturally occurring amino acid
  misc_feature (215)..(215): Xaa can be any naturally occurring amino acid
  misc_feature (281)..(281): Xaa can be any naturally occurring amino acid
  misc_feature (288)..(289): Xaa can be any naturally occurring amino acid
  misc_feature (296)..(296): Xaa can be any naturally occurring amino acid
LTLPSRFVLXXXXXXXCTTPTKCAKIIGVFPVFGRSHHILAIALMRGLADAGHDVTIVCSYEDNYSPKRGSYRTVILEGFAEEFANEAINLFDLQDFNNVFQEAVFEDYMYGITEKVFKDPGVNKLIQDKETFDAIIIEQFSNDALKALAYIFKSHLIAYNSFGSFNFVNRLVGNPTIISYTPQLISTFRRPMXLQDRIYNTILYTVEEIMNHFXFLPTQDKLIHKYFPDSPSVYDLTKNVSLVLVNSHETMGQAVPLVPNVISIGGFHVKPPKKLPEDLXSVLDSAXXGVIFFSXGVNLKSKDLPRIR

SEQ ID NO: 32480 - protein, 89 aa, Diabrotica virgifera
  misc_feature: Coding regions on vcDNA: vcDNA=SeqID_12177; Strand=+; Position=248-517
  misc_feature (30)..(39): Xaa can be any naturally occurring amino acid
SETCVHVSKILTNIRRLFILEETILIYVDXXXXXXXXXXANTKNIHKNLISKEKIGSKIYRIFDIRDDLFVSNNIWYLVDALVPYPFAL

SEQ ID NO: 32481 - protein, 215 aa, Diabrotica virgifera
  misc_feature: Coding regions on vcDNA: vcDNA=SeqID_12178; Strand=+; Position=24-671
  misc_feature: Homolog annotation: Hit_ID=NP_650690.1; Match level="QueryCoverage =72%, HitCoverage=35%, E-value=3e-10, Identity=28%"; Hit description =CG14314-PA [Drosophila melanogaster] gb|AAF55510.2| CG14314-PA [Drosophila melanogaster]
  misc_feature: Gene Ontology Annotation: Molecular function=molecular_function unknown
  misc_feature: Pfam annotation: Pfam_ID=DUF227; Match level="Score=49.9, E-value =7.1e-12, Copies=1"; Pfam description=Domain of unknown function (DUF227)
MTQVLSKDLSDLLESALNEKIESFDLQIEGNDNGEGHLGEVLFITLTNKSTNKIDHVVVKQVLESSVENTIDFMSSTFLNEIHFYGKFLPALQEFQRSYPGAEIFNHVPKCLGTCLERGKEKLILENLKFRNFTLHPKKEYVGYKMYEAIFKTYGKYHGACLAFKHNQPEKFLELSNGFQNNFKKMVKTGLLERGILGMSAMGTIHIKRDPTRII

SEQ ID NO: 32482 - protein, 21 aa, Diabrotica virgifera
  misc_feature: Coding regions on vcDNA: vcDNA=SeqID_12179; Strand=-; Position=1-63
  misc_feature (1)..(16): Xaa can be any naturally occurring amino acid
XXXXXXXXXXXXXXXXSSTPH

SEQ ID NO: 32483 - protein, 210 aa, Diabrotica virgifera
  misc_feature: Coding regions on vcDNA: vcDNA=SeqID_12180; Strand=+; Position=87-719
  misc_feature: Homolog annotation: Hit_ID=XP_318057.1; Match level="QueryCoverage =86%, HitCoverage=77%, E-value=1e-60, Identity=57%"; Hit description =ENSANGP00000010833 [Anopheles gambiae] ref|XP_307582.1| ENSANGP00000002089 [Anopheles gambiae]
  misc_feature: Gene Ontology Annotation: Molecular function=3'-5' exonuclease activity; Cellular component=mitochondrion; Biological process =nucleotide metabolism
  misc_feature: Pfam annotation: Pfam_ID=Exonuc_X-T; Match level="Score=104.7, E -value=2.3e-28, Copies=1"; Pfam description=Exonuclease
MFKLVQKQLVRYSKRFHSAMVNITPPMLDLEVNRIVWVDMEMTGLNVDQDKIMEIACLVTDADLNIIAEGPDIIIHQPDSVLKKMNAWCKKQHKKTGLTAACLNSMIHLEQAENEILDFVKQHVTGKMSPLAGNSVYMDRMFLIKNMPSLHNYLHYRLIDVSTVKELCRRWNLEVYKKAPSKQFTHRALSDIKESIEELKFYKENFFKQK

SEQ ID NO: 32484 - protein, 142 aa, Diabrotica virgifera
  misc_feature: Coding regions on vcDNA: vcDNA=SeqID_12181; Strand=-; Position=0-425
  misc_feature (27)..(35): Xaa can be any naturally occurring amino acid
  misc_feature (44)..(51): Xaa can be any naturally occurring amino acid
  misc_feature (63)..(139): Xaa can be any naturally occurring amino acid
VHYRNTSSLAKLKTNPLIQRLVSASVXXXXXXXXXVFLHMKDIXXXXXXXXTKYPVYFCLFKXXXXXXXXXXXXXXXXXXXXXXXXXXXXXXXXXXXXXXXXXXXXXXXXXXXXXXXXXXXXXXXXXXXXXXXXXXXXXAAR

SEQ ID NO: 32485 - protein, 305 aa, Diabrotica virgifera
  misc_feature: Coding regions on vcDNA: vcDNA=SeqID_12182; Strand=+; Position=1-918
  misc_feature: Homolog annotation: Hit_ID=BAC82608.1; Match level="QueryCoverage =88%, HitCoverage=64%, E-value=5e-14, Identity=24%"; Hit description =gag-like protein [Danio rerio]
  misc_feature: Pfam annotation: Pfam_ID=zf-CCHC; Match level="Score=28.3, E-value =2.3e-05, Copies=1"; Pfam description=Zinc knuckle
KLVSPTKRILISNISPYIPHQLAENAIKSLGLQIASPVSFLRAGIPGDEYSHILSFRRQVYVFSPSDNFELHTSLLISFEGNDNRIFLSTDKMECFVCKQAGHVASNCPNTSSDNVLSQNSTLSHDPTPTTESTPQQQHTQLVTDNVLSQNSTISYDLTTTTESTPQQQNTQLFSHTESHQAEDGDPNNINIQKPSSISSTPQTLLPTSEASKIIPTEENIPTKNPCEKTSEVMDQQASLGIIGESSSTSVKRSIDETLSPPIENLNTNNPTFALPQTPRQTKHPKPKKPKRTAPTPDALKFFMK

SEQ ID NO: 32486 - protein, 60 aa, Diabrotica virgifera
  misc_feature: Coding regions on vcDNA: vcDNA=SeqID_12183; Strand=+; Position=39-218
IHFLRTFPLFQCPTKRIMGRFSENGFVQVDSSKTIYFYSEEETNLSDFQQSLTITNLLDF

SEQ ID NO: 32487 - protein, 57 aa, Diabrotica virgifera
  misc_feature: Coding regions on vcDNA: vcDNA=SeqID_12184; Strand=+; Position=165-338
  misc_feature (17)..(28): Xaa can be any naturally occurring amino acid
  misc_feature (39)..(46): Xaa can be any naturally occurring amino acid
  misc_feature (51)..(57): Xaa can be any naturally occurring amino acid
EYLYKNKEYTVLKNDIXXXXXXXXXXXXTIELIKIIYAXXXXXXXXCYIRXXXXXXX

SEQ ID NO: 32488 - protein, 119 aa, Diabrotica virgifera
  misc_feature: Coding regions on vcDNA: vcDNA=SeqID_12185; Strand=-; Position=1-357
  misc_feature (7)..(14): Xaa can be any naturally occurring amino acid
  misc_feature (16)..(29): Xaa can be any naturally occurring amino acid
  misc_feature (31)..(38): Xaa can be any naturally occurring amino acid
  misc_feature (44)..(53): Xaa can be any naturally occurring amino acid
  misc_feature (57)..(66): Xaa can be any naturally occurring amino acid
  misc_feature (76)..(83): Xaa can be any naturally occurring amino acid
  misc_feature (86)..(98): Xaa can be any naturally occurring amino acid
  misc_feature (105)..(117): Xaa can be any naturally occurring amino acid
PGGMKNXXXXXXXXAXXXXXXXXXXXXXXGXXXXXXXXSSNNYXXXXXXXXXXAFCXXXXXXXXXXTNRAHTGLNXXXXXXXXRTXXXXXXXXXXXXXIQHRGRXXXXXXXXXXXXXLL

SEQ ID NO: 32489 - protein, 66 aa, Diabrotica virgifera
  misc_feature: Coding regions on vcDNA: vcDNA=SeqID_12186; Strand=-; Position=2-199
  misc_feature (2)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
FXXXXXXXXXXXNQPWAHTGLNXXXXXXXXSNXXXXXXXXXXXXXXPTSRSXXXXXXXXXXXXXXV

SEQ ID NO: 32490 - protein, 230 aa, Diabrotica virgifera
  misc_feature: Coding regions on vcDNA: vcDNA=SeqID_12187; Strand=-; Position=2-691
  misc_feature (13)..(42): Xaa can be any naturally occurring amino acid
  misc_feature (45)..(99): Xaa can be any naturally occurring amino acid
  misc_feature (102)..(116): Xaa can be any naturally occurring amino acid
  misc_feature (118)..(139): Xaa can be any naturally occurring amino acid
  misc_feature (144)..(164): Xaa can be any naturally occurring amino acid
  misc_feature (167)..(175): Xaa can be any naturally occurring amino acid
  misc_feature (180)..(195): Xaa can be any naturally occurring amino acid
  misc_feature (197)..(209): Xaa can be any naturally occurring amino acid
  misc_feature (213)..(228): Xaa can be any naturally occurring amino acid
VAEHGQYIADIHXXXXXXXXXXXXXXXXXXXXXXXXXXXXXXYNXXXXXXXXXXXXXXXXXXXXXXXXXXXXXXXXXXXXXXXXXXXXXXXXXXXXXXXVIXXXXXXXXXXXXXXXHXXXXXXXXXXXXXXXXXXXXXXFNLLXXXXXXXXXXXXXXXXXXXXXVYXXXXXXXXXLCYIXXXXXXXXXXXXXXXXGXXXXXXXXXXXXXSLTXXXXXXXXXXXXXXXXER

SEQ ID NO: 32491 - protein, 54 aa, Diabrotica virgifera
  misc_feature: Coding regions on vcDNA: vcDNA=SeqID_12188; Strand=+; Position=241-405
LVVLSAGAPPDSDMLSTRRNYQLEQLILTYTIMYFHSSVHIEIQAISDGRQPVG

SEQ ID NO: 32492 - protein, 286 aa, Diabrotica virgifera
  misc_feature: Coding regions on vcDNA: vcDNA=SeqID_12189; Strand=+; Position=97-953
  misc_feature: Homolog annotation: Hit_ID=XP_318853.1; Match level="QueryCoverage =99%, HitCoverage=46%, E-value=1e-43, Identity=32%"; Hit description =ENSANGP00000014400 [Anopheles gambiae]
  misc_feature (200)..(200): Xaa can be any naturally occurring amino acid
  misc_feature (253)..(253): Xaa can be any naturally occurring amino acid
  misc_feature (272)..(272): Xaa can be any naturally occurring amino acid
MGKAISKNLELSTNEYCVRFVGTEPISKNDPFWNRFLAYNLIPPTSLNDQLSLETRIEPLLQALVKNNPTSGNFSTLIQIFLERSTELLSSTSTQANLFNWQLYNILFLIRCVLKFFTEILREDDLMKHIEFKGSGNTMEAFIGALVGIIVDVPIEDSTYLIHLESATCLLICLSIQYHSGGRSDQSIMYRLMMKGKHGXYMAPILVKRLMTNFIDQQKMPPGFSGGDGNSMVLNLASNIWSVLTFNKKSNEXISDSDEYSYQEAPLATQSXLLLLVFSHHWDTLS

SEQ ID NO: 32493 - protein, 113 aa, Diabrotica virgifera
  misc_feature: Coding regions on vcDNA: vcDNA=SeqID_12190; Strand=-; Position=95-436
  misc_feature (7)..(58): Xaa can be any naturally occurring amino acid
  misc_feature (67)..(73): Xaa can be any naturally occurring amino acid
  misc_feature (85)..(92): Xaa can be any naturally occurring amino acid
  misc_feature (102)..(111): Xaa can be any naturally occurring amino acid
NMNIFTXXXXXXXXXXXXXXXXXXXXXXXXXXXXXXXXXXXXXXXXXXXXXXXXXXXXASSISFQKXXXXXXXGNKNVNLLALLXXXXXXXXLLSNYPGYFXXXXXXXXXXKI

SEQ ID NO: 32494 - protein, 72 aa, Diabrotica virgifera
  misc_feature: Coding regions on vcDNA: vcDNA=SeqID_12191; Strand=-; Position=1-216
  misc_feature (1)..(40): Xaa can be any naturally occurring amino acid
  misc_feature (44)..(45): Xaa can be any naturally occurring amino acid
  misc_feature (47)..(71): Xaa can be any naturally occurring amino acid
XXXXXXXXXXXXXXXXXXXXXXXXXXXXXXXXXXXXXXXXVSRXXKXXXXXXXXXXXXXXXXXXXXXXXXXL

SEQ ID NO: 32495 - protein, 278 aa, Diabrotica virgifera
  misc_feature: Coding regions on vcDNA: vcDNA=SeqID_12192; Strand=+; Position=41-874
  misc_feature (15)..(21): Xaa can be any naturally occurring amino acid
  misc_feature (25)..(31): Xaa can be any naturally occurring amino acid
  misc_feature (34)..(215): Xaa can be any naturally occurring amino acid
  misc_feature (217)..(237): Xaa can be any naturally occurring amino acid
  misc_feature (241)..(258): Xaa can be any naturally occurring amino acid
NQILSINLFRNETLXXXXXXXNFFXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXGDYXXXXXXXXXXXXXXXXXXDHFFLIKGEIYLKGKGEIFW

SEQ ID NO: 32496 - protein, 128 aa, Diabrotica virgifera
  misc_feature: Coding regions on vcDNA: vcDNA=SeqID_12193; Strand=-; Position=44-430
  misc_feature (3)..(11): Xaa can be any naturally occurring amino acid
  misc_feature (17)..(35): Xaa can be any naturally occurring amino acid
  misc_feature (37)..(49): Xaa can be any naturally occurring amino acid
  misc_feature (53)..(90): Xaa can be any naturally occurring amino acid
  misc_feature (93)..(107): Xaa can be any naturally occurring amino acid
  misc_feature (115)..(124): Xaa can be any naturally occurring amino acid
IHXXXXXXXXXNLNIIXXXXXXXXXXXXXXXXXXXFXXXXXXXXXXXXXFHNXXXXXXXXXXXXXXXXXXXXXXXXXXXXXXXXXXXXXXSPXXXXXXXXXXXXXXXYTILITSXXXXXXXXXXNLLF

SEQ ID NO: 32497 - protein, 57 aa, Diabrotica virgifera
  misc_feature: Coding regions on vcDNA: vcDNA=SeqID_12194; Strand=-; Position=159-332
  misc_feature (1)..(12): Xaa can be any naturally occurring amino acid
  misc_feature (14)..(38): Xaa can be any naturally occurring amino acid
XXXXXXXXXXXXGXXXXXXXXXXXXXXXXXXXXXXXXXIRINYLRDNSVILLESSNR

SEQ ID NO: 32498 - protein, 242 aa, Diabrotica virgifera
  misc_feature: Coding regions on vcDNA: vcDNA=SeqID_12195; Strand=-; Position=0-725
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(235): Xaa can be any naturally occurring amino acid
  misc_feature (237)..(241): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 32499 - protein, 70 aa, Diabrotica virgifera
  misc_feature: Coding regions on vcDNA: vcDNA=SeqID_12196; Strand=+; Position=358-570
PTAGPSRNSRTSYMSVSTFLKMCILMDQNYNRFLQCIVFYKNIQYKAISNMAGLFEIKKSVSLKEICVYG

SEQ ID NO: 32500 - protein, 76 aa, Diabrotica virgifera
  misc_feature: Coding regions on vcDNA: vcDNA=SeqID_12197; Strand=+; Position=532-762
VLLTFIRRPTADPAYVISSSIYLASPMLFVIRTMPPTNLRCINLSPSILMPVGRYNGLKRLLECFSLLATHSAGFC

SEQ ID NO: 32501 - protein, 81 aa, Diabrotica virgifera
  misc_feature: Coding regions on vcDNA: vcDNA=SeqID_12198; Strand=+; Position=522-764
  misc_feature: Homolog annotation: Hit_ID=AAS58470.1; Match level="QueryCoverage =100%, HitCoverage=13%, E-value=7e-15, Identity=55%"; Hit description= heat shock protein 70 [Aspergillus fumigatus]
  misc_feature: Gene Ontology Annotation: Biological process=response to stress
  misc_feature (39)..(39): Xaa can be any naturally occurring amino acid
PAYFKDSQRLNIMDAAMIVALQELLIINKPTAVDIVYVXNSTAQGERLVLIFHLSVDIFDVLLLTIEYAIFQLKYAAVDTH

SEQ ID NO: 32502 - protein, 213 aa, Diabrotica virgifera
  misc_feature: Coding regions on vcDNA: vcDNA=SeqID_12199; Strand=-; Position=0-638
  misc_feature (5)..(170): Xaa can be any naturally occurring amino acid
  misc_feature (173)..(211): Xaa can be any naturally occurring amino acid
HPTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFXXXXXXXXXXXXXXXXXXXXXXXXXXXXXXXXXXXXXXXGT

SEQ ID NO: 32503 - protein, 266 aa, Diabrotica virgifera
  misc_feature: Coding regions on vcDNA: vcDNA=SeqID_12200; Strand=+; Position=1-798
  misc_feature: Homolog annotation: Hit_ID=XP_393675.1; Match level="QueryCoverage =98%, HitCoverage=32%, E-value=1e-115, Identity=75%"; Hit description= similar to SD13096p [Apis mellifera]
  misc_feature: Gene Ontology Annotation: Molecular function=zinc ion binding; Cellular component=cellular_component unknown; Biological process =signal transduction
  misc_feature: Pfam annotation: Pfam_ID=PDEase_I; Match level="Score=-27.5, E-value =1e-07, Copies=1"; Pfam description=3'5'-cyclic nucleotide phosphodiester
KNSKNKIIGVIQLINKFNDLPFTQNDENFVEAFAIFCGMGIHNTRMYEAATTAVAKQKVILDVLSYHATASIEEAQRLRDLRVPSNVKFRLLDFAFDDIRMSDDETLTACLRMFLDLSLVETFHIDFDVLCRWLLSVKKNYRDVTYHNWRHAFNEGQMMYSILHATRWWEYLGSIECLAMMIACLCHDLDHRGTNNSFQMKIHSPIAQLYSTSTMEHHHFDHCLMILNSLQLLSYLAPEQHSRDIRVLEDAILATDLEIYFKKPVD

SEQ ID NO: 32504 - protein, 146 aa, Diabrotica virgifera
  misc_feature: Coding regions on vcDNA: vcDNA=SeqID_12201; Strand=+; Position=3-443
  misc_feature (2)..(45): Xaa can be any naturally occurring amino acid
  misc_feature (49)..(55): Xaa can be any naturally occurring amino acid
  misc_feature (58)..(68): Xaa can be any naturally occurring amino acid
  misc_feature (73)..(99): Xaa can be any naturally occurring amino acid
  misc_feature (106)..(123): Xaa can be any naturally occurring amino acid
  misc_feature (132)..(146): Xaa can be any naturally occurring amino acid
VXXXXXXXXXXXXXXXXXXXXXXXXXXXXXXXXXXXXXXXXXXXXEFKXXXXXXXLVXXXXXXXXXXXEMLLXXXXXXXXXXXXXXXXXXXXXXXXXXXYKYYIPXXXXXXXXXXXXXXXXXXVESTNFRMXXXXXXXXXXXXXXX

SEQ ID NO: 32505 - protein, 74 aa, Diabrotica virgifera
  misc_feature: Coding regions on vcDNA: vcDNA=SeqID_12202; Strand=+; Position=376-600
  misc_feature (24)..(41): Xaa can be any naturally occurring amino acid
  misc_feature (49)..(56): Xaa can be any naturally occurring amino acid
IRIVRINLIARLLMWQKRARLFPXXXXXXXXXXXXXXXXXXIVIQIMKXXXXXXXXHLQSILLAGYLFRSSHTY

SEQ ID NO: 32506 - protein, 136 aa, Diabrotica virgifera
  misc_feature: Coding regions on vcDNA: vcDNA=SeqID_12203; Strand=-; Position=1-408
  misc_feature (3)..(13): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(136): Xaa can be any naturally occurring amino acid
PFXXXXXXXXXXXTNPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXX

SEQ ID NO: 32507 - protein, 27 aa, Diabrotica virgifera
  misc_feature: Coding regions on vcDNA: vcDNA=SeqID_12204; Strand=+; Position=1-81
SPPASAKGDDNIVVSSTPNLQNIRLGS

SEQ ID NO: 32508 - protein, 77 aa, Diabrotica virgifera
  misc_feature: Coding regions on vcDNA: vcDNA=SeqID_12205; Strand=+; Position=245-478
VVNFVRILFRDLYILQTCTKLPSYLRIYGRGLSLNQCAYACVPEEGTWGTEEGLAFFRACSCCSCDDIFAIWRVLLS

SEQ ID NO: 32509 - protein, 152 aa, Diabrotica virgifera
  misc_feature: Coding regions on vcDNA: vcDNA=SeqID_12206; Strand=-; Position=337-795
  misc_feature (6)..(20): Xaa can be any naturally occurring amino acid
  misc_feature (22)..(40): Xaa can be any naturally occurring amino acid
  misc_feature (50)..(79): Xaa can be any naturally occurring amino acid
  misc_feature (81)..(133): Xaa can be any naturally occurring amino acid
  misc_feature (135)..(151): Xaa can be any naturally occurring amino acid
YLVYQXXXXXXXXXXXXXXXRXXXXXXXXXXXXXXXXXXXEMLFVFKYIXXXXXXXXXXXXXXXXXXXXXXXXXXXXXXMXXXXXXXXXXXXXXXXXXXXXXXXXXXXXXXXXXXXXXXXXXXXXXXXXXXXXVXXXXXXXXXXXXXXXXXV

SEQ ID NO: 32510 - protein, 241 aa, Diabrotica virgifera
  misc_feature: Coding regions on vcDNA: vcDNA=SeqID_12207; Strand=+; Position=99-824
  misc_feature: Homolog annotation: Hit_ID=XP_394682.1; Match level="QueryCoverage =88%, HitCoverage=55%, E-value=2e-15, Identity=25%"; Hit description =similar to ENSANGP00000020151 [Apis mellifera]
  misc_feature: Pfam annotation: Pfam_ID=Arrestin_N; Match level="Score=33.8, E-value= 1.2e-07, Copies=1"; Pfam description=Arrestin (or S-antigen), N -terminal do
  misc_feature (78)..(85): Xaa can be any naturally occurring amino acid
MTCKIVIINPGIFRPGDAITGKIICIFEREERIRGIKCQFRGREKVHWNERRGKHTTHYHGQTDFVVANTDFMDEGTXXXXXXXXNFSYVLPPSDIPSSYQHQFGSITYFLHAYVDRPFAFDYKDDVALHVVSPIINHPTHQMRAVSLEVNKEVGTCCWPKEPSTMELRLERDNYVLGDVIYFKAIIRNTSDSEINSIAVQLSTTVQLTAYSPSTRHKTERILLAVAEGILGAPGSTKIHI

SEQ ID NO: 32511 - protein, 244 aa, Diabrotica virgifera
  misc_feature: Coding regions on vcDNA: vcDNA=SeqID_12208; Strand=-; Position=1-732
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(237): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMMIILV

SEQ ID NO: 32512 - protein, 255 aa, Diabrotica virgifera
  misc_feature: Coding regions on vcDNA: vcDNA=SeqID_12209; Strand=+; Position=205-967
  misc_feature: Homolog annotation: Hit_ID=XP_318949.1; Match level="QueryCoverage =85%, HitCoverage=13%, E-value=3e-47, Identity=43%"; Hit description =ENSANGP00000015753 [Anopheles gambiae]
  misc_feature: Gene Ontology Annotation: Molecular function=ATP-binding cassette (ABC) transporter activity; Cellular component=integral to plasma membrane; Biological process=transport
  misc_feature (152)..(152): Xaa can be any naturally occurring amino acid
  misc_feature (166)..(166): Xaa can be any naturally occurring amino acid
  misc_feature (171)..(171): Xaa can be any naturally occurring amino acid
MANLTELTTLPTTVTELPKLTSNSSQNATIEEEAYAALSSFCGSPFWDTNLTWNTNDPEFTPCFEKTVLVWIPCIFLWVFAGLEVFYIFNSKRRNIPWNWLNLSKLAITATLIVLTISDIVNSFKTAGNRGSEVNDVDIYSPLIKILTFALXPEFLFSTIESTVYXTSGLXLFLFWFFVVLCAIPQFRTEIRRSQRNEILPDYYYFYTSYLIYFPLVVLMFLLNCFADKAPLERKYPQSQNPSPEESASFLSRLL

SEQ ID NO: 32513 - protein, 248 aa, Diabrotica virgifera
  misc_feature: Coding regions on vcDNA: vcDNA=SeqID_12210; Strand=-; Position=1-744
  misc_feature (4)..(28): Xaa can be any naturally occurring amino acid
  misc_feature (35)..(79): Xaa can be any naturally occurring amino acid
  misc_feature (86)..(98): Xaa can be any naturally occurring amino acid
  misc_feature (100)..(156): Xaa can be any naturally occurring amino acid
  misc_feature (162)..(245): Xaa can be any naturally occurring amino acid
PLTXXXXXXXXXXXXXXXXXXXXXXXXXRAGGGRXXXXXXXXXXXXXXXXXXXXXXXXXXXXXXXXXXXXXXXXXXXXXSPLKHPXXXXXXXXXXXXXPXXXXXXXXXXXXXXXXXXXXXXXXXXXXXXXXXXXXXXXXXXXXXXXXXXXXXXXXXLSPLPXXXXXXXXXXXXXXXXXXXXXXXXXXXXXXXXXXXXXXXXXXXXXXXXXXXXXXXXXXXXXXXXXXXXXXXXXXXXXXXXXXXXSKK

SEQ ID NO: 32514 - protein, 66 aa, Diabrotica virgifera; identical to SEQ ID NO: 26808
  misc_feature: Coding regions on vcDNA: vcDNA=SeqID_12211; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32515 - protein, 258 aa, Diabrotica virgifera
  misc_feature: Coding regions on vcDNA: vcDNA=SeqID_12212; Strand=+; Position=2-775
  misc_feature (1)..(15): Xaa can be any naturally occurring amino acid
  misc_feature (17)..(55): Xaa can be any naturally occurring amino acid
  misc_feature (58)..(150): Xaa can be any naturally occurring amino acid
  misc_feature (152)..(184): Xaa can be any naturally occurring amino acid
  misc_feature (188)..(194): Xaa can be any naturally occurring amino acid
  misc_feature (202)..(212): Xaa can be any naturally occurring amino acid
  misc_feature (224)..(254): Xaa can be any naturally occurring amino acid
XXXXXXXXXXXXXXXTXXXXXXXXXXXXXXXXXXXXXXXXXXXXXXXXXXXXXXXKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXVFLXXXXXXXRPPINLNXXXXXXXXXXXQSLSFFIESRKXXXXXXXXXXXXXXXXXXXXXXXXXXXXXXXERPY

SEQ ID NO: 32516 - protein, 289 aa, Diabrotica virgifera
  misc_feature: Coding regions on vcDNA: vcDNA=SeqID_12213; Strand=-; Position=1-867
  misc_feature (1)..(88): Xaa can be any naturally occurring amino acid
  misc_feature (96)..(289): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXFQINPVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32517 - protein, 54 aa, Diabrotica virgifera
  misc_feature: Coding regions on vcDNA: vcDNA=SeqID_12214; Strand=-; Position=0-161
  misc_feature (2)..(53): Xaa can be any naturally occurring amino acid
KXXXXXXXXXXXXXXXXXXXXXXXXXXXXXXXXXXXXXXXXXXXXXXXXXXXXT

SEQ ID NO: 32518 - protein, 301 aa, Diabrotica virgifera
  misc_feature: Coding regions on vcDNA: vcDNA=SeqID_12215; Strand=+; Position=59-964
  misc_feature: Homolog annotation: Hit_ID=AAL96744.2; Match level="QueryCoverage =81%, HitCoverage=14%, E-value=2e-09, Identity=23%"; Hit description =similar to Dictyostelium discoideum (Slime mold). Homeobox -containing protein (Fragment)
MERNRSNFRPPNSDMFPQRFRNDSRNHWQPQFNSNNPCNFNPWVSNSLQNSAHRPYNAGPGFNTVRQRGSSWTNNGHNGQWNQNRNMRGQNWPNNTEDNNGGYWKQISGNQNEQRSSFQRGNFTRERRTPYDRPREFFNNRNDRFNAQDRWEGPSNTEVNDSSYDTVPEPLSPLEAKIEKLISEVQGQPDKIGELILLQNNNEIPPVLINNAVHQVKNCVMNIDRDEETGFSKLRINNTVICEGMYSSKKDAKEALYEMALDILKMKCFFISSNHTTKKWMIIIKRQRFQKITQSTAIVLL

SEQ ID NO: 32519 - protein, 149 aa, Diabrotica virgifera
  misc_feature: Coding regions on vcDNA: vcDNA=SeqID_12216; Strand=-; Position=113-562
  misc_feature: Homolog annotation: Hit_ID=EAL40174.1; Match level="QueryCoverage =95%, HitCoverage=41%, E-value=2e-20, Identity=36%"; Hit description =ENSANGP00000027966 [Anopheles gambiae str. PEST] ref|XP_557484.1| ENSANGP00000027966 [Anopheles gambiae st
  misc_feature: Gene Ontology Annotation: Molecular function=phosphoserine transaminase activity; Biological process=serine biosynthesis
  misc_feature (74)..(75): Xaa can be any naturally occurring amino acid
MKYRPSLKGSILLSIKKSVHNPPTTFSFYVMVKVLQWIKKNGGLETPENPPIEKNTFLFNPPVEFKGFSPSPIXXSVPSKMYFPFRVGGGNEKLEELFFVEPEKIKMFHLKRPKSFGGIRASLYNPVTLDDVKFLVKFMKKFQAPPGSK

SEQ ID NO: 32520 - protein, 299 aa, Diabrotica virgifera
  misc_feature: Coding regions on vcDNA: vcDNA=SeqID_12217; Strand=-; Position=2-898
  misc_feature (7)..(17): Xaa can be any naturally occurring amino acid
  misc_feature (30)..(30): Xaa can be any naturally occurring amino acid
  misc_feature (38)..(285): Xaa can be any naturally occurring amino acid
  misc_feature (287)..(295): Xaa can be any naturally occurring amino acid
KSNRLNXXXXXXXXXXXPTSRVAIFIIDLXSPIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXDAGG

SEQ ID NO: 32521 - protein, 266 aa, Diabrotica virgifera
  misc_feature: Coding regions on vcDNA: vcDNA=SeqID_12218; Strand=+; Position=19-870
  misc_feature: Homolog annotation: Hit_ID=XP_318884.1; Match level="QueryCoverage =90%, HitCoverage=79%, E-value=3e-88, Identity=58%"; Hit description =ENSANGP00000015840 [Anopheles gambiae]
  misc_feature: Pfam annotation: Pfam_ID=CBM_14; Match level="Score=122.4, E-value =1.1e-33, Copies=3"; Pfam description=Chitin binding Peritrophin-A domain
  misc_feature (225)..(225): Xaa can be any naturally occurring amino acid
  misc_feature (247)..(247): Xaa can be any naturally occurring amino acid
MSANSSTWTFVFIAILALGVSGARNRNKRPQQEPVEVDDSAEISDQCPEPDGYFADAEQCDKYYHCSNGRITEKLCPDGQVFNDYSSEYEKCDLPFNIDCSSRPKLQEPQPSEHCPRKHGYFAHDQKNICDKFYFCVDGKFNAITCPNGLVYNVKAGICSWPDEAKRSGCTSEEVFEFQCPKVTEDVAITHPRYPDPEDCQYFYYFDDVTKRCDWARNVPECADXYQGRLTEQQLKDLENPPTARPXATKGSKEERSEATRENSST

SEQ ID NO: 32522 - protein, 51 aa, Diabrotica virgifera
  misc_feature: Coding regions on vcDNA: vcDNA=SeqID_12219; Strand=-; Position=3-155
  misc_feature (14)..(19): Xaa can be any naturally occurring amino acid
  misc_feature (43)..(49): Xaa can be any naturally occurring amino acid
FVTATIRNVKVELXXXXXXTWKLTFITVRIEITFINLTNQHQXXXXXXXIS

SEQ ID NO: 32523 - protein, 256 aa, Diabrotica virgifera
  misc_feature: Coding regions on vcDNA: vcDNA=SeqID_12220; Strand=+; Position=232-999
  misc_feature: Homolog annotation: Hit_ID=CAB51372.1; Match level="QueryCoverage =70%, HitCoverage=53%, E-value=2e-19, Identity=31%"; Hit description =transposase [Pleuronectes platessa]
  misc_feature (72)..(72): Xaa can be any naturally occurring amino acid
LEEIVWNLQVVYPEKLLHVPKLIYQHKIVRLQWAREMVHHGPNWNNGISFDESKIGLFSDSRRVLVWRAPGXQVRLEIAQPRAPFEGGSIIIWGGIMSGTRTPLLVLERRVTGVVYIEKVLNPVVHLFRGAVGNNGFVFMHHNAPPHRTAAVHNFLQEEGISTLQWPSNSPDMNVIEHAWDILKTRIKKRNNPTLRELKDAAREKWEIITQAPAQPSYSNNLPNPTIRQACQAQWKENTHEKLGNFWESFFPPPKI

SEQ ID NO: 32524 - protein, 92 aa, Diabrotica virgifera
  misc_feature: Coding regions on vcDNA: vcDNA=SeqID_12221; Strand=-; Position=2-277
  misc_feature (2)..(33): Xaa can be any naturally occurring amino acid
  misc_feature (36)..(92): Xaa can be any naturally occurring amino acid
LXXXXXXXXXXXXXXXXXXXXXXXXXXXXXXXXSPXXXXXXXXXXXXXXXXXXXXXXXXXXXXXXXXXXXXXXXXXXXXXXXXXXXXXXXXX

SEQ ID NO: 32525 - protein, 91 aa, Diabrotica virgifera
  misc_feature: Coding regions on vcDNA: vcDNA=SeqID_12222; Strand=+; Position=84-359
  misc_feature (43)..(51): Xaa can be any naturally occurring amino acid
  misc_feature (54)..(60): Xaa can be any naturally occurring amino acid
KVFTHVFLMAQHVICCNSTDDDLFRSKTLFHKCGYFSNPLRGXXXXXXXXXDIXXXXXXXVNGIQPATRKFFLFVVVCLKSNDSEILFPNF

SEQ ID NO: 32526 - protein, 84 aa, Diabrotica virgifera
  misc_feature: Coding regions on vcDNA: vcDNA=SeqID_12223; Strand=-; Position=419-673
ADLAISFPSAGRLVTSTEGIQNNYNIKASLYMLGSTGASSLLSTRQQSKMTCINSYWRVACPIQSSNTTRATKIQEKLPWNSAG

SEQ ID NO: 32527 - protein, 207 aa, Diabrotica virgifera
  misc_feature: Coding regions on vcDNA: vcDNA=SeqID_12224; Strand=+; Position=58-681
  misc_feature: Homolog annotation: Hit_ID=EAA08860.3; Match level="QueryCoverage =100%, HitCoverage=100%, E-value=8e-83, Identity=72%"; Hit description=ENSANGP00000011838 [Anopheles gambiae str. PEST] ref|XP _562483.1| ENSANGP00000011838 [Anopheles gambiae
  misc_feature: Gene Ontology Annotation: Molecular function=molecular_function unknown; Cellular component=cellular_component unknown; Biological process=biological_process unknown
  misc_feature: Pfam annotation: Pfam_ID=DUF814; Match level="Score=115.6, E-value =1.2e-31, Copies=1"; Pfam description=Domain of unknown function (DUF814)
  misc_feature (164)..(176): Xaa can be any naturally occurring amino acid
MVFYFESTVVSPPTVLFMGIDKNENEDLIKWGWPEDVWFHVDKVSSAHVYLRLPPGQTIDDIPSTVLEDAAQLVKANSINGNKMNDVDVVYTMWANLKKTPGMEVGQVGFHKEKEVRKIRVAKRINEIVNRLNKTKKEEHPDFRGEREKRDRLEREDKKKNLRXXXXXXXXXXXXXKEDAELKSYNSLMNADNMAKYDDGNDSDDFM

SEQ ID NO: 32528 - protein, 54 aa, Diabrotica virgifera
  misc_feature: Coding regions on vcDNA: vcDNA=SeqID_12225; Strand=+; Position=2-166
  misc_feature: Homolog annotation: Hit_ID=XP_393496.1; Match level="QueryCoverage =100%, HitCoverage=3%, E-value=2e-10, Identity=60%"; Hit description =similar to ENSANGP00000007677 [Apis mellifera]
  misc_feature (31)..(36): Xaa can be any naturally occurring amino acid
ASLILRNLVIYSSQCKRYLKSYESHLANVAXXXXXXSRTIAQILFDMNDGSTHR

SEQ ID NO: 32529 - protein, 162 aa, Diabrotica virgifera
  misc_feature: Coding regions on vcDNA: vcDNA=SeqID_12226; Strand=+; Position=5-490
  misc_feature: Homolog annotation: Hit_ID=CAH81944.1; Match level="QueryCoverage =98%, HitCoverage=98%, E-value=3e-18, Identity=26%"; Hit description =conserved hypothetical protein [Plasmodium chabaudi]
  misc_feature: Gene Ontology Annotation: Molecular function=protein binding; Cellular component=nucleus; Biological process=mRNA splicing
  misc_feature (4)..(4): Xaa can be any naturally occurring amino acid
  misc_feature (6)..(7): Xaa can be any naturally occurring amino acid
  misc_feature (9)..(9): Xaa can be any naturally occurring amino acid
  misc_feature (12)..(12): Xaa can be any naturally occurring amino acid
  misc_feature (40)..(40): Xaa can be any naturally occurring amino acid
  misc_feature (114)..(114): Xaa can be any naturally occurring amino acid
LQGXEXXRXRKXTFKRKRERRGREERRGREKEGKRGDPEXRKKPRKGATKPTKKAQRTQQTPGKTRGRRPKTTTKETPAKRPKQRRKQKRKRKTPERTPRARQKQQRSKQKRSXGKQERRARTPERKRPRTRTKHNRKRGKTRRKPEKGARRKQEKPPREKS

SEQ ID NO: 32530 - protein, 79 aa, Diabrotica virgifera
  misc_feature: Coding regions on vcDNA: vcDNA=SeqID_12227; Strand=-; Position=365-604
  misc_feature (16)..(21): Xaa can be any naturally occurring amino acid
  misc_feature (47)..(53): Xaa can be any naturally occurring amino acid
QYLLILLYNSIHSSNXXXXXXLLIYNIKFFINYINTLFILSIHSFLXXXXXXXTILPYHAQNTSSIHNIPFTIHSLYLY

SEQ ID NO: 32531 - protein, 54 aa, Diabrotica virgifera
  misc_feature: Coding regions on vcDNA: vcDNA=SeqID_12228; Strand=+; Position=238-399
HCLLDRKIPNYGIYKIFKICTLMFGSLSRYLTHSYKIYKGIKPGFLYITYVKDS

SEQ ID NO: 32532 - protein, 154 aa, Diabrotica virgifera
  misc_feature: Coding regions on vcDNA: vcDNA=SeqID_12229; Strand=+; Position=3-467
  misc_feature (5)..(12): Xaa can be any naturally occurring amino acid
  misc_feature (15)..(56): Xaa can be any naturally occurring amino acid
  misc_feature (58)..(66): Xaa can be any naturally occurring amino acid
LRRPXXXXXXXXNLXXXXXXXXXXXXXXXXXXXXXXXXXXXXXXXXXXXXXXXXXXYXXXXXXXXXDEFRNMIYLRLRVYYDRDDKPCSYGHIGDDQLLYIIVRSVSFSYLYFRTYWKFLEVEISSNSRTKSSIDSKNEDHRLCSKRILWKRDV

SEQ ID NO: 32533 - protein, 55 aa, Diabrotica virgifera
  misc_feature: Coding regions on vcDNA: vcDNA=SeqID_12230; Strand=-; Position=1-165
  misc_feature (7)..(51): Xaa can be any naturally occurring amino acid
LYWGFLXXXXXXXXXXXXXXXXXXXXXXXXXXXXXXXXXXXXXXXXXXXXXAVKI

SEQ ID NO: 32534 - protein, 108 aa, Diabrotica virgifera
  misc_feature: Coding regions on vcDNA: vcDNA=SeqID_12231; Strand=+; Position=2-325
  misc_feature (1)..(73): Xaa can be any naturally occurring amino acid
  misc_feature (87)..(98): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXPFRGITSGNFLLWXXXXXXXXXXXXNPPNGWDYKG

SEQ ID NO: 32535 - protein, 290 aa, Diabrotica virgifera
  misc_feature: Coding regions on vcDNA: vcDNA=SeqID_12232; Strand=+; Position=2-874
  misc_feature (6)..(223): Xaa can be any naturally occurring amino acid
  misc_feature (226)..(238): Xaa can be any naturally occurring amino acid
PVPQRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANXXXXXXXXXXXXXQGCMLHKPDEIYFLPHPTIWTKIAPCISKTIKFPGKQGKPLPMGLLTTSSIE

SEQ ID NO: 32536 - protein, 62 aa, Diabrotica virgifera
  misc_feature: Coding regions on vcDNA: vcDNA=SeqID_12233; Strand=+; Position=4-192
  misc_feature (2)..(14): Xaa can be any naturally occurring amino acid
  misc_feature (21)..(31): Xaa can be any naturally occurring amino acid
  misc_feature (36)..(45): Xaa can be any naturally occurring amino acid
  misc_feature (57)..(58): Xaa can be any naturally occurring amino acid
  misc_feature (60)..(60): Xaa can be any naturally occurring amino acid
QXXXXXXXXXXXXXATSMLDXXXXXXXXXXXLSLFXXXXXXXXXXNRWRPQVGFYLXXIXIF

SEQ ID NO: 32537 - protein, 262 aa, Diabrotica virgifera
  misc_feature: Coding regions on vcDNA: vcDNA=SeqID_12234; Strand=-; Position=1-786
  misc_feature (1)..(12): Xaa can be any naturally occurring amino acid
  misc_feature (14)..(262): Xaa can be any naturally occurring amino acid
XXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32538 - protein, 315 aa, Diabrotica virgifera
  misc_feature: Coding regions on vcDNA: vcDNA=SeqID_12235; Strand=+; Position=1-945
  misc_feature (1)..(313): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGG

SEQ ID NO: 32539 - protein, 135 aa, Diabrotica virgifera
  misc_feature: Coding regions on vcDNA: vcDNA=SeqID_12236; Strand=+; Position=1-408
  misc_feature: Homolog annotation: Hit_ID=XP_308915.1; Match level="QueryCoverage =95%, HitCoverage=75%, E-value=2e-26, Identity=51%"; Hit description =ENSANGP00000013278 [Anopheles gambiae]
  misc_feature: Gene Ontology Annotation: Molecular function=structural constituent of eye lens
  misc_feature: Pfam annotation: Pfam_ID=Chitin_bind_4; Match level="Score=84.5, E -value=2.8e-22, Copies=1"; Pfam description=Insect cuticle protein
FIVYVAAIAAVAYARPGGDYGHLELAGGYEDGGHYGGHEATSYQHGGLIANEIGHGDEGHHEEHVDYHAPAKYHYDYAVHDLHTHDIKSQWETRNGDKVKGEYTVVEPDGSRRIVSYTADKHTGFHAVVKNVHDY

SEQ ID NO: 32540 - protein, 308 aa, Diabrotica virgifera
  misc_feature: Coding regions on vcDNA: vcDNA=SeqID_12237; Strand=+; Position=15-938
  misc_feature: Homolog annotation: Hit_ID=AAF87759.1; Match level="QueryCoverage =89%, HitCoverage=62%, E-value=1e-108, Identity=75%"; Hit description= cytochrome oxidase subunit I [Diabrotica virgifera virgifera]
  misc_feature: Pfam annotation: Pfam_ID=COX1; Match level="Score=110.8, E-value=3.5e- 30, Copies=1"; Pfam description=Cytochrome C and Quinol oxidase polyp
  misc_feature (34)..(42): Xaa can be any naturally occurring amino acid
  misc_feature (69)..(69): Xaa can be any naturally occurring amino acid
  misc_feature (114)..(122): Xaa can be any naturally occurring amino acid
  misc_feature (126)..(132): Xaa can be any naturally occurring amino acid
  misc_feature (143)..(150): Xaa can be any naturally occurring amino acid
  misc_feature (171)..(171): Xaa can be any naturally occurring amino acid
  misc_feature (206)..(206): Xaa can be any naturally occurring amino acid
  misc_feature (223)..(223): Xaa can be any naturally occurring amino acid
  misc_feature (226)..(232): Xaa can be any naturally occurring amino acid
  misc_feature (279)..(279): Xaa can be any naturally occurring amino acid
  misc_feature (287)..(304): Xaa can be any naturally occurring amino acid
SNTPICLSCRNYSNPSSIIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVGAHFHYGLSIGAVFAIIAGFIQXFPLFTGIXXXXXXXXXXXXXXXXXXVNLT

SEQ ID NO: 32541 - protein, 182 aa, Diabrotica virgifera
  misc_feature: Coding regions on vcDNA: vcDNA=SeqID_12238; Strand=+; Position=24-569
  misc_feature: Homolog annotation: Hit_ID=CAE70527.1; Match level="QueryCoverage =82%, HitCoverage=94%, E-value=2e-17, Identity=25%"; Hit description =Hypothetical protein CBG17156 [Caenorhabditis briggsae]
  misc_feature: Gene Ontology Annotation: Molecular function=molecular_function unknown; Cellular component=cellular_component unknown; Biological process=N-linked glycosylation
  misc_feature (10)..(10): Xaa can be any naturally occurring amino acid
VEAEGPLKEXQKNEKNKQERKGEKEKEEENPQKKPDHKQSKHEKPTDQKDKPKKQDRKTKREKPDQQQQHRKRDPKKQRKKGDQKSQPGKEDQKQQHRNRNEPGNDKAEKNKQREEEQANKTNARRRQREKTARNRGGVDERANKGRQREDDLENKALPDIQRTKADASHAMDTIGPKDRGE

SEQ ID NO: 32542 - protein, 102 aa, Diabrotica virgifera
  misc_feature: Coding regions on vcDNA: vcDNA=SeqID_12239; Strand=-; Position=175-483
QSGGNFNSSFPLGEYTSVFQAQTFAILQIARENNLRAFELQRINICTDRQAATGPLISPKVDSRLLSEYRHELDRLAQHNSVILVWVPGHRGIYNLFEPFKY

SEQ ID NO: 32543 - protein, 105 aa, Diabrotica virgifera
  misc_feature: Coding regions on vcDNA: vcDNA=SeqID_12240; Strand=+; Position=1-318
  misc_feature (7)..(7): Xaa can be any naturally occurring amino acid
  misc_feature (10)..(10): Xaa can be any naturally occurring amino acid
  misc_feature (74)..(81): Xaa can be any naturally occurring amino acid
FKGAGDXERXKRKPLKRHGKSQKRNPRKTTGKTTQERDPERNRGRRTEKEKRHRTKRKKGSPTKKRPATARTHXXXXXXXXTPRKIRNPSSVVKSWWILVKSKVY

SEQ ID NO: 32544 - protein, 67 aa, Diabrotica virgifera
  misc_feature: Coding regions on vcDNA: vcDNA=SeqID_12241; Strand=-; Position=1-201
  misc_feature (3)..(14): Xaa can be any naturally occurring amino acid
  misc_feature (24)..(31): Xaa can be any naturally occurring amino acid
  misc_feature (34)..(46): Xaa can be any naturally occurring amino acid
  misc_feature (53)..(65): Xaa can be any naturally occurring amino acid
VLXXXXXXXXXXXXPTLAHTGLNXXXXXXXXRTXXXXXXXXXXXXXIQHRGRXXXXXXXXXXXXXLL

SEQ ID NO: 32545 - protein, 34 aa, Diabrotica virgifera
  misc_feature: Coding regions on vcDNA: vcDNA=SeqID_12242; Strand=-; Position=0-101
  misc_feature (1)..(32): Xaa can be any naturally occurring amino acid
XXXXXXXXXXXXXXXXXXXXXXXXXXXXXXXXTP

SEQ ID NO: 32546 - protein, 101 aa, Diabrotica virgifera
  misc_feature: Coding regions on vcDNA: vcDNA=SeqID_12243; Strand=+; Position=3-304
  misc_feature: Homolog annotation: Hit_ID=CAH81944.1; Match level="QueryCoverage =100%, HitCoverage=85%, E-value=4e-11, Identity=27%"; Hit description= conserved hypothetical protein [Plasmodium chabaudi]
  misc_feature (53)..(53): Xaa can be any naturally occurring amino acid
KKNTKRTRKTDRNKTRKRHRREHRENNKQQGRHRRKAQRKKRDRTHKHPQQEXRKAPGKRHDTQKRKRRQRDQDKREKRTERQQTTNGSEKTSKEENKQKK

SEQ ID NO: 32547 - protein, 76 aa, Diabrotica virgifera
  misc_feature: Coding regions on vcDNA: vcDNA=SeqID_12244; Strand=+; Position=579-809
LFVPILTYAYNILVYNSATNFVGLWLPKTYFTSLHFSLSHALALLLPTISSLGVLSFFPISPPSGLFYYFGSLAFM

SEQ ID NO: 32548 - protein, 269 aa, Diabrotica virgifera
  misc_feature: Coding regions on vcDNA: vcDNA=SeqID_12245; Strand=-; Position=1-807
  misc_feature (14)..(41): Xaa can be any naturally occurring amino acid
  misc_feature (44)..(269): Xaa can be any naturally occurring amino acid
INVIKTYIGVFSVXXXXXXXXXXXXXXXXXXXXXXXXXXXXPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32549 - protein, 187 aa, Diabrotica virgifera
  misc_feature: Coding regions on vcDNA: vcDNA=SeqID_12246; Strand=+; Position=1-564
  misc_feature (1)..(49): Xaa can be any naturally occurring amino acid
  misc_feature (52)..(108): Xaa can be any naturally occurring amino acid
  misc_feature (113)..(139): Xaa can be any naturally occurring amino acid
  misc_feature (147)..(171): Xaa can be any naturally occurring amino acid
  misc_feature (177)..(186): Xaa can be any naturally occurring amino acid
XXXXXXXXXXXXXXXXXXXXXXXXXXXXXXXXXXXXXXXXXXXXXXXXXFSXXXXXXXXXXXXXXXXXXXXXXXXXXXXXXXXXXXXXXXXXXXXXXXXXXXXXXXXXDEFKXXXXXXXXXXXXXXXXXXXXXXXXXXXVGNIYFTXXXXXXXXXXXXXXXXXXXXXXXXXNLTGLXXXXXXXXXXG

SEQ ID NO: 32550 - protein, 182 aa, Diabrotica virgifera
  misc_feature: Coding regions on vcDNA: vcDNA=SeqID_12247; Strand=+; Position=181-726
  misc_feature: Homolog annotation: Hit_ID=EAL33546.1; Match level="QueryCoverage =92%, HitCoverage=24%, E-value=3e-58, Identity=64%"; Hit description =GA17636-PA [Drosophila pseudoobscura]
  misc_feature (169)..(174): Xaa can be any naturally occurring amino acid
MTDANNKKIGQNSIVQPLLTDLYQITMAYAYWKTGKIDGYAVFDLYFRKNPFQGEFTIFAGLEECLKFLEKFKYSESDIEYIKQILPASIEEEFFDYLRTVTADQIKFYSVNEGTVVFPRVPLIRIEGPLIIAQLLETTLLNLVNDDSLLVTNDDRYRLASRILKLYEXXXXXXEGVMNISL

SEQ ID NO: 32551 - protein, 148 aa, Diabrotica virgifera
  misc_feature: Coding regions on vcDNA: vcDNA=SeqID_12248; Strand=-; Position=76-522
  misc_feature (9)..(44): Xaa can be any naturally occurring amino acid
  misc_feature (46)..(56): Xaa can be any naturally occurring amino acid
  misc_feature (70)..(78): Xaa can be any naturally occurring amino acid
  misc_feature (112)..(128): Xaa can be any naturally occurring amino acid
YFIKLYKGXXXXXXXXXXXXXXXXXXXXXXXXXXXXXXXXXXXXYXXXXXXXXXXXIPPPFKLISEQAIXXXXXXXXXVPNKQSTKILPNSYINPIPIQLHTQFSNIHIIIXXXXXXXXXXXXXXXXXNIKFILYHITSYHILKYDNF

SEQ ID NO: 32552 - protein, 98 aa, Diabrotica virgifera
  misc_feature: Coding regions on vcDNA: vcDNA=SeqID_12249; Strand=-; Position=3-296
  misc_feature (45)..(53): Xaa can be any naturally occurring amino acid
  misc_feature (56)..(64): Xaa can be any naturally occurring amino acid
  misc_feature (69)..(75): Xaa can be any naturally occurring amino acid
  misc_feature (85)..(91): Xaa can be any naturally occurring amino acid
FQINPLYIELYLLTLHYYRYHSPSYLALIFYIFMSLSRKTANRSXXXXXXXXXLWXXXXXXXXXKAPRXXXXXXXRAAARMNSIXXXXXXXEQPDAEK

SEQ ID NO: 32553 - protein, 119 aa, Diabrotica virgifera
  misc_feature: Coding regions on vcDNA: vcDNA=SeqID_12250; Strand=-; Position=6-365
  misc_feature (12)..(17): Xaa can be any naturally occurring amino acid
  misc_feature (89)..(89): Xaa can be any naturally occurring amino acid
  misc_feature (111)..(118): Xaa can be any naturally occurring amino acid
QFIHIYIIKYTXXXXXXHQFLNSNITSLYIDLLFSILLSNPYHYSSHSKLIFYLIKSFSLILNFLIHQSQNNPFPFSLFSSLREFSSSXLPSPFLLFPSFTPFFPLLRAPXXXXXXXXP

SEQ ID NO: 32554 - protein, 34 aa, Diabrotica virgifera
  misc_feature: Coding regions on vcDNA: vcDNA=SeqID_12251; Strand=-; Position=1-102
  misc_feature (8)..(33): Xaa can be any naturally occurring amino acid
PLRVIFSXXXXXXXXXXXXXXXXXXXXXXXXXXP

SEQ ID NO: 32555 - protein, 308 aa, Diabrotica virgifera
  misc_feature: Coding regions on vcDNA: vcDNA=SeqID_12252; Strand=+; Position=1-924
  misc_feature: Homolog annotation: Hit_ID=AAF87760.1; Match level="QueryCoverage =100%, HitCoverage=70%, E-value=1e-111, Identity=70%"; Hit description=cytochrome oxidase subunit I [Diabrotica virgifera zeae]
  misc_feature: Pfam annotation: Pfam_ID=COX1; Match level="Score=-3.1, E-value=4e -11, Copies=1"; Pfam description=Cytochrome C and Quinol oxidase polyp
  misc_feature (27)..(35): Xaa can be any naturally occurring amino acid
  misc_feature (39)..(45): Xaa can be any naturally occurring amino acid
  misc_feature (56)..(63): Xaa can be any naturally occurring amino acid
  misc_feature (84)..(84): Xaa can be any naturally occurring amino acid
  misc_feature (119)..(119): Xaa can be any naturally occurring amino acid
  misc_feature (136)..(136): Xaa can be any naturally occurring amino acid
  misc_feature (139)..(145): Xaa can be any naturally occurring amino acid
  misc_feature (172)..(178): Xaa can be any naturally occurring amino acid
  misc_feature (192)..(192): Xaa can be any naturally occurring amino acid
  misc_feature (200)..(216): Xaa can be any naturally occurring amino acid
  misc_feature (246)..(246): Xaa can be any naturally occurring amino acid
  misc_feature (262)..(269): Xaa can be any naturally occurring amino acid
  misc_feature (272)..(272): Xaa can be any naturally occurring amino acid
  misc_feature (282)..(282): Xaa can be any naturally occurring amino acid
  misc_feature (290)..(290): Xaa can be any naturally occurring amino acid
AITILLTDRILNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAXSFQRKRLRPXRITSSIEXLQFNPPAEHRYSELPILS

SEQ ID NO: 32556 - protein, 48 aa, Diabrotica virgifera
  misc_feature: Coding regions on vcDNA: vcDNA=SeqID_12253; Strand=-; Position=2-145
  misc_feature (25)..(48): Xaa can be any naturally occurring amino acid
SHPSFHLSIQTLMIMLLCYGQNAAXXXXXXXXXXXXXXXXXXXXXXXX

SEQ ID NO: 32557 - protein, 397 aa, Diabrotica virgifera
  misc_feature: Coding regions on vcDNA: vcDNA=SeqID_12254; Strand=-; Position=1-1191
  misc_feature (3)..(104): Xaa can be any naturally occurring amino acid
  misc_feature (106)..(124): Xaa can be any naturally occurring amino acid
  misc_feature (135)..(178): Xaa can be any naturally occurring amino acid
  misc_feature (181)..(268): Xaa can be any naturally occurring amino acid
  misc_feature (271)..(310): Xaa can be any naturally occurring amino acid
  misc_feature (315)..(370): Xaa can be any naturally occurring amino acid
  misc_feature (373)..(392): Xaa can be any naturally occurring amino acid
  misc_feature (394)..(394): Xaa can be any naturally occurring amino acid
PPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXRRREKKEPPPXXXXXXXXXXXXXXXXXXXXXXXXXXXXXXXXXXXXXXXXXXXXFKXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLXXXXXXXXXXXXXXXXXXXXXXXXXXXXXXXXXXXXXXXXNLPFXXXXXXXXXXXXXXXXXXXXXXXXXXXXXXXXXXXXXXXXXXXXXXXXXXXXXXXXHNXXXXXXXXXXXXXXXXXXXXYXKIN

SEQ ID NO: 32558 - protein, 148 aa, Diabrotica virgifera
  misc_feature: Coding regions on vcDNA: vcDNA=SeqID_12255; Strand=-; Position=24-470
  misc_feature (4)..(20): Xaa can be any naturally occurring amino acid
  misc_feature (40)..(46): Xaa can be any naturally occurring amino acid
  misc_feature (53)..(63): Xaa can be any naturally occurring amino acid
  misc_feature (76)..(86): Xaa can be any naturally occurring amino acid
  misc_feature (89)..(101): Xaa can be any naturally occurring amino acid
  misc_feature (109)..(116): Xaa can be any naturally occurring amino acid
  misc_feature (132)..(132): Xaa can be any naturally occurring amino acid
YLKXXXXXXXXXXXXXXXXXNSYYKVHPFTLFKYYSFSPXXXXXXXLINHIHXXXXXXXXXXXLLPFHSIKNSLQXXXXXXXXXXXKTXXXXXXXXXXXXXNNPTHTRXXXXXXXXFEKILFSLSSPSLSFXFLSLLFSSPFMISPYN

SEQ ID NO: 32559 - protein, 232 aa, Diabrotica virgifera
  misc_feature: Coding regions on vcDNA: vcDNA=SeqID_12256; Strand=+; Position=182-877
  misc_feature: Homolog annotation: Hit_ID=XP_314721.1; Match level="QueryCoverage =76%, HitCoverage=69%, E-value=5e-23, Identity=32%"; Hit description =ENSANGP00000013196 [Anopheles gambiae]
  misc_feature: Pfam annotation: Pfam_ID=Far-17a_AIG1; Match level="Score=61.0, E -value=3.3e-15, Copies=1"; Pfam description=FAR-17a/AIG1-like protein
MLDRSKSVTAILVYLSVLVFYVFSLYCSDSVGKNIKSNKVKIPSQLRGVVEYGKCFFTLWNFMLQIFFISLAVLDELSKLLSLPSKVQNLLSKVRAYIFNSLVFPCSTLVVFTFWSIWAVDRELIFPKVMDTFFPSWLNHVLHTFIAIPLVIEILLPKKDNFVQFKNAAPILLFYAGLYQTLYFSIYLKDGVWLYPIYKVLSIPQMVLFNIVQMVLILGFQYGGISLKGRPN

SEQ ID NO: 32560 - protein, 31 aa, Diabrotica virgifera
  misc_feature: Coding regions on vcDNA: vcDNA=SeqID_12257; Strand=-; Position=39-134
NHIKYFITTLISYPILKIFHPITKKILLLLL

SEQ ID NO: 32561 - protein, 32 aa, Diabrotica virgifera
  misc_feature: Coding regions on vcDNA: vcDNA=SeqID_12258; Strand=-; Position=3-98
  misc_feature (23)..(29): Xaa can be any naturally occurring amino acid
FRIVSLTMKLVLTFYIAHLCEWXXXXXXXVLQ

SEQ ID NO: 32562 - protein, 57 aa, Diabrotica virgifera
  misc_feature: Coding regions on vcDNA: vcDNA=SeqID_12259; Strand=+; Position=2-172
  misc_feature (4)..(14): Xaa can be any naturally occurring amino acid
SEVXXXXXXXXXXXSLIGLLLGFGRTELGNIIYRVACVGFNNTVTGNIRPILKTLHL

SEQ ID NO: 32563 - protein, 65 aa, Diabrotica virgifera
  misc_feature: Coding regions on vcDNA: vcDNA=SeqID_12260; Strand=+; Position=23-217
  misc_feature (5)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (53)..(64): Xaa can be any naturally occurring amino acid
QRYFXXXXXXXXXXATSMLDXXXXXXXXXXXXXCSXXXXXXXXSLNRCEPGWXXXXXXXXXXXXK

SEQ ID NO: 32564 - protein, 111 aa, Diabrotica virgifera
  misc_feature: Coding regions on vcDNA: vcDNA=SeqID_12261; Strand=-; Position=737 -1072
  misc_feature (96)..(96): Xaa can be any naturally occurring amino acid
GKNPKKCKKIPGVSPLKKIKYITNFRYKPEVQNKMKIFSLHRSLFKTPFHFNFYDSVAFRSQNISNRAFICSPLYSHISNAPNFLRIGLSESKLLXHVVVTTKHNIRRTSI

SEQ ID NO: 32565 - protein, 40 aa, Diabrotica virgifera
  misc_feature: Coding regions on vcDNA: vcDNA=SeqID_12262; Strand=-; Position=1-120
  misc_feature (8)..(23): Xaa can be any naturally occurring amino acid
  misc_feature (29)..(40): Xaa can be any naturally occurring amino acid
SGQARLIXXXXXXXXXXXXXXXXAEIPYXXXXXXXXXXXX

SEQ ID NO: 32566 - protein, 129 aa, Diabrotica virgifera
  misc_feature: Coding regions on vcDNA: vcDNA=SeqID_12263; Strand=+; Position=3-389
  misc_feature: Homolog annotation: Hit_ID=XP_394899.1; Match level="QueryCoverage =91%, HitCoverage=71%, E-value=1e-28, Identity=55%"; Hit description =similar to CG1919-PA [Apis mellifera]
  misc_feature: Gene Ontology Annotation: Molecular function=structural constituent of eye lens
  misc_feature: Pfam annotation: Pfam_ID=Chitin_bind_4; Match level="Score=87.1, E -value=4.6e-23, Copies=1"; Pfam description=Insect cuticle protein
YSKILSVLTLAAVAQAGVLDYSHGHATSYASSNLGLGHGHAVPVVAHGYNAPVLSHGASAHHDVDYYAHPKYEFNYGVQDGHTGDHKTQHEVRDGDVVKGSYTVAEPDGTLRTVHYTADDHYGFNVVVE

SEQ ID NO: 32567 - protein, 65 aa, Diabrotica virgifera
  misc_feature: Coding regions on vcDNA: vcDNA=SeqID_12264; Strand=+; Position=3-200
  misc_feature (1)..(21): Xaa can be any naturally occurring amino acid
XXXXXXXXXXXXXXXXXXXXXVLFNVKDTTHRTFIDFEFYFTSAIHLTKHFNNTYDYPSTLHTLP

SEQ ID NO: 32568 - protein, 243 aa, Diabrotica virgifera
  misc_feature: Coding regions on vcDNA: vcDNA=SeqID_12265; Strand=+; Position=85-816
  misc_feature: Homolog annotation: Hit_ID=YP_161395.1; Match level="QueryCoverage =72%, HitCoverage=67%, E-value=1e-09, Identity=27%"; Hit description =hypothetical protein BGP110 [Borrelia garinii PBi] gb|AAU85960.1| hypothetical protein BGP110
  misc_feature (135)..(142): Xaa can be any naturally occurring amino acid
MQKAKASILQEVRLYADDSLVKKKTFDEEMEKIKQYVNISLNAIQQNSTHKSHLEYIKENVEFINNTIKNKVDIYEDKFQKLENNMKIMSEDLDKSITDKIEAALLPYKNSSTVSDEKLLDLEKRTSQKLTDLKXXXXXXXXTKNDNLLNKIDTLDTKIIQAENNIAKQNMISQKIDKILDDIRQDKSSLNNQLKTQQNAINNLHNEIADLDQKISNNTDINNNLDSINKTFSEKYRRFTARS

SEQ ID NO: 32569 - protein, 30 aa, Diabrotica virgifera
  misc_feature: Coding regions on vcDNA: vcDNA=SeqID_12266; Strand=-; Position=0-89
  misc_feature (5)..(25): Xaa can be any naturally occurring amino acid
KNYSXXXXXXXXXXXXXXXXXXXXXPLIPT

SEQ ID NO: 32570 - protein, 93 aa, Diabrotica virgifera
  misc_feature: Coding regions on vcDNA: vcDNA=SeqID_12267; Strand=+; Position=522-803
  misc_feature (11)..(31): Xaa can be any naturally occurring amino acid
  misc_feature (56)..(62): Xaa can be any naturally occurring amino acid
  misc_feature (90)..(90): Xaa can be any naturally occurring amino acid
SPCMQQHIYLXXXXXXXXXXXXXXXXXXXXXQFCILPDFISHPLKTTMNDKEKQQXXXXXXXVANEKWMEDKCKELEKLNEKHDTFNMFXKVR

SEQ ID NO: 32571 - protein, 48 aa, Diabrotica virgifera; identical to SEQ ID NO: 28504
  misc_feature: Coding regions on vcDNA: vcDNA=SeqID_12268; Strand=+; Position=1-147
  misc_feature (2)..(16): Xaa can be any naturally occurring amino acid
  misc_feature (18)..(25): Xaa can be any naturally occurring amino acid

SEQ ID NO: 32572 - protein, 200 aa, Diabrotica virgifera
  misc_feature: Coding regions on vcDNA: vcDNA=SeqID_12269; Strand=+; Position=2-604
  misc_feature: Homolog annotation: Hit_ID=XP_395288.1; Match level="QueryCoverage =95%, HitCoverage=27%, E-value=2e-68, Identity=67%"; Hit description =similar to KIAA0252 [Apis mellifera]
  misc_feature: Gene Ontology Annotation: Cellular component=DNA-directed RNA polymerase II, holoenzyme; Biological process=growth
  misc_feature (1)..(10): Xaa can be any naturally occurring amino acid
  misc_feature (46)..(54): Xaa can be any naturally occurring amino acid
XXXXXXXXXXKIYNLGNTKTNKGLKVRHGTQERVFRLEFISNQEFXXXXXXXXXEASTAASNELPSKGKIEQKQADIKEAISYEFNEQDVERIIQEKSRFKPNPFNYAMKKTQLMKERDGALSRGDEDVARELAQKLSDLEERASELDKLRTSTISSISYINDRNRKKNVEEAEKAIMEEVRANKGKKADDPFTRRSTQP

SEQ ID NO: 32573 - protein, 245 aa, Diabrotica virgifera
  misc_feature: Coding regions on vcDNA: vcDNA=SeqID_12270; Strand=+; Position=3-740
  misc_feature: Homolog annotation: Hit_ID=XP_313416.1; Match level="QueryCoverage =100%, HitCoverage=20%, E-value=1e-136, Identity=95%"; Hit description=ENSANGP00000011389 [Anopheles gambiae]
  misc_feature: Gene Ontology Annotation: Molecular function=DNA-directed RNA polymerase activity; Cellular component=DNA-directed RNA polymerase II, core complex; Biological process=transcription from Pol II promoter
  misc_feature: Pfam annotation: Pfam_ID=RNA_pol_Rpb2_7; Match level="Score=182.9, E -value=6.6e-52, Copies=1"; Pfam description=RNA polymerase Rpb2, domain 7
QIGDKFASRHGQKGTCGIQYRQEDMIFSAEGITPDIIINPHAIPSRMTIGHLIECIQGKVSSNKGEIGDATPFNDAVNVQKISTLLQEYGYQLRGNEVMYNGHTGRKINAQIFLGPTYYQRLKHMVDDKIHSRARGPLQILVRQPMEGRARDGGLRFGEMERDCQISHGAAQFLRERLFEVSDPYRIHICNFCGLIAIANLRNNTFECKGCKNKTQISQVRLPYAAKLLFQELMSMNIAPRLMVL

SEQ ID NO: 32574 - protein, 185 aa, Diabrotica virgifera
  misc_feature: Coding regions on vcDNA: vcDNA=SeqID_12271; Strand=+; Position=1-555
  misc_feature (1)..(10): Xaa can be any naturally occurring amino acid
  misc_feature (12)..(62): Xaa can be any naturally occurring amino acid
  misc_feature (66)..(108): Xaa can be any naturally occurring amino acid
  misc_feature (112)..(118): Xaa can be any naturally occurring amino acid
  misc_feature (132)..(138): Xaa can be any naturally occurring amino acid
  misc_feature (154)..(160): Xaa can be any naturally occurring amino acid
  misc_feature (162)..(170): Xaa can be any naturally occurring amino acid
XXXXXXXXXXIXXXXXXXXXXXXXXXXXXXXXXXXXXXXXXXXXXXXXXXXXXXXXXXXXXXEDPXXXXXXXXXXXXXXXXXXXXXXXXXXXXXXXXXXXXXXXXXXXPIFXXXXXXXLRENREIFFGRVPXXXXXXXPPRGGDKRFFNWGGEXXXXXXXCXXXXXXXXXSVIGGGLYNPAGGGG

SEQ ID NO: 32575 - protein, 169 aa, Diabrotica virgifera
  misc_feature: Coding regions on vcDNA: vcDNA=SeqID_12272; Strand=-; Position=11-520
  misc_feature (3)..(13): Xaa can be any naturally occurring amino acid
  misc_feature (23)..(109): Xaa can be any naturally occurring amino acid
  misc_feature (113)..(132): Xaa can be any naturally occurring amino acid
  misc_feature (137)..(150): Xaa can be any naturally occurring amino acid
  misc_feature (154)..(167): Xaa can be any naturally occurring amino acid
LTXXXXXXXXXXXSNIILLTKFXXXXXXXXXXXXXXXXXXXXXXXXXXXXXXXXXXXXXXXXXXXXXXXXXXXXXXXXXXXXXXXXXXXXXXXXXXXXXXXXXXXXXXXDNLXXXXXXXXXXXXXXXXXXXXFLNSXXXXXXXXXXXXXXPRFXXXXXXXXXXXXXXPF

SEQ ID NO: 32576 - protein, 317 aa, Diabrotica virgifera
  misc_feature: Coding regions on vcDNA: vcDNA=SeqID_12273; Strand=+; Position=3-953
  misc_feature: Homolog annotation: Hit_ID=AAF87759.1; Match level="QueryCoverage =90%, HitCoverage=65%, E-value=1e-115, Identity=76%"; Hit description= cytochrome oxidase subunit I [Diabrotica virgifera virgifera]
  misc_feature: Pfam annotation: Pfam_ID=COX1; Match level="Score=128.1, E-value=2.2e- 35, Copies=1"; Pfam description=Cytochrome C and Quinol oxidase polyp
  misc_feature (11)..(11): Xaa can be any naturally occurring amino acid
  misc_feature (36)..(44): Xaa can be any naturally occurring amino acid
  misc_feature (71)..(71): Xaa can be any naturally occurring amino acid
  misc_feature (116)..(124): Xaa can be any naturally occurring amino acid
  misc_feature (128)..(134): Xaa can be any naturally occurring amino acid
  misc_feature (145)..(152): Xaa can be any naturally occurring amino acid
  misc_feature (173)..(173): Xaa can be any naturally occurring amino acid
  misc_feature (208)..(208): Xaa can be any naturally occurring amino acid
  misc_feature (225)..(225): Xaa can be any naturally occurring amino acid
  misc_feature (228)..(234): Xaa can be any naturally occurring amino acid
  misc_feature (253)..(253): Xaa can be any naturally occurring amino acid
  misc_feature (261)..(261): Xaa can be any naturally occurring amino acid
  misc_feature (279)..(279): Xaa can be any naturally occurring amino acid
  misc_feature (289)..(306): Xaa can be any naturally occurring amino acid
RIVERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSLIDIVLXDTYYVVAXFSYVLSIGAVFAIIAGFXQWFPLFTGKXXXXXXXXXXXXXXXXXXGNFTLLPPTIF

SEQ ID NO: 32577 - protein, 33 aa, Diabrotica virgifera
  misc_feature: Coding regions on vcDNA: vcDNA=SeqID_12274; Strand=+; Position=1-99
LQLCLSYQPADALILSTLLTCISALFVFLSMST

SEQ ID NO: 32578 - protein, 107 aa, Diabrotica virgifera
  misc_feature: Coding regions on vcDNA: vcDNA=SeqID_12275; Strand=-; Position=2-322
  misc_feature (1)..(16): Xaa can be any naturally occurring amino acid
  misc_feature (24)..(41): Xaa can be any naturally occurring amino acid
  misc_feature (46)..(67): Xaa can be any naturally occurring amino acid
  misc_feature (73)..(84): Xaa can be any naturally occurring amino acid
  misc_feature (90)..(107): Xaa can be any naturally occurring amino acid
XXXXXXXXXXXXXXXXVILKILRXXXXXXXXXXXXXXXXXXGVPLXXXXXXXXXXXXXXXXXXXXXXFFKLEXXXXXXXXXXXXRIPQGXXXXXXXXXXXXXXXXXX

SEQ ID NO: 32579 - protein, 80 aa, Diabrotica virgifera
  misc_feature: Coding regions on vcDNA: vcDNA=SeqID_12276; Strand=-; Position=0-239
NIRGSRRFIAGVYWPFAQLLDLQMFEYWCRLCWEEYCQAADSAAYCLPELLSLSSIQLFLISVNYLISSTNPNVLNKFLV

SEQ ID NO: 32580 - protein, 44 aa, Diabrotica virgifera
  misc_feature: Coding regions on vcDNA: vcDNA=SeqID_12277; Strand=+; Position=200-334
  misc_feature (36)..(44): Xaa can be any naturally occurring amino acid
DPLLVLTVYIFTRGVGGIGFSFLILLLYELRGKDVXXXXXXXXX

SEQ ID NO: 32581 - protein, 75 aa, Diabrotica virgifera
  misc_feature: Coding regions on vcDNA: vcDNA=SeqID_12278; Strand=-; Position=75-302
  misc_feature (32)..(32): Xaa can be any naturally occurring amino acid
  misc_feature (38)..(40): Xaa can be any naturally occurring amino acid
  misc_feature (42)..(44): Xaa can be any naturally occurring amino acid
  misc_feature (46)..(46): Xaa can be any naturally occurring amino acid
  misc_feature (48)..(48): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(58): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(73): Xaa can be any naturally occurring amino acid
GEPVRSPYCYSESPSYSMTSEPATDFFSSNKXPPSFSXXXSXXXYXLXNYHXYPXKXXYXLXNHNXFNXPFXXSP

SEQ ID NO: 32582 - protein, 138 aa, Diabrotica virgifera
  misc_feature: Coding regions on vcDNA: vcDNA=SeqID_12279; Strand=-; Position=0-413
  misc_feature (1)..(6): Xaa can be any naturally occurring amino acid
  misc_feature (8)..(133): Xaa can be any naturally occurring amino acid
XXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRKG

SEQ ID NO: 32583 - protein, 337 aa, Diabrotica virgifera
  misc_feature: Coding regions on vcDNA: vcDNA=SeqID_12280; Strand=-; Position=2-1012
  misc_feature (21)..(28): Xaa can be any naturally occurring amino acid
  misc_feature (31)..(334): Xaa can be any naturally occurring amino acid
KCNLCLKKEGPENYLSRVKGXXXXXXXXSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNML

SEQ ID NO: 32584 - protein, 345 aa, Diabrotica virgifera
  misc_feature: Coding regions on vcDNA: vcDNA=SeqID_12281; Strand=-; Position=0-1034
  misc_feature (5)..(341): Xaa can be any naturally occurring amino acid
ISAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEEG

SEQ ID NO: 32585 - protein, 28 aa, Diabrotica virgifera
  misc_feature: Coding regions on vcDNA: vcDNA=SeqID_12282; Strand=-; Position=2-85
IHFLLSWGNNIMITSSPPKNVVIIIITV

SEQ ID NO: 32586 - protein, 204 aa, Diabrotica virgifera
  misc_feature: Coding regions on vcDNA: vcDNA=SeqID_12283; Strand=+; Position=1-612
  misc_feature (7)..(13): Xaa can be any naturally occurring amino acid
  misc_feature (21)..(22): Xaa can be any naturally occurring amino acid
  misc_feature (25)..(198): Xaa can be any naturally occurring amino acid
GLTDGPXXXXXXXEISFLDLXXQGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLINSNG

SEQ ID NO: 32587 - protein, 81 aa, Diabrotica virgifera
  misc_feature: Coding regions on vcDNA: vcDNA=SeqID_12284; Strand=+; Position=463-708
FNVLIMLKFTKNFLIVTKFHSNQQFSGLFIPLIVVYIYSNRGQILCFLSRIDVAFFPILLCKIHIVSQHLFIHLTHCPSTC

SEQ ID NO: 32588 - protein, 98 aa, Diabrotica virgifera
  misc_feature: Coding regions on vcDNA: vcDNA=SeqID_12285; Strand=+; Position=1-297
  misc_feature (5)..(97): Xaa can be any naturally occurring amino acid
KRGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 32589 - protein, 285 aa, Diabrotica virgifera
  misc_feature: Coding regions on vcDNA: vcDNA=SeqID_12286; Strand=-; Position=1-855
  misc_feature (3)..(91): Xaa can be any naturally occurring amino acid
  misc_feature (94)..(104): Xaa can be any naturally occurring amino acid
  misc_feature (114)..(130): Xaa can be any naturally occurring amino acid
  misc_feature (134)..(155): Xaa can be any naturally occurring amino acid
  misc_feature (161)..(217): Xaa can be any naturally occurring amino acid
  misc_feature (221)..(278): Xaa can be any naturally occurring amino acid
LLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFHXXXXXXXXXXXYFSTVKITRXXXXXXXXXXXXXXXXXSCLXXXXXXXXXXXXXXXXXXXXXXQFFNDXXXXXXXXXXXXXXXXXXXXXXXXXXXXXXXXXXXXXXXXXXXXXXXXXXXXXXXXXKLIXXXXXXXXXXXXXXXXXXXXXXXXXXXXXXXXXXXXXXXXXXXXXXXXXXXXXXXXXXVLITTRP

SEQ ID NO: 32590 - protein, 185 aa, Diabrotica virgifera
  misc_feature: Coding regions on vcDNA: vcDNA=SeqID_12287; Strand=+; Position=163-717
  misc_feature: Homolog annotation: Hit_ID=EAL41187.1; Match level="QueryCoverage =47%, HitCoverage=22%, E-value=1e-13, Identity=47%"; Hit description =ENSANGP00000026738 [Anopheles gambiae str. PEST] ref|XP_565858.1| ENSANGP00000026738 [Anopheles gambiae st
  misc_feature (150)..(161): Xaa can be any naturally occurring amino acid
MMCLDFQNVKVFLWILIFKVILIQSKTSLWKLNIDKTKIIKVTKFPSIISYSDNQPIFHSGDPLFDIILSTEHYGETWVKQPIQYYCSDCKNRRNGTDEVLDCGKPVNFTYFDNLAGVVNRNKHPTVPEPQAILCFTKNYGNYKSEMEEXXXXXXXXXXXXVKKEKPRSIQLYNTDRGNFGVFKG

SEQ ID NO: 32591 - protein, 95 aa, Diabrotica virgifera
  misc_feature: Coding regions on vcDNA: vcDNA=SeqID_12288; Strand=-; Position=223-510
SLAFFILLCPSWCSACFYLSGCGHASLHACPGARSLLTKAEPNSPSAIIAVPSFCHNYVLFVVISRGCTYRCFIRALPSILSSRVRTFLKDQLPW

SEQ ID NO: 32592 - protein, 108 aa, Diabrotica virgifera
  misc_feature: Coding regions on vcDNA: vcDNA=SeqID_12289; Strand=-; Position=166-492
  misc_feature (2)..(23): Xaa can be any naturally occurring amino acid
  misc_feature (27)..(61): Xaa can be any naturally occurring amino acid
  misc_feature (69)..(79): Xaa can be any naturally occurring amino acid
RXXXXXXXXXXXXXXXXXXXXXXVNRXXXXXXXXXXXXXXXXXXXXXXXXXXXXXXXXXXXLINRCKFXXXXXXXXXXXGYHVSSKKVVNIFLLQYKVEFLSCGKLQK

SEQ ID NO: 32593 - protein, 122 aa, Diabrotica virgifera
  misc_feature: Coding regions on vcDNA: vcDNA=SeqID_12290; Strand=+; Position=1-369
  misc_feature (3)..(55): Xaa can be any naturally occurring amino acid
  misc_feature (58)..(108): Xaa can be any naturally occurring amino acid
SGXXXXXXXXXXXXXXXXXXXXXXXXXXXXXXXXXXXXXXXXXXXXXXXXXXXXXVLXXXXXXXXXXXXXXXXXXXXXXXXXXXXXXXXXXXXXXXXXXXXXXXXXXXLTDNSVILLESSHQ

SEQ ID NO: 32594 - protein, 124 aa, Diabrotica virgifera
  misc_feature: Coding regions on vcDNA: vcDNA=SeqID_12291; Strand=+; Position=90-464
  misc_feature: Homolog annotation: Hit_ID=NP_060015.1; Match level="QueryCoverage =75%, HitCoverage=25%, E-value=5e-20, Identity=50%"; Hit description =hydroxyacid oxidase 1 [Homo sapiens] emb|CAC34364.1| GD:HAO1 [Homo sapiens] emb|CAB57329.1|
  misc_feature: Gene Ontology Annotation: Molecular function=(S)-2-hydroxy-acid oxidase activity; Cellular component=peroxisome; Biological process =fatty acid alpha-oxidation
  misc_feature: Pfam annotation: Pfam_ID=FMN_dh; Match level="Score=-227.0, E-value =0.072, Copies=1"; Pfam description=FMN-dependent dehydrogenase
MSDLFSVSEFEKHALEVLPKDIRDYYRSGAGRQESLADNRKAFFRYKVRPRYLRNVENIDLSTVILGEKISMPIGIAPSGMLKMGHPMGEIEDAEAVDIDADEKLLFPGRRKNLLLGGMTVYIV

SEQ ID NO: 32595 - protein, 52 aa, Diabrotica virgifera
  misc_feature: Coding regions on vcDNA: vcDNA=SeqID_12292; Strand=-; Position=1-156
  misc_feature (8)..(39): Xaa can be any naturally occurring amino acid
  misc_feature (41)..(52): Xaa can be any naturally occurring amino acid
FRGFSLKXXXXXXXXXXXXXXXXXXXXXXXXXXXXXXXXPXXXXXXXXXXXX

SEQ ID NO: 32596 - protein, 137 aa, Diabrotica virgifera
  misc_feature: Coding regions on vcDNA: vcDNA=SeqID_12293; Strand=+; Position=1-411
  misc_feature (3)..(135): Xaa can be any naturally occurring amino acid
HLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGG

SEQ ID NO: 32597 - protein, 178 aa, Diabrotica virgifera
  misc_feature: Coding regions on vcDNA: vcDNA=SeqID_12294; Strand=+; Position=98-634
  misc_feature: Homolog annotation: Hit_ID=NP_648312.3; Match level="QueryCoverage =100%, HitCoverage=100%, E-value=4e-68, Identity=67%"; Hit description=CG3911-PA [Drosophila melanogaster] gb|AAF50270.3| CG3911-PA [Drosophila melanogaster]
  misc_feature: Gene Ontology Annotation: Molecular function=molecular_function unknown; Cellular component=TRAPP; Biological process=ER to Golgi transport
  misc_feature: Pfam annotation: Pfam_ID=TRAPP_Bet3; Match level="Score=162.5, E -value=9.1e-46, Copies=1"; Pfam description=Transport protein particle (TRAPP) com
MSRSTTRFDVKKVNSELVTLTYGALVAQMIKDLDNVDDVSKQLERLGYNMGIRLIEDFLAKTGTGRCLDLKDTADKIQSAFKMYLGIQPNVTNWSPSGDEFSFMLDSNPLTELVELPDDLKSLKYCNLLCGAIRGALEMVQLDVQSWIVQDQLKGDQNTEIRVKFIRRLEDAMPAGED

SEQ ID NO: 32598 - protein, 93 aa, Diabrotica virgifera
  misc_feature: Coding regions on vcDNA: vcDNA=SeqID_12295; Strand=-; Position=1-279
  misc_feature (75)..(85): Xaa can be any naturally occurring amino acid
PFLSLYMQCSAAWEFWEIQRYFFPGFIVLVGGHSIGTLFVFNLICLYFPIISNSKHFSLSLSIIFAWRISVGIAXXXXXXXXXXXCSYLLWIE

SEQ ID NO: 32599 - protein, 110 aa, Diabrotica virgifera
  misc_feature: Coding regions on vcDNA: vcDNA=SeqID_12296; Strand=-; Position=32-364
  misc_feature: Homolog annotation: Hit_ID=CAH84231.1; Match level="QueryCoverage =92%, HitCoverage=72%, E-value=1e-14, Identity=36%"; Hit description =hypothetical protein PC300925.00.0 [Plasmodium chabaudi]
  misc_feature (39)..(39): Xaa can be any naturally occurring amino acid
  misc_feature (56)..(56): Xaa can be any naturally occurring amino acid
HRFHHLHIGHFIRHHPLVHHFFVHHFFIHHLLVNFFHHXGVLVFEPSFFLSSLIVXYHLVFQHFFVHHFTFHHFFFHYVIINHHFEGHHFFVHCLWNSLFGHHLSAPAYL

SEQ ID NO: 32600 - protein, 244 aa, Diabrotica virgifera
  misc_feature: Coding regions on vcDNA: vcDNA=SeqID_12297; Strand=-; Position=2-733
  misc_feature (1)..(1): Xaa can be any naturally occurring amino acid
  misc_feature (4)..(13): Xaa can be any naturally occurring amino acid
  misc_feature (19)..(244): Xaa can be any naturally occurring amino acid
XNIXXXXXXXXXXVKKCKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32601 - protein, 18 aa, Diabrotica virgifera
  misc_feature: Coding regions on vcDNA: vcDNA=SeqID_12298; Strand=-; Position=1-54
  misc_feature (1)..(18): Xaa can be any naturally occurring amino acid
XXXXXXXXXXXXXXXXXX

SEQ ID NO: 32602 - protein, 153 aa, Diabrotica virgifera
  misc_feature: Coding regions on vcDNA: vcDNA=SeqID_12299; Strand=+; Position=1-459
  misc_feature (1)..(81): Xaa can be any naturally occurring amino acid
  misc_feature (84)..(142): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXRRXXXXXXXXXXXXXXXXXXXXXXXXXXXXXXXXXXXXXXXXXXXXXXXXXXXXXXXXXXXRDKRRIFLGSS

SEQ ID NO: 32603 - protein, 29 aa, Diabrotica virgifera
  misc_feature: Coding regions on vcDNA: vcDNA=SeqID_12300; Strand=+; Position=12-98
FYWRAQIHNKDCDPNVGLKFIIGVAGILL

SEQ ID NO: 32604 - protein, 244 aa, Diabrotica virgifera
  misc_feature: Coding regions on vcDNA: vcDNA=SeqID_12301; Strand=+; Position=213-943
  misc_feature: Homolog annotation: Hit_ID=XP_392908.1; Match level="QueryCoverage =95%, HitCoverage=46%, E-value=2e-50, Identity=46%"; Hit description =similar to ENSANGP00000017992 [Apis mellifera]
  misc_feature: Gene Ontology Annotation: Molecular function=ATPase activity; Cellular component=replication fork; Biological process=DNA replication
  misc_feature (219)..(219): Xaa can be any naturally occurring amino acid
FCLSSAKKVTSCPICNKDFPTDEIESHANRCIFLNCVEDDLAKRKRSPSPVISVSQPKVSFTQKSPRNLSRQFVENPVKHTENSASCSNSTSISFKPNLSFIIPLAKQIQPKTLNDFYGQNQVLGKATVLRDLLEKAEIPNMILWGPPGCGKTSLSGIISEICKMNSKKLRFSSLCAASAGVKEVQNIITISKNEMKFGKKTVLFMDEIHAFNKNNRDXMLLSVERGEITLVGATTENPSFSIN

SEQ ID NO: 32605 - protein, 85 aa, Diabrotica virgifera
  misc_feature: Coding regions on vcDNA: vcDNA=SeqID_12302; Strand=+; Position=45-302
  misc_feature (30)..(36): Xaa can be any naturally occurring amino acid
  misc_feature (42)..(47): Xaa can be any naturally occurring amino acid
  misc_feature (60)..(69): Xaa can be any naturally occurring amino acid
FEKKSLCITFVNTPVRFKSLQVEKWSSFVXXXXXXXLQKSTXXXXXXFFSKVESFRVISXXXXXXXXXXGDFQGIKGPAKNTIFY

SEQ ID NO: 32606 - protein, 94 aa, Diabrotica virgifera
  misc_feature: Coding regions on vcDNA: vcDNA=SeqID_12303; Strand=+; Position=190-474
EKKYKKKRKSISKYGASGRVVLAYIWWLGGGGACQNRAIAPKTLKTGLIAIPIVDRPCTFWASSFLYCHPHLNCPPTPIAHLNSLVTNKTFIFS

SEQ ID NO: 32607 - protein, 123 aa, Diabrotica virgifera
  misc_feature: Coding regions on vcDNA: vcDNA=SeqID_12304; Strand=+; Position=573-941
  misc_feature (104)..(109): Xaa can be any naturally occurring amino acid
VYTVLRRLPTPNRHVSLFNHRPGRISLSSSSFSISSLQLLLGLPLFLLPRGVHAKICLRILSSGILCTWSYHISCFVLMPSLLYVNSHHFSDFLFVIRPKFLRXXXXXXPLPMEKGAPRKFSF

SEQ ID NO: 32608 - protein, 47 aa, Diabrotica virgifera
  misc_feature: Coding regions on vcDNA: vcDNA=SeqID_12305; Strand=+; Position=3-146
IVCVLGSIAFLTILERRALGNNQIRSGANSSVFFAICRPKERCAEAG

SEQ ID NO: 32609 - protein, 301 aa, Diabrotica virgifera
  misc_feature: Coding regions on vcDNA: vcDNA=SeqID_12306; Strand=-; Position=2-904
  misc_feature (41)..(56): Xaa can be any naturally occurring amino acid
  misc_feature (90)..(96): Xaa can be any naturally occurring amino acid
  misc_feature (210)..(234): Xaa can be any naturally occurring amino acid
KPPCQNIVFPICTKTRLAQIYYVRWKCTKHSMFWIYNISAXXXXXXXXXXXXXXXXQYLCSSTAVLPHSQKGSILYMQYLYNASDKFSLXXXXXXXKQREEEAIAMKKADKKKAIEVKEVNYRAITFDLEAILTVPFSADPQIYYKRKLSVFNFTTYDSFDQNGHCYVWDETQGSKGASEIGTCLLKYPYNLPKTVEHVATFSDTCGGQXXXXXXXXXXXXXXXXXXXXXXXXXKFMESGHSYLEADSIHATIEHARKHKKIFTIEEWALLISKTQTKTLEVRRLNHSDFYDLQNLASIII

SEQ ID NO: 32610 - protein, 180 aa, Diabrotica virgifera
  misc_feature: Coding regions on vcDNA: vcDNA=SeqID_12307; Strand=-; Position=1-540
  misc_feature (12)..(30): Xaa can be any naturally occurring amino acid
  misc_feature (32)..(47): Xaa can be any naturally occurring amino acid
  misc_feature (49)..(180): Xaa can be any naturally occurring amino acid
KKIPRFYSPKGXXXXXXXXXXXXXXXXXXXEXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32611 - protein, 37 aa, Diabrotica virgifera
  misc_feature: Coding regions on vcDNA: vcDNA=SeqID_12308; Strand=-; Position=0-110
  misc_feature (16)..(25): Xaa can be any naturally occurring amino acid
KRPLNKFANTLPIVIXXXXXXXXXXTLHFEKRYNIHL

SEQ ID NO: 32612 - protein, 272 aa, Diabrotica virgifera
  misc_feature: Coding regions on vcDNA: vcDNA=SeqID_12309; Strand=+; Position=1-815
  misc_feature: Homolog annotation: Hit_ID=A32713; Match level="QueryCoverage=98%, HitCoverage=31%, E-value=3e-79, Identity=53%"; Hit description =reverse transcriptase homolog - fruit fly (Drosophila melanogaster)
  misc_feature: Pfam annotation: Pfam_ID=RVT_1; Match level="Score=196.6, E-value =5.1e-56, Copies=1"; Pfam description=Reverse transcriptase (RNA -dependent D
  misc_feature (261)..(261): Xaa can be any naturally occurring amino acid
VAQIILIPKPGKNKTQVTSYRPISLLPVLSKILEKLLLKQLSPVIEERKLIPQHQFGFRTQHGTIEQVHRLVKHIRSDLENKRYCSAEFLDIGQAFDKVWYAGMLFKLKKNLPHPFYQILKSYISNRHFLVKQDNEYTSLRPIKAGVPQGSVLGPILYLLYTADLPTSNRTTCATFADDTAVLASHHDPNTASGILQKDLNNIQRWLKKWKIKANESKSIHVTFTMKRQTCPSVTLNETQLPQTDTVKYLGIHLYRRLTWXKHIFTKRKQLG

SEQ ID NO: 32613 - protein, 91 aa, Diabrotica virgifera
  misc_feature: Coding regions on vcDNA: vcDNA=SeqID_12310; Strand=-; Position=10-285
  misc_feature (59)..(66): Xaa can be any naturally occurring amino acid
  misc_feature (87)..(87): Xaa can be any naturally occurring amino acid
LVYLFRELALPQQENIVFRFILSRYMIFIHLWEYSGEGCGLAPLPPVGISRGPRITIFXXXXXXXXPMTCVCPFNGMIGFNCLSDKXIAIF

SEQ ID NO: 32614 - protein, 46 aa, Diabrotica virgifera
  misc_feature: Coding regions on vcDNA: vcDNA=SeqID_12311; Strand=-; Position=0-137
  misc_feature (1)..(45): Xaa can be any naturally occurring amino acid
XXXXXXXXXXXXXXXXXXXXXXXXXXXXXXXXXXXXXXXXXXXXXP

SEQ ID NO: 32615 - protein, 62 aa, Diabrotica virgifera
  misc_feature: Coding regions on vcDNA: vcDNA=SeqID_12312; Strand=-; Position=2-187
  misc_feature (5)..(28): Xaa can be any naturally occurring amino acid
  misc_feature (31)..(62): Xaa can be any naturally occurring amino acid
IGSLXXXXXXXXXXXXXXXXXXXXXXXXIHXXXXXXXXXXXXXXXXXXXXXXXXXXXXXXXX

SEQ ID NO: 32616 - protein, 141 aa, Diabrotica virgifera
  misc_feature: Coding regions on vcDNA: vcDNA=SeqID_12313; Strand=+; Position=3-425
  misc_feature: Homolog annotation: Hit_ID=AAV84216.1; Match level="QueryCoverage =96%, HitCoverage=62%, E-value=4e-33, Identity=55%"; Hit description =elongation factor 4A [Culicoides sonorensis]
  misc_feature: Gene Ontology Annotation: Molecular function=translation initiation factor activity; Cellular component=eukaryotic translation initiation factor 4 complex; Biological process=regulation of translational initiation
  misc_feature (27)..(27): Xaa can be any naturally occurring amino acid
  misc_feature (61)..(66): Xaa can be any naturally occurring amino acid
  misc_feature (112)..(112): Xaa can be any naturally occurring amino acid
  misc_feature (115)..(115): Xaa can be any naturally occurring amino acid
  misc_feature (123)..(123): Xaa can be any naturally occurring amino acid
DENIEANCQDVGNNFNDINLIEELLRXLYVYGFRKPLALLRTPVSPCVKAHHGIAHAQSCXXXXXXFSISILQQIVTSEGESQALILAPTLELAPQIQKVVDVLGYFMSAHXHAXIGGTNVRXYMPKLETGAHVAAGTPRQ

SEQ ID NO: 32617 - protein, 277 aa, Diabrotica virgifera
  misc_feature: Coding regions on vcDNA: vcDNA=SeqID_12314; Strand=+; Position=3-835
  misc_feature: Homolog annotation: Hit_ID=AAH59310.1; Match level="QueryCoverage =84%, HitCoverage=31%, E-value=3e-92, Identity=71%"; Hit description =MGC68977 protein [Xenopus laevis]
  misc_feature: Gene Ontology Annotation: Molecular function=electron transporter activity; Cellular component=nucleus; Biological process=electron transport
  misc_feature: Pfam annotation: Pfam_ID=MCM; Match level="Score=174.3, E-value=2.6e -49, Copies=1"; Pfam description=MCM2/3/5 family
  misc_feature (46)..(52): Xaa can be any naturally occurring amino acid
  misc_feature (147)..(147): Xaa can be any naturally occurring amino acid
  misc_feature (169)..(169): Xaa can be any naturally occurring amino acid
DGGVVCIDEFDKMREDDRVAIHEAMEQQTISIAKAGITTTLNSRCXXXXXXXSIFGRWDDTKGEENIDFLPTILSRFDMIFIVKDEHDKQRDMTLAKHIMGVHMSAGEITKSSKDGEMSLEFIRKYINYCRTRCGPRLNPDAAEKLXRRYVMMRSGASQHEKEADKKSXIPITVRPLDAVIRISESLAKMQLPPFVTKTHVDEALPLFQVSTLDAAMKESLLGAKGFSMRKNPQGCFFWKTLEARVGFWKRGFPPKFFPRFWNPQIPKRTEIKFFLL

SEQ ID NO: 32618 - protein, 186 aa, Diabrotica virgifera
  misc_feature: Coding regions on vcDNA: vcDNA=SeqID_12315; Strand=-; Position=3-560
  misc_feature (8)..(54): Xaa can be any naturally occurring amino acid
  misc_feature (57)..(68): Xaa can be any naturally occurring amino acid
  misc_feature (86)..(95): Xaa can be any naturally occurring amino acid
  misc_feature (102)..(118): Xaa can be any naturally occurring amino acid
  misc_feature (124)..(138): Xaa can be any naturally occurring amino acid
  misc_feature (164)..(169): Xaa can be any naturally occurring amino acid
  misc_feature (178)..(180): Xaa can be any naturally occurring amino acid
YNLEKISXXXXXXXXXXXXXXXXXXXXXXXXXXXXXXXXXXXXXXXXXXXXXXXSSXXXXXXXXXXXXYLNHTIYLFIKSYFNLSXXXXXXXXXXYYHFISXXXXXXXXXXXXXXXXXNSPKLXXXXXXXXXXXXXXXKIQKINKSYNKLSFSSLSSFFLSFSXXXXXXSSFKRLSSXXXRARAPL

SEQ ID NO: 32619 - protein, 55 aa, Diabrotica virgifera
  misc_feature: Coding regions on vcDNA: vcDNA=SeqID_12316; Strand=-; Position=1-165
  misc_feature (3)..(3): Xaa can be any naturally occurring amino acid
  misc_feature (12)..(12): Xaa can be any naturally occurring amino acid
  misc_feature (16)..(18): Xaa can be any naturally occurring amino acid
  misc_feature (23)..(34): Xaa can be any naturally occurring amino acid
  misc_feature (41)..(53): Xaa can be any naturally occurring amino acid
KPXLAHTGFNSXSCKXXXVEQTXXXXXXXXXXXXIQHRGRXXXXXXXXXXXXXLL

SEQ ID NO: 32620 - protein, 101 aa, Diabrotica virgifera
  misc_feature: Coding regions on vcDNA: vcDNA=SeqID_12317; Strand=+; Position=96-401
  misc_feature (73)..(80): Xaa can be any naturally occurring amino acid
RLSERYRLLATRGLASGAGFALYSRLDAAEPDIRIARRAEGILLQISRISQKTYPPRPTAPIMQPYILTKHQXXXXXXXXKPNNDGMFCDIAPSPLQDPTS

SEQ ID NO: 32621 - protein, 18 aa, Diabrotica virgifera
  misc_feature: Coding regions on vcDNA: vcDNA=SeqID_12318; Strand=-; Position=2-55
PDFYLITNGIHAYCVLDI

SEQ ID NO: 32622 - protein, 58 aa, Diabrotica virgifera
  misc_feature: Coding regions on vcDNA: vcDNA=SeqID_12319; Strand=-; Position=2-175
  misc_feature (29)..(35): Xaa can be any naturally occurring amino acid
  misc_feature (50)..(58): Xaa can be any naturally occurring amino acid
KKKSKELVPVSLGQNTPAHSHLLIGPVEXXXXXXXKAILLINRGKKCSEXXXXXXXXX

SEQ ID NO: 32623 - protein, 135 aa, Diabrotica virgifera
  misc_feature: Coding regions on vcDNA: vcDNA=SeqID_12320; Strand=-; Position=0-404
  misc_feature (3)..(76): Xaa can be any naturally occurring amino acid
  misc_feature (83)..(90): Xaa can be any naturally occurring amino acid
  misc_feature (99)..(105): Xaa can be any naturally occurring amino acid
  misc_feature (113)..(134): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXHQPLIQXXXXXXXXYVPLARSKXXXXXXXQWPGETIXXXXXXXXXXXXXXXXXXXXXXP

SEQ ID NO: 32624 - protein, 48 aa, Diabrotica virgifera
  misc_feature: Coding regions on vcDNA: vcDNA=SeqID_12321; Strand=-; Position=1-144
  misc_feature (2)..(48): Xaa can be any naturally occurring amino acid
GXXXXXXXXXXXXXXXXXXXXXXXXXXXXXXXXXXXXXXXXXXXXXXX

SEQ ID NO: 32625 - protein, 99 aa, Diabrotica virgifera
  misc_feature: Coding regions on vcDNA: vcDNA=SeqID_12322; Strand=-; Position=68-367
ILNFRSRGRSILFQRAKTFYSDINHHHRDQKDLPQVVVLILPALDPQLLIWLSSPIFGRSSCSRQRRRTVVGYQNYLLMMLGRMVPNSRTRTHSKNLRE

SEQ ID NO: 32626 - protein, 264 aa, Diabrotica virgifera
  misc_feature: Coding regions on vcDNA: vcDNA=SeqID_12323; Strand=-; Position=1-792
  misc_feature (1)..(13): Xaa can be any naturally occurring amino acid
  misc_feature (15)..(264): Xaa can be any naturally occurring amino acid
XXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32627 - protein, 83 aa, Diabrotica virgifera
  misc_feature: Coding regions on vcDNA: vcDNA=SeqID_12324; Strand=-; Position=115-366
NVFERFYFRSEYYKFTNTFCIYFASFRFIILTKRVYIFRFGFFQKNIPCWKRSVKIILTYCTFEISYTFGVIKLSNLCIHVSF

SEQ ID NO: 32628 - protein, 261 aa, Diabrotica virgifera
  misc_feature: Coding regions on vcDNA: vcDNA=SeqID_12325; Strand=+; Position=122-904
MSITDIHLRDYLSTTAKPKNEVEEIFDSVLYRDPYPECICGGEGFREGINIMDKDGNIPEKDLIHFSLGQLEYRFICGKHLQDFITLPPDFKNFYQQQLDTNLDSDSSTDKEDDEDDDEPETCCHYANSYVSATNNLLTPSTHDRTPSVREEMTLPNEGARNQSFPGCIRVFKPQINKVKRKKQSFRSNDNAFRLYVQHSSMDNNNASSSDSRTHEQSDFGIDSNNRIHGQSDNSSDSNKRTHGQSDSSSDSNKRTHDQSY

SEQ ID NO: 32629 - protein, 99 aa, Diabrotica virgifera
  misc_feature: Coding regions on vcDNA: vcDNA=SeqID_12326; Strand=-; Position=37-336
  misc_feature (1)..(10): Xaa can be any naturally occurring amino acid
  misc_feature (42)..(48): Xaa can be any naturally occurring amino acid
  misc_feature (63)..(90): Xaa can be any naturally occurring amino acid
XXXXXXXXXXILNTYLFVKNLFLCGFFVINYSNEEISHNLLXXXXXXXFLLPRRMSLSKYKMXXXXXXXXXXXXXXXXXXXXXXXXXXXXVVLSERRYK

SEQ ID NO: 32630 - protein, 80 aa, Diabrotica virgifera
  misc_feature: Coding regions on vcDNA: vcDNA=SeqID_12327; Strand=-; Position=1-240
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (73)..(80): Xaa can be any naturally occurring amino acid
PFXXXXXXXXXXXTNLAHTGLNXXXXXXXXSNXXXXXXXXXXXXXXPTSRSXXXXXXXXXXXXXXVIPKVIYXXXXXXXX

SEQ ID NO: 32631 - protein, 64 aa, Diabrotica virgifera
  misc_feature: Coding regions on vcDNA: vcDNA=SeqID_12328; Strand=+; Position=12-203
  misc_feature (1)..(9): Xaa can be any naturally occurring amino acid
XXXXXXXXXMQGLNEGGSTVISCRKKGILKKTAGIFLNAGKTITSSEQVARYFSRLPTQLQTPR

SEQ ID NO: 32632 - protein, 66 aa, Diabrotica virgifera
  misc_feature: Coding regions on vcDNA: vcDNA=SeqID_12329; Strand=+; Position=18-218
DDFEDHPALLERHSQLSASENILAPEERSIYDRRLYRYVSCRASYQKKIIINGVSPNVRRQKYTNF

SEQ ID NO: 32633 - protein, 282 aa, Diabrotica virgifera
  misc_feature: Coding regions on vcDNA: vcDNA=SeqID_12330; Strand=+; Position=2-847
  misc_feature: Homolog annotation: Hit_ID=NP_650611.1; Match level="QueryCoverage =98%, HitCoverage=78%, E-value=6e-43, Identity=30%"; Hit description =CG4090-PA [Drosophila melanogaster] gb|AAF55402.1| CG4090-PA [Drosophila melanogaster]
  misc_feature: Pfam annotation: Pfam_ID=CBM_14; Match level="Score=47.8, E-value =3.2e-11, Copies=1"; Pfam description=Chitin binding Peritrophin-A domain
QNQNGSGSQNQQGSGNNGQQETQKPNNSGNTGLVTNKKCVKEGFAKDDGDCKKFYRCVNNGKGGYDKYEFTCPEGTVWDETNLSCNWPFAVTGKCGQPNSNNNNQNSSNQQNGSNNSNNQQNIGTNSDQDNNQQSNGSNENNQQNAGDGSSQQNNQGGNGSNNNNQQNTGDNSSQQNNQQGGGTNSNNQQNTGNGSNQNNQQSTGSNQNTQQNTGNNSNQQNNQGGTSNGNNQQNVGDGSNQNNTQRNNGSNQDNQQNAGNNSNHQNNSGGESSNNNQPKKL

SEQ ID NO: 32634 - protein, 73 aa, Diabrotica virgifera
  misc_feature: Coding regions on vcDNA: vcDNA=SeqID_12331; Strand=-; Position=64-285
VEGSGIKQVYECRYDDRCQPSYYETLKLIILISRITHCHMFSQQLLFSQPIHSFIFTTHKLLIYLHRFHHISF

SEQ ID NO: 32635 - protein, 34 aa, Diabrotica virgifera; identical to SEQ ID NO: 27603
  misc_feature: Coding regions on vcDNA: vcDNA=SeqID_12332; Strand=-; Position=80-184

SEQ ID NO: 32636 - protein, 205 aa, Diabrotica virgifera
  misc_feature: Coding regions on vcDNA: vcDNA=SeqID_12333; Strand=-; Position=134-751
  misc_feature: Homolog annotation: Hit_ID=XP_391892.1; Match level="QueryCoverage =94%, HitCoverage=11%, E-value=7e-62, Identity=63%"; Hit description =similar to CG2049-PB [Apis mellifera]
  misc_feature: Gene Ontology Annotation: Molecular function=protein kinase activity; Cellular component=site of polarized growth (sensu Saccharomyces); Biological process=signal transduction
  misc_feature (136)..(136): Xaa can be any naturally occurring amino acid
GLKLDNFLLGTEGFVKIADFGLCKEGMGFGDRTGPFCGTPGFLAPEVLPETSYSRAVGWGGLGGPIFGRLGGESPFPGEEEEGVFDLIVNGEGRVPRFLSFEAPPIMGRVLRKSPDRGFGLGGGDAGGVKKPGFFXHIPGGELFPPRIPPPFVPPGGAMGGVSNFGEEFSPERPPLAPPKEPRQFSVQDHPLFRGVSSPAGGGGP

SEQ ID NO: 32637 - protein, 92 aa, Diabrotica virgifera
  misc_feature: Coding regions on vcDNA: vcDNA=SeqID_12334; Strand=+; Position=1-276
  misc_feature (3)..(10): Xaa can be any naturally occurring amino acid
  misc_feature (14)..(14): Xaa can be any naturally occurring amino acid
  misc_feature (17)..(41): Xaa can be any naturally occurring amino acid
  misc_feature (44)..(91): Xaa can be any naturally occurring amino acid
IIXXXXXXXXNERXWMXXXXXXXXXXXXXXXXXXXXXXXXXREXXXXXXXXXXXXXXXXXXXXXXXXXXXXXXXXXXXXXXXXXXXXXXXXP

SEQ ID NO: 32638 - protein, 281 aa, Diabrotica virgifera
  misc_feature: Coding regions on vcDNA: vcDNA=SeqID_12335; Strand=+; Position=1-848
  misc_feature: Homolog annotation: Hit_ID=XP_314933.1; Match level="QueryCoverage =99%, HitCoverage=6%, E-value=7e-33, Identity=29%"; Hit description =ENSANGP00000001120 [Anopheles gambiae]
  misc_feature (186)..(186): Xaa can be any naturally occurring amino acid
  misc_feature (225)..(225): Xaa can be any naturally occurring amino acid
  misc_feature (278)..(278): Xaa can be any naturally occurring amino acid
ADYIYKHNYGMPDESARENRAIHLYNLANRRKFNVSGELDVLTKWNGQEYFLTAVHSKRIVKLWTDYEAQDKGYKQHSRLELSPTHWIEYNLNVLNKSLDETFDAQKVVINVIYPRRSFTAQGFYNISDSIVSTDVSLVYDKDNKTVQAGLDWRRASLHREQLLLQIKHPSFERDITMSSEYGYDXRQSMGNWSVVYSLNPDQKLTLCGKVNDNSNSVTYNYTYXVWAEHIATNLNLNSTGDFYWNPNALGTEHITNYQRSYLPSSVSETLAKINLLXKRI

SEQ ID NO: 32639 - protein, 229 aa, Diabrotica virgifera
  misc_feature: Coding regions on vcDNA: vcDNA=SeqID_12336; Strand=+; Position=2-688
  misc_feature: Homolog annotation: Hit_ID=XP_397110.1; Match level="QueryCoverage =88%, HitCoverage=37%, E-value=3e-51, Identity=53%"; Hit description =similar to CG5462-PD [Apis mellifera]
  misc_feature: Gene Ontology Annotation: Cellular component=lateral plasma membrane; Biological process=establishment and/or maintenance of epithelial cell polarity
  misc_feature: Pfam annotation: Pfam_ID=PDZ; Match level="Score=31.7, E-value=2.2e -06, Copies=1"; Pfam description=PDZ domain (Also known as DHR or GLGF
GGLQGQRGNPLDRSDEGIFVSKINSVGAARRDGRLKAGMRLLEVNGKSLLGATHQEAVNALRACGNMIHMVVCKGYDKGDIDRAVHEGRLTRGGSVSSRSQSVSSLDVPEDDLQDLKVKSELLQLEKDEVEKRLQPIHQEEEEFSLVEAKPPSPADKVLDVVRAVETLAHGPMENSVPPKSPNSELKTTTIVMSKHTLAPQPTTDELMHVSTLPKTTQPKVDVETESKS

SEQ ID NO: 32640 - protein, 209 aa, Diabrotica virgifera
  misc_feature: Coding regions on vcDNA: vcDNA=SeqID_12337; Strand=-; Position=264-894
  misc_feature: Homolog annotation: Hit_ID=NP_067034.2; Match level="QueryCoverage =97%, HitCoverage=32%, E-value=2e-32, Identity=34%"; Hit description =Buster1 transposase-like protein [Homo sapiens]
  misc_feature (48)..(48): Xaa can be any naturally occurring amino acid
  misc_feature (108)..(108): Xaa can be any naturally occurring amino acid
  misc_feature (113)..(113): Xaa can be any naturally occurring amino acid
  misc_feature (126)..(126): Xaa can be any naturally occurring amino acid
  misc_feature (186)..(186): Xaa can be any naturally occurring amino acid
AQNFINSEFIIKLAYLCDIFNKLNNLNKFLQGNNTHILQLADKITGFXKKFFLWKRKLEDQKIDCFPALQGILHEKSIVILDPSLKNMFTQHMLSLSEHFEKYFPEDXSNITXVRNPFQSSTLNFXSENLFEFWSSVSYEYHAISPAALKVLLLFVTLYLCETRFSAFSVIKSKYRSNIYLEKEMXVVISKLEPRFHKLCSKKQAHPSH

SEQ ID NO: 32641 - protein, 24 aa, Diabrotica virgifera
  misc_feature: Coding regions on vcDNA: vcDNA=SeqID_12338; Strand=-; Position=0-71
  misc_feature (4)..(23): Xaa can be any naturally occurring amino acid
KMDXXXXXXXXXXXXXXXXXXXXP

SEQ ID NO: 32642 - protein, 62 aa, Diabrotica virgifera
  misc_feature: Coding regions on vcDNA: vcDNA=SeqID_12339; Strand=-; Position=1-186
  misc_feature (3)..(61): Xaa can be any naturally occurring amino acid
ITXXXXXXXXXXXXXXXXXXXXXXXXXXXXXXXXXXXXXXXXXXXXXXXXXXXXXXXXXXXS

SEQ ID NO: 32643 - protein, 68 aa, Diabrotica virgifera
  misc_feature: Coding regions on vcDNA: vcDNA=SeqID_12340; Strand=-; Position=363-569
FPNFYNFLSKIMQIHSNLRKCKQLPYILPICACFPFSTATFSFILSMRQRSALRLFKYIFVLIFILIL

SEQ ID NO: 32644 - protein, 308 aa, Diabrotica virgifera
  misc_feature: Coding regions on vcDNA: vcDNA=SeqID_12341; Strand=+; Position=1-922
  misc_feature: Homolog annotation: Hit_ID=XP_319689.1; Match level="QueryCoverage =97%, HitCoverage=14%, E-value=3e-70, Identity=43%"; Hit description =ENSANGP00000021394 [Anopheles gambiae]
  misc_feature: Gene Ontology Annotation: Molecular function=protein binding; Biological process=vision
  misc_feature (149)..(149): Xaa can be any naturally occurring amino acid
  misc_feature (185)..(196): Xaa can be any naturally occurring amino acid
  misc_feature (234)..(234): Xaa can be any naturally occurring amino acid
  misc_feature (252)..(252): Xaa can be any naturally occurring amino acid
  misc_feature (254)..(254): Xaa can be any naturally occurring amino acid
  misc_feature (268)..(268): Xaa can be any naturally occurring amino acid
  misc_feature (276)..(276): Xaa can be any naturally occurring amino acid
  misc_feature (285)..(285): Xaa can be any naturally occurring amino acid
  misc_feature (300)..(300): Xaa can be any naturally occurring amino acid
ERSSNQPERNASWRLLLRKEIFTPWHNPVEDSMSTNLIYHQIVRGVKFGEYRCPKEGDIAVLIAIQYYVENGAPINQKALHSRIGEYLPTYLVKRSQNDLTNWENKIVSAFINLACVKQKQPSIKAKETMVKYAQMTWPILFSKFFEVXTASKNKMIIAVNSAGIFMIDDEEQIHMELTFADVSXXXXXXXXXXXXILNTVAREEYAFHTLDAQSLSNLLQYILDGLKKRSVYXVCTADYSHSVGAESFLSXFXKGDLIVLGNGQTGXTLMTASWXGYENGTENXGDFPTENVYILPTLXPPPADILA

SEQ ID NO: 32645 - protein, 143 aa, Diabrotica virgifera
  misc_feature: Coding regions on vcDNA: vcDNA=SeqID_12342; Strand=-; Position=2-427
  misc_feature (45)..(45): Xaa can be any naturally occurring amino acid
  misc_feature (61)..(61): Xaa can be any naturally occurring amino acid
  misc_feature (91)..(91): Xaa can be any naturally occurring amino acid
ISILKYFVFSSNYCSIFLLFIDFSHIVICYFFFRSYNSDLWLFFXLFIFFVFDLIFLPVYXLSLTSFLSSNISILVFLVKTCLLSCTLIFXVVPNLYLHLIFYFPFNYCVYFSLFLIISFFIYINLLTIIIPHLSTNFYLVIL

SEQ ID NO: 32646 - protein, 66 aa, Diabrotica virgifera; identical to SEQ ID NO: 26808
  misc_feature: Coding regions on vcDNA: vcDNA=SeqID_12343; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32647 - protein, 66 aa, Diabrotica virgifera; identical to SEQ ID NO: 26808
  misc_feature: Coding regions on vcDNA: vcDNA=SeqID_12344; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32648 - protein, 51 aa, Diabrotica virgifera
  misc_feature: Coding regions on vcDNA: vcDNA=SeqID_12345; Strand=-; Position=84-239
QSSRLSFLSSIIFTLPFNIISIQSSSLSYNPKHTDFLYTYQKSLPYSHYFS

SEQ ID NO: 32649 - protein, 147 aa, Diabrotica virgifera
  misc_feature: Coding regions on vcDNA: vcDNA=SeqID_12346; Strand=+; Position=3-446
  misc_feature (63)..(85): Xaa can be any naturally occurring amino acid
  misc_feature (87)..(146): Xaa can be any naturally occurring amino acid
RPSQHKHHELLQCGICVCIGRCCCSRTTFRLQLQPAQRGWRHLLRGKQPLLGVWNDFQSIKNXXXXXXXXXXXXXXXXXXXXXXXLXXXXXXXXXXXXXXXXXXXXXXXXXXXXXXXXXXXXXXXXXXXXXXXXXXXXXXXXXXXXC

SEQ ID NO: 32650 - protein, 148 aa, Diabrotica virgifera
  misc_feature: Coding regions on vcDNA: vcDNA=SeqID_12347; Strand=+; Position=210-653
  misc_feature: Homolog annotation: Hit_ID=XP_395582.1; Match level="QueryCoverage =98%, HitCoverage=33%, E-value=4e-30, Identity=47%"; Hit description =similar to CG1316-PA [Apis mellifera]
  misc_feature: Pfam annotation: Pfam_ID=RRM_1; Match level="Score=43.8, E-value=5e -10, Copies=1"; Pfam description=RNA recognition motif. (a.k.a. RRM, R
  misc_feature (4)..(4): Xaa can be any naturally occurring amino acid
MSDXPYSRLFVVGARDLREDDIKNAFNKFGDVKDVWAVKDRNSGDYRGIFYVKYYKTSHAALALEEMRGTNLGGRPLKVMIAHNREAGQGQDFKPDIEEEDLKRLFIVVSKTEGHNELHNHFKQFGTLAFDSIVHDRETIPNISFIYV

SEQ ID NO: 32651 - protein, 120 aa, Diabrotica virgifera
  misc_feature: Coding regions on vcDNA: vcDNA=SeqID_12348; Strand=+; Position=2-364
  misc_feature (71)..(71): Xaa can be any naturally occurring amino acid
  misc_feature (81)..(81): Xaa can be any naturally occurring amino acid
GKLNRSLQVSVNFPPWTIQPLTIDLTLTKYPKSTTNPIFIKHLYSEVISHYPNYLQIFSDASKAHDGHAAXTTVNKLLTLXSIPRNCYILTGETIAILEALILFKTRSENKCVIITDSLR

SEQ ID NO: 32652 - protein, 72 aa, Diabrotica virgifera
  misc_feature: Coding regions on vcDNA: vcDNA=SeqID_12349; Strand=-; Position=16-234
IERLYGFQSLSIAQYYNRYIYKKDHHVGSTRDNFHMILFIVNKRGRKEDICLILNFLMRESSTDHQILVIKL

SEQ ID NO: 32653 - protein, 210 aa, Diabrotica virgifera
  misc_feature: Coding regions on vcDNA: vcDNA=SeqID_12350; Strand=+; Position=26-656
  misc_feature: Homolog annotation: Hit_ID=NP_648446.1; Match level="QueryCoverage =85%, HitCoverage=32%, E-value=3e-46, Identity=49%"; Hit description =CG7616-PA [Drosophila melanogaster] gb|AAF50084.1| CG7616-PA [Drosophila melanogaster]
  misc_feature: Gene Ontology Annotation: Cellular component=mitochondrion; Biological process=electron transport
  misc_feature (36)..(36): Xaa can be any naturally occurring amino acid
RLRGDAVRGISPGSSSTRPGRIIALTDINTKLFEAXGYQIFQTGFVHGDPHPGNVLVRKVNGNAQLVLLDHGLYQEVSAKDRIALSHFWKAIVLRDHRNMMKYSNELGVKDYEVFAEILTQSPLKAQGFQLKVHLSEEDLQHLTEIAKNRFDTVMACLKQMPRSLLLVLRNLNTIRAIAYHHGNPINRYTTLGRTATKSFYGVQSSLLTT

SEQ ID NO: 32654 - protein, 332 aa, Diabrotica virgifera
  misc_feature: Coding regions on vcDNA: vcDNA=SeqID_12351; Strand=-; Position=1-996
  misc_feature (5)..(330): Xaa can be any naturally occurring amino acid
SKKFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLR

SEQ ID NO: 32655 - protein, 29 aa, Diabrotica virgifera
  misc_feature: Coding regions on vcDNA: vcDNA=SeqID_12352; Strand=-; Position=2-88
  misc_feature (15)..(28): Xaa can be any naturally occurring amino acid
QANEYLALGLSIDRXXXXXXXXXXXXXXN

SEQ ID NO: 32656 - protein, 138 aa, Diabrotica virgifera
  misc_feature: Coding regions on vcDNA: vcDNA=SeqID_12353; Strand=+; Position=1-414
  misc_feature (2)..(121): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNFITIHLLLKNYASKLS

SEQ ID NO: 32657 - protein, 124 aa, Diabrotica virgifera
  misc_feature: Coding regions on vcDNA: vcDNA=SeqID_12354; Strand=+; Position=1-375
LQSVGKCLNYISDQNMVLGKIIIRVVFAICLLLLIVTDYSGILHKLIGGNRSDDHHVSPRPTNPGYGDSKTDIDIDADIEEESVKHLGSQTTKSKIVKTIKKACLPKLICELTASTQRDKVTDS

SEQ ID NO: 32658 - protein, 234 aa, Diabrotica virgifera
  misc_feature: Coding regions on vcDNA: vcDNA=SeqID_12355; Strand=+; Position=109-812
  misc_feature: Homolog annotation: Hit_ID=BAA07210.1; Match level="QueryCoverage =96%, HitCoverage=89%, E-value=8e-82, Identity=61%"; Hit description =Bmsqd-1 [Bombyx mori]
  misc_feature: Gene Ontology Annotation: Molecular function=RNA binding; Cellular component=nuclear speck; Biological process=RNA catabolism
  misc_feature: Pfam annotation: Pfam_ID=RRM_1; Match level="Score=129.5, E-value =8.2e-36, Copies=2"; Pfam description=RNA recognition motif. (a.k.a. RRM, R
  misc_feature (75)..(82): Xaa can be any naturally occurring amino acid
  misc_feature (101)..(107): Xaa can be any naturally occurring amino acid
  misc_feature (179)..(179): Xaa can be any naturally occurring amino acid
MENGEEHQNGSGDAPADSGSAETPGRDDDRKLFVGGMSWETTDRELREHFGQYGEIESINVKTDPNTGRSRGFAXXXXXXXXAIDKVVAAGDHVINGKKVXXXXXXXRHGKIFVGGLTSELSDDDIKNYFSQFGSIIDIEMPFDKQKNQRKGFCFITFESEQVVNELLKQPKQTIKDKXGRGGYGNQGNWNQAYGGYGYGQGYGYDGYSQGYDYYGYDGYGGFLGGYDYSNWRR

SEQ ID NO: 32659 - protein, 111 aa, Diabrotica virgifera
  misc_feature: Coding regions on vcDNA: vcDNA=SeqID_12356; Strand=+; Position=1-336
  misc_feature: Homolog annotation: Hit_ID=XP_319444.1; Match level="QueryCoverage =98%, HitCoverage=37%, E-value=3e-18, Identity=46%"; Hit description =ENSANGP00000014428 [Anopheles gambiae]
  misc_feature: Gene Ontology Annotation: Molecular function=RNA binding; Cellular component=nucleus; Biological process=proteolysis and peptidolysis
EKHLDELPSSSLEELIKHGLRALRDTLPPEVDLTTKNVSIGYTGKGQTFKILEEEETSPYLSLIEGEERRGGGAAAAAIEDLPADPLRDDAGDEPRDAVPAVETSAMDTTE

SEQ ID NO: 32660 - protein, 50 aa, Diabrotica virgifera
  misc_feature: Coding regions on vcDNA: vcDNA=SeqID_12357; Strand=+; Position=3-152
  misc_feature (4)..(32): Xaa can be any naturally occurring amino acid
  misc_feature (40)..(46): Xaa can be any naturally occurring amino acid
MKGXXXXXXXXXXXXXXXXXXXXXXXXXXXXXKKTPKIVXXXXXXXGFSS

SEQ ID NO: 32661 - protein, 257 aa, Diabrotica virgifera
  misc_feature: Coding regions on vcDNA: vcDNA=SeqID_12358; Strand=+; Position=41-814
ICSVFIFNNLRYYWIVFNLINLKPPKVCPLCYHSFVLMKRTHDDILHSSSAEKVHENCHLCGNSEDVINVSKWAHFKAIGKDFPGSNGENISNVCSDCLYYLETKSTVKEKLISEYPILKQESIISQFDVLGNSTPTRRTRTKAERKSPIDIVDLTVAEPVATPTDNMKFRPLKTDRHLRRSRAVNTDPKLLNQVLIIKLPNQSLKEEATKSAPKRKSLTPKRVRFRDEHEHIIDKYNSPSLYTDKENAYKETERIG

SEQ ID NO: 32662 - protein, 216 aa, Diabrotica virgifera
  misc_feature: Coding regions on vcDNA: vcDNA=SeqID_12359; Strand=+; Position=251-901
  misc_feature: Homolog annotation: Hit_ID=XP_534585.1; Match level="QueryCoverage =82%, HitCoverage=63%, E-value=7e-40, Identity=43%"; Hit description =PREDICTED: similar to hypothetical protein FLJ32191 [Canis familiaris]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=93.0, E-value =7.8e-25, Copies=4"; Pfam description=Zinc finger, C2H2 type
  misc_feature (35)..(42): Xaa can be any naturally occurring amino acid
  misc_feature (162)..(162): Xaa can be any naturally occurring amino acid
  misc_feature (167)..(180): Xaa can be any naturally occurring amino acid
  misc_feature (198)..(198): Xaa can be any naturally occurring amino acid
  misc_feature (202)..(210): Xaa can be any naturally occurring amino acid
MDIMKTPNEDSSHEENDMNPQVEGKVTHNGKKSQXXXXXXXXFIKPSHLKIHLRVHTGEKPYKCELCYKQFSASSGLKVHFRRHTGEKPHKCKICFKQWSTSSHLKRHLRVHTGEKAHKCEVCFKQFSEADNLKTHLRLHTGEKPYKCEICFEQFSTADTLXKHLRXXXXXXXXXXXXXXKQFIQAGAYNKHMKSHTXEKTXXXXXXXXXSLEQKV

SEQ ID NO: 32663 - protein, 118 aa, Diabrotica virgifera
  misc_feature: Coding regions on vcDNA: vcDNA=SeqID_12360; Strand=-; Position=3-359
  misc_feature (2)..(23): Xaa can be any naturally occurring amino acid
  misc_feature (83)..(92): Xaa can be any naturally occurring amino acid
  misc_feature (96)..(116): Xaa can be any naturally occurring amino acid
YXXXXXXXXXXXXXXXXXXXXXXVQIENIDNNLYDGITLKFCVTAILLCQFDFFNFSKFEYNPVRARLVLFLNLLIQFSTKGXXXXXXXXXXVKYXXXXXXXXXXXXXXXXXXXXXDA

SEQ ID NO: 32664 - protein, 235 aa, Diabrotica virgifera
  misc_feature: Coding regions on vcDNA: vcDNA=SeqID_12361; Strand=-; Position=1-705
  misc_feature (1)..(33): Xaa can be any naturally occurring amino acid
  misc_feature (36)..(172): Xaa can be any naturally occurring amino acid
  misc_feature (175)..(213): Xaa can be any naturally occurring amino acid
  misc_feature (215)..(235): Xaa can be any naturally occurring amino acid
XXXXXXXXXXXXXXXXXXXXXXXXXXXXXXXXXGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXGXXXXXXXXXXXXXXXXXXXXX

SEQ ID NO: 32665 - protein, 42 aa, Diabrotica virgifera
  misc_feature: Coding regions on vcDNA: vcDNA=SeqID_12362; Strand=-; Position=0-125
  misc_feature (2)..(2): Xaa can be any naturally occurring amino acid
  misc_feature (6)..(38): Xaa can be any naturally occurring amino acid
IXLSTXXXXXXXXXXXXXXXXXXXXXXXXXXXXXXXXXKLLT

SEQ ID NO: 32666 - protein, 105 aa, Diabrotica virgifera
  misc_feature: Coding regions on vcDNA: vcDNA=SeqID_12363; Strand=-; Position=366-683
LPFNKCIKHNVSSHVGTYVRQNRANNNIRIIMHLMVEAYNLDHTYYTYKDSNLDMRPAQILSFTKKAGIQNGDCTSTVYVTNSMITFERQVRFQPNLVYKFFFYV

SEQ ID NO: 32667 - protein, 57 aa, Diabrotica virgifera; identical to SEQ ID NO: 32497
  misc_feature: Coding regions on vcDNA: vcDNA=SeqID_12364; Strand=-; Position=159-332
  misc_feature (1)..(12): Xaa can be any naturally occurring amino acid
  misc_feature (14)..(38): Xaa can be any naturally occurring amino acid

SEQ ID NO: 32668 - protein, 105 aa, Diabrotica virgifera
  misc_feature: Coding regions on vcDNA: vcDNA=SeqID_12365; Strand=+; Position=216-533
  misc_feature: Homolog annotation: Hit_ID=CAG10932.1; Match level="QueryCoverage =88%, HitCoverage=82%, E-value=5e-12, Identity=37%"; Hit description =unnamed protein product [Tetraodon nigroviridis]
  misc_feature: Pfam annotation: Pfam_ID=Rpr2; Match level="Score=57.5, E-value=3.8e -14, Copies=1"; Pfam description=RNAse P Rpr2/Rpp21 subunit domain
MSLNTFKKCTQKEGMQRMNYLYQICNLMITENRTNNAAAAAYSNLLNNISRKTVQRLEIDMKRTICKACVCLLIVGVTAKIAIKKKKRILTCLRCNHSKIYIINK

SEQ ID NO: 32669 - protein, 66 aa, Diabrotica virgifera; identical to SEQ ID NO: 26808
  misc_feature: Coding regions on vcDNA: vcDNA=SeqID_12366; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32670 - protein, 50 aa, Diabrotica virgifera
  misc_feature: Coding regions on vcDNA: vcDNA=SeqID_12367; Strand=-; Position=2-151
  misc_feature (3)..(50): Xaa can be any naturally occurring amino acid
LIXXXXXXXXXXXXXXXXXXXXXXXXXXXXXXXXXXXXXXXXXXXXXXXX

SEQ ID NO: 32671 - protein, 141 aa, Diabrotica virgifera
  misc_feature: Coding regions on vcDNA: vcDNA=SeqID_12368; Strand=+; Position=3-428
  misc_feature (7)..(93): Xaa can be any naturally occurring amino acid
  misc_feature (96)..(124): Xaa can be any naturally occurring amino acid
  misc_feature (127)..(134): Xaa can be any naturally occurring amino acid
LPTRPTXXXXXXXXXXXXXXXXXXXXXXXXXXXXXXXXXXXXXXXXXXXXXXXXXXXXXXXXXXXXXXXXXXXXXXXXXXXXXXXXXXXXXXXLFXXXXXXXXXXXXXXXXXXXXXXXXXXXXXLIXXXXXXXXILLEFNF

SEQ ID NO: 32672 - protein, 77 aa, Diabrotica virgifera
  misc_feature: Coding regions on vcDNA: vcDNA=SeqID_12369; Strand=+; Position=469-701
  misc_feature (29)..(29): Xaa can be any naturally occurring amino acid
  misc_feature (54)..(54): Xaa can be any naturally occurring amino acid
SDLANITDTGKEMTNLNFLIHLLTIAKSXTELILSIADSVDTYQNITDMIGQIXAELYSNFYVADKDIVTSKHNENE

SEQ ID NO: 32673 - protein, 83 aa, Diabrotica virgifera
  misc_feature: Coding regions on vcDNA: vcDNA=SeqID_12370; Strand=-; Position=332-583
LVLFNISYIRSNKLHAVVSDGSFGLNLCCIGVNKMYSCINFNILVYSTLFYYFGNFDKDRYWYIISNIMRVIISEDGNRLISF

SEQ ID NO: 32674 - protein, 26 aa, Diabrotica virgifera
  misc_feature: Coding regions on vcDNA: vcDNA=SeqID_12371; Strand=-; Position=1-78
  misc_feature (4)..(4): Xaa can be any naturally occurring amino acid
  misc_feature (12)..(12): Xaa can be any naturally occurring amino acid
  misc_feature (17)..(24): Xaa can be any naturally occurring amino acid
SIDXSNKKYAVXPKVIXXXXXXXXIK

SEQ ID NO: 32675 - protein, 31 aa, Diabrotica virgifera
  misc_feature: Coding regions on vcDNA: vcDNA=SeqID_12372; Strand=-; Position=2-94
  misc_feature (17)..(30): Xaa can be any naturally occurring amino acid
IIYLLPQYKLNPTSRSXXXXXXXXXXXXXXV

SEQ ID NO: 32676 - protein, 44 aa, Diabrotica virgifera
  misc_feature: Coding regions on vcDNA: vcDNA=SeqID_12373; Strand=-; Position=0-131
SSFDVSSSVHFNKISFNNCIKHNTSTHLDRTKSAMVPNDLSLSP

SEQ ID NO: 32677 - protein, 22 aa, Diabrotica virgifera
  misc_feature: Coding regions on vcDNA: vcDNA=SeqID_12374; Strand=-; Position=1-66
  misc_feature (1)..(22): Xaa can be any naturally occurring amino acid
XXXXXXXXXXXXXXXXXXXXXX

SEQ ID NO: 32678 - protein, 29 aa, Diabrotica virgifera
  misc_feature: Coding regions on vcDNA: vcDNA=SeqID_12375; Strand=-; Position=1-87
  misc_feature (2)..(12): Xaa can be any naturally occurring amino acid
FXXXXXXXXXXXNQPGSHRFKLRSCGRVE

SEQ ID NO: 32679 - protein, 269 aa, Diabrotica virgifera
  misc_feature: Coding regions on vcDNA: vcDNA=SeqID_12376; Strand=+; Position=27-832
  misc_feature: Homolog annotation: Hit_ID=XP_393523.1; Match level="QueryCoverage =99%, HitCoverage=53%, E-value=1e-121, Identity=44%"; Hit description= similar to ENSANGP00000019179 [Apis mellifera]
  misc_feature: Gene Ontology Annotation: Molecular function=structural constituent of bone; Cellular component=collagen type I; Biological process =epidermal differentiation
  misc_feature: Pfam annotation: Pfam_ID=Collagen; Match level="Score=158.1, E-value =2e-44, Copies=3"; Pfam description=Collagen triple helix repeat (20 copi
  misc_feature (1)..(1): Xaa can be any naturally occurring amino acid
  misc_feature (260)..(260): Xaa can be any naturally occurring amino acid
XPGIPGAPGPPGPLPDLSAFYQQLSQSQGGDKGPNYPEPFQYLQAQVGPVGSRGPPGPPGPVGPQGFQGLRGEIGEPGPAGPPGPAGPRGLTGSPGKDGERGDDGEAGAAGATGPPGSRGIPGMPGLPGVKGHRGFPGLDGSKGDQGSTGEKGSQGVSGPMGQTGSQGPAGPRGERGREGPPGPPGIRGIDGIAGPPGMPGSIGKPGAPGFPGNPGAKGDQGASGPKGSQGYQGSRGESGRPGSPGESGPPGPAGKDGYXGEKGYTGAP

SEQ ID NO: 32680 - protein, 78 aa, Diabrotica virgifera
  misc_feature: Coding regions on vcDNA: vcDNA=SeqID_12377; Strand=-; Position=301-537
  misc_feature (8)..(14): Xaa can be any naturally occurring amino acid
  misc_feature (59)..(68): Xaa can be any naturally occurring amino acid
MFYQLLQXXXXXXXPPPRWGNHSHGESAFRHHIDFDPTIHFGSWTIYLVRIANIQTKKXXXXXXXXXXHTVETTQFYL

SEQ ID NO: 32681 - protein, 47 aa, Diabrotica virgifera; identical to SEQ ID NO: 26759
  misc_feature: Coding regions on vcDNA: vcDNA=SeqID_12378; Strand=+; Position=3-146
  misc_feature (1)..(15): Xaa can be any naturally occurring amino acid
  misc_feature (17)..(24): Xaa can be any naturally occurring amino acid

SEQ ID NO: 32682 - protein, 161 aa, Diabrotica virgifera
  misc_feature: Coding regions on vcDNA: vcDNA=SeqID_12379; Strand=+; Position=3-488
  misc_feature (81)..(88): Xaa can be any naturally occurring amino acid
  misc_feature (139)..(143): Xaa can be any naturally occurring amino acid
TRYRWHSICSNKVSITTLNATTEGKPNISNGMPFPMMNIICVTHSISIYGHYGSLAHYITFNMNPLYIIFLSIIAKTYIFXXXXXXXXFSFSLCRGYLPFLCKGTPILEPYFSRTDTVYYHCFIMSLFSIRRIGRNTDXXXXXFNRSVIHTKNLYLQEFCL

SEQ ID NO: 32683 - protein, 112 aa, Diabrotica virgifera
  misc_feature: Coding regions on vcDNA: vcDNA=SeqID_12380; Strand=-; Position=0-335
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(111): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXG

SEQ ID NO: 32684 - protein, 38 aa, Diabrotica virgifera
  misc_feature: Coding regions on vcDNA: vcDNA=SeqID_12381; Strand=-; Position=1-114
  misc_feature (2)..(15): Xaa can be any naturally occurring amino acid
  misc_feature (17)..(38): Xaa can be any naturally occurring amino acid
PXXXXXXXXXXXXXXNXXXXXXXXXXXXXXXXXXXXXX

SEQ ID NO: 32685 - protein, 179 aa, Diabrotica virgifera
  misc_feature: Coding regions on vcDNA: vcDNA=SeqID_12382; Strand=+; Position=363-901
  misc_feature: Homolog annotation: Hit_ID=EAA14842.2; Match level="QueryCoverage =98%, HitCoverage=55%, E-value=4e-60, Identity=61%"; Hit description =ENSANGP00000006521 [Anopheles gambiae str. PEST] ref|XP_552905.1| ENSANGP00000006521 [Anopheles gambiae st
  misc_feature: Gene Ontology Annotation: Molecular function=zinc porter activity; Cellular component=integral to membrane; Biological process=transport
  misc_feature: Pfam annotation: Pfam_ID=Cation_efflux; Match level="Score=-14.6, E -value=5.5e-08, Copies=1"; Pfam description=Cation efflux family
  misc_feature (109)..(109): Xaa can be any naturally occurring amino acid
  misc_feature (141)..(141): Xaa can be any naturally occurring amino acid
  misc_feature (143)..(143): Xaa can be any naturally occurring amino acid
MASILCVIFMLGEIVGGYLSNSLAIASDAAHLLTDFASFMISLFSLYMANRPSTKKMLFGWYRAEVIGALTSVLLIWVVTGILVYMAVQRIIYKTYEVDSKVMLITSGXGVIVNIIMGITLHQHGHTHSGSDGEHGHAHGXEXKEENINVRAAFIHVLGDFLQSFGVFVAAIVIYFKQI

SEQ ID NO: 32686 - protein, 217 aa, Diabrotica virgifera
  misc_feature: Coding regions on vcDNA: vcDNA=SeqID_12383; Strand=-; Position=2-652
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(213): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRR

SEQ ID NO: 32687 - protein, 97 aa, Diabrotica virgifera
  misc_feature: Coding regions on vcDNA: vcDNA=SeqID_12384; Strand=-; Position=3-293
  misc_feature (6)..(32): Xaa can be any naturally occurring amino acid
  misc_feature (34)..(44): Xaa can be any naturally occurring amino acid
  misc_feature (54)..(62): Xaa can be any naturally occurring amino acid
  misc_feature (64)..(77): Xaa can be any naturally occurring amino acid
  misc_feature (84)..(96): Xaa can be any naturally occurring amino acid
FSLEIXXXXXXXXXXXXXXXXXXXXXXXXXXXFXXXXXXXXXXXNQPGSHRFKXXXXXXXXXEXXXXXXXXXXXXXXSNIEVAXXXXXXXXXXXXXC

SEQ ID NO: 32688 - protein, 75 aa, Diabrotica virgifera
  misc_feature: Coding regions on vcDNA: vcDNA=SeqID_12385; Strand=-; Position=168-395
SDLHLYCSLAAPASTSVVTSCLQIAGICRYILSRILSCGVRTCDLFLIGDLVVSLAPSTTILLQVNIRVLRQYYF

SEQ ID NO: 32689 - protein, 44 aa, Diabrotica virgifera
  misc_feature: Coding regions on vcDNA: vcDNA=SeqID_12386; Strand=+; Position=94-225
LLLLIDTYYAPSVSGMIDEYRYDDHHVTPRTSNPGYGDAKTEIY

SEQ ID NO: 32690 - protein, 82 aa, Diabrotica virgifera
  misc_feature: Coding regions on vcDNA: vcDNA=SeqID_12387; Strand=-; Position=530-778
  misc_feature (47)..(77): Xaa can be any naturally occurring amino acid
TYRPTSTLSQEHRGGIELDRPCELSPPVGRPTTRQLTPRTMNQRRGXXXXXXXXXXXXXXXXXXXXXXXXXXXXXXXPIDPR

SEQ ID NO: 32691 - protein, 312 aa, Diabrotica virgifera
  misc_feature: Coding regions on vcDNA: vcDNA=SeqID_12388; Strand=-; Position=1-936
  misc_feature (1)..(83): Xaa can be any naturally occurring amino acid
  misc_feature (85)..(312): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32692 - protein, 65 aa, Diabrotica virgifera
  misc_feature: Coding regions on vcDNA: vcDNA=SeqID_12389; Strand=+; Position=109-306
  misc_feature (37)..(47): Xaa can be any naturally occurring amino acid
IIEDLVCLPRLIYENQVNNLITGLLRTRVDASTASVXXXXXXXXXXXFMSVLRKYIRYFFYCKLY

SEQ ID NO: 32693 - protein, 148 aa, Diabrotica virgifera
  misc_feature: Coding regions on vcDNA: vcDNA=SeqID_12390; Strand=-; Position=1-444
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(148): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32694 - protein, 105 aa, Diabrotica virgifera
  misc_feature: Coding regions on vcDNA: vcDNA=SeqID_12391; Strand=-; Position=250-567
  misc_feature (3)..(10): Xaa can be any naturally occurring amino acid
  misc_feature (16)..(42): Xaa can be any naturally occurring amino acid
  misc_feature (46)..(89): Xaa can be any naturally occurring amino acid
  misc_feature (91)..(100): Xaa can be any naturally occurring amino acid
IIXXXXXXXXSNQIFXXXXXXXXXXXXXXXXXXXXXXXXXXXKNPXXXXXXXXXXXXXXXXXXXXXXXXXXXXXXXXXXXXXXXXXXXXIXXXXXXXXXXLIITP

SEQ ID NO: 32695 - protein, 81 aa, Diabrotica virgifera
  misc_feature: Coding regions on vcDNA: vcDNA=SeqID_12392; Strand=-; Position=454-699
  misc_feature (38)..(44): Xaa can be any naturally occurring amino acid
KANFLVIVILFYILQNFLLFLLLNIFKNMICAIRLTNXXXXXXXSFSASDSNLNTRHFYRTDYSIYVFYGSVLSVNRKPND

SEQ ID NO: 32696 - protein, 127 aa, Diabrotica virgifera
  misc_feature: Coding regions on vcDNA: vcDNA=SeqID_12393; Strand=-; Position=0-380
  misc_feature (39)..(48): Xaa can be any naturally occurring amino acid
  misc_feature (53)..(122): Xaa can be any naturally occurring amino acid
RPRDGLARVRILKKKTRQSRFFLSLIRTIYSKSDVIKSXXXXXXXXXXVNLIXXXXXXXXXXXXXXXXXXXXXXXXXXXXXXXXXXXXXXXXXXXXXXXXXXXXXXXXXXXXXXXXXXXXXXGRLYG

SEQ ID NO: 32697 - protein, 80 aa, Diabrotica virgifera
  misc_feature: Coding regions on vcDNA: vcDNA=SeqID_12394; Strand=-; Position=2-241
  misc_feature (1)..(8): Xaa can be any naturally occurring amino acid
  misc_feature (30)..(42): Xaa can be any naturally occurring amino acid
  misc_feature (45)..(79): Xaa can be any naturally occurring amino acid
XXXXXXXXSNRLNYIAATPIINLIPHRGSXXXXXXXXXXXXXAVXXXXXXXXXXXXXXXXXXXXXXXXXXXXXXXXXXXQ

SEQ ID NO: 32698 - protein, 409 aa, Diabrotica virgifera
  misc_feature: Coding regions on vcDNA: vcDNA=SeqID_12395; Strand=-; Position=1-1227
  misc_feature (1)..(9): Xaa can be any naturally occurring amino acid
  misc_feature (11)..(85): Xaa can be any naturally occurring amino acid
  misc_feature (92)..(139): Xaa can be any naturally occurring amino acid
  misc_feature (143)..(157): Xaa can be any naturally occurring amino acid
  misc_feature (169)..(202): Xaa can be any naturally occurring amino acid
  misc_feature (212)..(226): Xaa can be any naturally occurring amino acid
  misc_feature (231)..(287): Xaa can be any naturally occurring amino acid
  misc_feature (290)..(305): Xaa can be any naturally occurring amino acid
  misc_feature (309)..(409): Xaa can be any naturally occurring amino acid
XXXXXXXXXVXXXXXXXXXXXXXXXXXXXXXXXXXXXXXXXXXXXXXXXXXXXXXXXXXXXXXXXXXXXXXXXXXXXXXXXXXXXPLLGWGXXXXXXXXXXXXXXXXXXXXXXXXXXXXXXXXXXXXXXXXXXXXXXXXSPPXXXXXXXXXXXXXXXFGAGKKNPPRPXXXXXXXXXXXXXXXXXXXXXXXXXXXXXXXXXXGGKSPLLKTXXXXXXXXXXXXXXXNFPPXXXXXXXXXXXXXXXXXXXXXXXXXXXXXXXXXXXXXXXXXXXXXXXXXXXXXXXXXNPXXXXXXXXXXXXXXXXLLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32699 - protein, 71 aa, Diabrotica virgifera
  misc_feature: Coding regions on vcDNA: vcDNA=SeqID_12396; Strand=+; Position=578-793
  misc_feature (5)..(5): Xaa can be any naturally occurring amino acid
  misc_feature (31)..(31): Xaa can be any naturally occurring amino acid
NPPVXNTNIIFRHSRKNIWFTICFSQIYLIXLILQLNIIFLQSLDKEDFFAWSLQRKVDVYRVPTLYRSSA

SEQ ID NO: 32700 - protein, 318 aa, Diabrotica virgifera
  misc_feature: Coding regions on vcDNA: vcDNA=SeqID_12397; Strand=+; Position=2-956
  misc_feature: Homolog annotation: Hit_ID=NP_055023.1; Match level="QueryCoverage =99%, HitCoverage=62%, E-value=5e-20, Identity=22%"; Hit description =dentin sialophosphoprotein preproprotein [Homo sapiens] sp|Q9NZW4|DSPP_HUMAN Dentin
  misc_feature: Gene Ontology Annotation: Molecular function=chaperone activity; Cellular component=extracellular space; Biological process=protein folding
  misc_feature (217)..(217): Xaa can be any naturally occurring amino acid
  misc_feature (301)..(301): Xaa can be any naturally occurring amino acid
  misc_feature (309)..(309): Xaa can be any naturally occurring amino acid
INVAEHCESSSEKNSSTNNLKSGKKADTEELSHVHEETDNISKSKSNDQDDSINSGDNNDEESINIIELDSTIEHDQTIESSSQKSVEYTKLDKNNTDVINHSESSTEKKSLTKNLKPGKNADTEELINVHEETDKISKTKSNDQDDSINSEDNNDEESSNISELELTFEIDKTIESSTQKSPEHTESDNINHIDVTNLCESSSEKNSSTNNLKSGXNADTQEFSNVDEENDMNSTNINNTKKFPTDALTQKRKNDEKSNDFDEESNKSGITNNEKQLSGLEDKSDRPIDTQDQHNTVTIXLSSSQTMXESPSSKSQK

SEQ ID NO: 32701 - protein, 93 aa, Diabrotica virgifera
  misc_feature: Coding regions on vcDNA: vcDNA=SeqID_12398; Strand=+; Position=12-293
GEKLTEIEIHTEISKSVIFTSNGSSFNPKLYKSVEMAASSFAVSGSRRVSIVLSENKRKVKLFEMEAEEEDDEEADASSSMLKDDSVQENVAE

SEQ ID NO: 32702 - protein, 44 aa, Diabrotica virgifera; identical to SEQ ID NO: 32266
  misc_feature: Coding regions on vcDNA: vcDNA=SeqID_12399; Strand=-; Position=1-132
  misc_feature (3)..(13): Xaa can be any naturally occurring amino acid
  misc_feature (23)..(30): Xaa can be any naturally occurring amino acid

SEQ ID NO: 32703 - protein, 22 aa, Diabrotica virgifera
  misc_feature: Coding regions on vcDNA: vcDNA=SeqID_12400; Strand=-; Position=0-65
  misc_feature (1)..(20): Xaa can be any naturally occurring amino acid
XXXXXXXXXXXXXXXXXXXXPP

SEQ ID NO: 32704 - protein, 80 aa, Diabrotica virgifera
  misc_feature: Coding regions on vcDNA: vcDNA=SeqID_12401; Strand=-; Position=591-833
YALHLLQYTPLSSAVCIVYWCVVCAKSKLQYTKLYNPSYVEWIIINLLFLSGVCRGCKLLFVCVNTSYYFLYDGHYFQYC

SEQ ID NO: 32705 - protein, 245 aa, Diabrotica virgifera
  misc_feature: Coding regions on vcDNA: vcDNA=SeqID_12402; Strand=+; Position=43-780
  misc_feature: Homolog annotation: Hit_ID=XP_394962.1; Match level="QueryCoverage =80%, HitCoverage=37%, E-value=9e-40, Identity=41%"; Hit description =similar to ENSANGP00000003484 [Apis mellifera]
  misc_feature: Gene Ontology Annotation: Cellular component=transcription factor complex; Biological process=regulation of transcription, DNA -dependent
  misc_feature (136)..(136): Xaa can be any naturally occurring amino acid
  misc_feature (198)..(198): Xaa can be any naturally occurring amino acid
MFKMFEPKKKDNPSSKQLSYIVSFTDPNLEIPQGPKEPIFKIVQERCLEEIYEKIKQLFDERPMWTKAAIQHKIGFTNEMSKILLPANAYLWSTGPWRMIWTRLGYDPRVDLSSRIYQILDFRIRESEGTKIMVRXKRAAYRKDILHPKMDESHYILRPDTIPPARQMFYQFFDVLLPEIQEMMQRLPKAQAKLDVKXGWLPVNFLDQCREIANKYVMKNTPAVGRLQLKNRTRTTGQRRIRRRR

SEQ ID NO: 32706 - protein, 77 aa, Diabrotica virgifera
  misc_feature: Coding regions on vcDNA: vcDNA=SeqID_12403; Strand=-; Position=2-232
  misc_feature (2)..(11): Xaa can be any naturally occurring amino acid
  misc_feature (14)..(24): Xaa can be any naturally occurring amino acid
  misc_feature (34)..(41): Xaa can be any naturally occurring amino acid
  misc_feature (44)..(51): Xaa can be any naturally occurring amino acid
  misc_feature (56)..(56): Xaa can be any naturally occurring amino acid
  misc_feature (63)..(76): Xaa can be any naturally occurring amino acid
IXXXXXXXXXXPFXXXXXXXXXXXTNLAHTGLNXXXXXXXXSNXXXXXXXXPIINXNPTSRSXXXXXXXXXXXXXXV

SEQ ID NO: 32707 - protein, 57 aa, Diabrotica virgifera
  misc_feature: Coding regions on vcDNA: vcDNA=SeqID_12404; Strand=-; Position=2-172
  misc_feature (10)..(17): Xaa can be any naturally occurring amino acid
  misc_feature (21)..(43): Xaa can be any naturally occurring amino acid
  misc_feature (47)..(57): Xaa can be any naturally occurring amino acid
KFTLVFPLRXXXXXXXXKRIXXXXXXXXXXXXXXXXXXXXXXXPDEXXXXXXXXXXX

SEQ ID NO: 32708 - protein, 214 aa, Diabrotica virgifera
  misc_feature: Coding regions on vcDNA: vcDNA=SeqID_12405; Strand=+; Position=134-778
  misc_feature: Homolog annotation: Hit_ID=XP_396952.1; Match level="QueryCoverage =88%, HitCoverage=31%, E-value=1e-25, Identity=35%"; Hit description =similar to ENSANGP00000012864 [Apis mellifera]
MGSSMSNDKVQPSGVNKFKDFQKSESEDSEQYKSKNRSSTDVCFLIVFVVFLTALICFLAYCFFNGDIFRTINGYDDCGNICGRNNKNLKRLDNKNNSLQCLGTSKINEPYHIVLRKGSAKEFNRLCISDCSLYEGYRKFFNRCMPNKSQTVVNTIFSRTGLSNFFTEVSEDFQICWTEICYLCLIALVLSSLLLVLFRYLVGVVVWITLLRVI

SEQ ID NO: 32709 - protein, 309 aa, Diabrotica virgifera
  misc_feature: Coding regions on vcDNA: vcDNA=SeqID_12406; Strand=-; Position=1-927
  misc_feature (2)..(309): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32710 - protein, 295 aa, Diabrotica virgifera
  misc_feature: Coding regions on vcDNA: vcDNA=SeqID_12407; Strand=+; Position=1-885
  misc_feature (1)..(269): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTPYRVLLKFIPHFFFITPLIPPPPP

SEQ ID NO: 32711 - protein, 28 aa, Diabrotica virgifera
  misc_feature: Coding regions on vcDNA: vcDNA=SeqID_12408; Strand=-; Position=1-84
  misc_feature (2)..(9): Xaa can be any naturally occurring amino acid
  misc_feature (18)..(28): Xaa can be any naturally occurring amino acid
KXXXXXXXXPPIKIKWVXXXXXXXXXXX

SEQ ID NO: 32712 - protein, 94 aa, Diabrotica virgifera
  misc_feature: Coding regions on vcDNA: vcDNA=SeqID_12409; Strand=+; Position=68-349
  misc_feature (1)..(20): Xaa can be any naturally occurring amino acid
  misc_feature (24)..(37): Xaa can be any naturally occurring amino acid
  misc_feature (85)..(94): Xaa can be any naturally occurring amino acid
XXXXXXXXXXXXXXXXXXXXESGXXXXXXXXXXXXXXEELNKYKFYCKIHILKTFFVKECNSISNITIPTGIRLDLLHHEYIYRXXXXXXXXXX

SEQ ID NO: 32713 - protein, 178 aa, Diabrotica virgifera
  misc_feature: Coding regions on vcDNA: vcDNA=SeqID_12410; Strand=+; Position=550 -1083
  misc_feature (84)..(93): Xaa can be any naturally occurring amino acid
  misc_feature (122)..(132): Xaa can be any naturally occurring amino acid
  misc_feature (137)..(144): Xaa can be any naturally occurring amino acid
  misc_feature (153)..(163): Xaa can be any naturally occurring amino acid
HKYASPPKYFPPPLFSNHRSSINLSFFLFRLTPPLPALKRHALPHTNNLTTHNFSDSPYFIYDFFILPHYRLPRPPPRPYSSVXXXXXXXXXXHELPLSSLFPSFPSPLFLPLLLVSACSLXXXXXXXXXXXPSPHXXXXXXXXSTYAFFFLXXXXXXXXXXXVTFSRLIAPSSLFPS

SEQ ID NO: 32714 - protein, 146 aa, Diabrotica virgifera
  misc_feature: Coding regions on vcDNA: vcDNA=SeqID_12411; Strand=+; Position=324-761
  misc_feature: Homolog annotation: Hit_ID=XP_394336.1; Match level="QueryCoverage =80%, HitCoverage=29%, E-value=4e-30, Identity=55%"; Hit description =similar to CG5582-PA [Apis mellifera]
  misc_feature: Gene Ontology Annotation: Molecular function=chaperone activity; Cellular component=mitochondrion; Biological process=protein folding
MSYNYESCAAIVPPETGKGTPTTFNKNRRIRALTAYWILGLCNNYGYVVMLTAANEIVNKETGGDTPPKEETTARDCTYLSTGAILLADILPGLIIKVIAPFLPFFVHLRVAICVVLAASGFLCVAYSETLVIALLGVVIDSLASA

SEQ ID NO: 32715 - protein, 123 aa, Diabrotica virgifera
  misc_feature: Coding regions on vcDNA: vcDNA=SeqID_12412; Strand=-; Position=57-428
  misc_feature (1)..(7): Xaa can be any naturally occurring amino acid
  misc_feature (14)..(14): Xaa can be any naturally occurring amino acid
  misc_feature (20)..(21): Xaa can be any naturally occurring amino acid
  misc_feature (24)..(24): Xaa can be any naturally occurring amino acid
  misc_feature (27)..(27): Xaa can be any naturally occurring amino acid
  misc_feature (30)..(31): Xaa can be any naturally occurring amino acid
  misc_feature (35)..(35): Xaa can be any naturally occurring amino acid
  misc_feature (43)..(44): Xaa can be any naturally occurring amino acid
  misc_feature (48)..(51): Xaa can be any naturally occurring amino acid
  misc_feature (53)..(53): Xaa can be any naturally occurring amino acid
  misc_feature (56)..(56): Xaa can be any naturally occurring amino acid
  misc_feature (61)..(64): Xaa can be any naturally occurring amino acid
  misc_feature (69)..(70): Xaa can be any naturally occurring amino acid
  misc_feature (72)..(72): Xaa can be any naturally occurring amino acid
  misc_feature (75)..(75): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(87): Xaa can be any naturally occurring amino acid
  misc_feature (91)..(91): Xaa can be any naturally occurring amino acid
  misc_feature (94)..(95): Xaa can be any naturally occurring amino acid
  misc_feature (97)..(98): Xaa can be any naturally occurring amino acid
  misc_feature (102)..(102): Xaa can be any naturally occurring amino acid
  misc_feature (113)..(113): Xaa can be any naturally occurring amino acid
  misc_feature (117)..(119): Xaa can be any naturally occurring amino acid
  misc_feature (121)..(123): Xaa can be any naturally occurring amino acid
XXXXXXXLPKSSKXNFHPTXXFSXSNXSIXXSIPXLSSSSSFXXFLIXXXXTXPSXFSIIXXXXPFPPXXNXINXIXSLXLKSTXXXTPLXFNXXLXXTSTXKHINIINHFLXNTIXXXSXXX

SEQ ID NO: 32716 - protein, 17 aa, Diabrotica virgifera
  misc_feature: Coding regions on vcDNA: vcDNA=SeqID_12413; Strand=-; Position=1-51
FFSLKSRKSEAILATPH

SEQ ID NO: 32717 - protein, 235 aa, Diabrotica virgifera
  misc_feature: Coding regions on vcDNA: vcDNA=SeqID_12414; Strand=+; Position=1-705
  misc_feature (7)..(8): Xaa can be any naturally occurring amino acid
  misc_feature (14)..(159): Xaa can be any naturally occurring amino acid
  misc_feature (179)..(198): Xaa can be any naturally occurring amino acid
  misc_feature (206)..(226): Xaa can be any naturally occurring amino acid
  misc_feature (229)..(235): Xaa can be any naturally occurring amino acid
SRRPIFXXLCMRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLKKEIRKNFFSPGLIKNRXXXXXXXXXXXXXXXXXXXXAPGFFSPXXXXXXXXXXXXXXXXXXXXXWLXXXXXXX

SEQ ID NO: 32718 - protein, 44 aa, Diabrotica virgifera
  misc_feature: Coding regions on vcDNA: vcDNA=SeqID_12415; Strand=-; Position=1-132
  misc_feature (1)..(8): Xaa can be any naturally occurring amino acid
  misc_feature (11)..(18): Xaa can be any naturally occurring amino acid
  misc_feature (30)..(42): Xaa can be any naturally occurring amino acid
XXXXXXXXSNXXXXXXXXPIINLIQHRGSXXXXXXXXXXXXXLL

SEQ ID NO: 32719 - protein, 206 aa, Diabrotica virgifera
  misc_feature: Coding regions on vcDNA: vcDNA=SeqID_12416; Strand=-; Position=209-829
  misc_feature (50)..(55): Xaa can be any naturally occurring amino acid
  misc_feature (73)..(80): Xaa can be any naturally occurring amino acid
ISDRYLLASSFCRKNKKNGGTVIYVKNTLKFEAINCDSFNIEQTCEFCGXXXXXXNTVVLVVYRSSKCNDFKXXXXXXXXLLDHIMRPNLNVVILGDFNINFKGKTPNISELTSITSSFGIKQTIYDYTRVTATSATCIYNIMTNFEENQFQTNVPEPCFSDHRGQYINLSKSSNKLKSSVCTRAFTQEGIFENEKLFIRVRLEHF

SEQ ID NO: 32720 - protein, 66 aa, Diabrotica virgifera; identical to SEQ ID NO: 26808
  misc_feature: Coding regions on vcDNA: vcDNA=SeqID_12417; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32721 - protein, 273 aa, Diabrotica virgifera
  misc_feature: Coding regions on vcDNA: vcDNA=SeqID_12418; Strand=+; Position=1-822
  misc_feature (13)..(24): Xaa can be any naturally occurring amino acid
  misc_feature (30)..(37): Xaa can be any naturally occurring amino acid
  misc_feature (47)..(62): Xaa can be any naturally occurring amino acid
  misc_feature (65)..(86): Xaa can be any naturally occurring amino acid
  misc_feature (88)..(120): Xaa can be any naturally occurring amino acid
  misc_feature (128)..(167): Xaa can be any naturally occurring amino acid
  misc_feature (171)..(180): Xaa can be any naturally occurring amino acid
  misc_feature (182)..(214): Xaa can be any naturally occurring amino acid
  misc_feature (218)..(236): Xaa can be any naturally occurring amino acid
  misc_feature (238)..(268): Xaa can be any naturally occurring amino acid
TLIYSQLIKPFLXXXXXXXXXXXXTSIVRXXXXXXXXNFIFCTSCIXXXXXXXXXXXXXXXXDLXXXXXXXXXXXXXXXXXXXXXXYXXXXXXXXXXXXXXXXXXXXXXXXXXXXXXXXXRDDLKHNXXXXXXXXXXXXXXXXXXXXXXXXXXXXXXXXXXXXXXXXYTFXXXXXXXXXXIXXXXXXXXXXXXXXXXXXXXXXXXXXXXXXXXXLHIXXXXXXXXXXXXXXXXXXXLXXXXXXXXXXXXXXXXXXXXXXXXXXXXXXXIAYIF

SEQ ID NO: 32722 - protein, 214 aa, Diabrotica virgifera
  misc_feature: Coding regions on vcDNA: vcDNA=SeqID_12419; Strand=+; Position=97-741
  misc_feature: Homolog annotation: Hit_ID=NP_057125.2; Match level="QueryCoverage =78%, HitCoverage=70%, E-value=8e-72, Identity=74%"; Hit description =Der1-like domain family, member 2 [Homo sapiens] gb|AAH10890.1| Der1- like domain family, member 2
  misc_feature: Gene Ontology Annotation: Molecular function=molecular_function unknown; Cellular component=membrane; Biological process=proteolysis and peptidolysis
  misc_feature: Pfam annotation: Pfam_ID=DER1; Match level="Score=266.1, E-value=6.2e- 77, Copies=1"; Pfam description=Der1-like family
MAYQTLRNEYMNMPPVTRAYTTACVITTLAVQLELASPFQLYFNPILIVKQGQLWRLVTTFLFFGTFGFNFFFNMIFTYRYCRMLEEGSFRNRTADFVLMFLFGAACMIGFAFFVNLLFLGQAFTIMLVYVWSRRNPFVGLNFFGLLNFQAPYLPWILLAFSIILGNAVCFSTRSQWSTVKNLALVGSRRFFNAASPSICSYKRYKTNTCVYVD

SEQ ID NO: 32723 - protein, 242 aa, Diabrotica virgifera
  misc_feature: Coding regions on vcDNA: vcDNA=SeqID_12420; Strand=+; Position=3-729
  misc_feature: Homolog annotation: Hit_ID=NP_524494.1; Match level="QueryCoverage =79%, HitCoverage=24%, E-value=4e-85, Identity=76%"; Hit description =CG7748-PA [Drosophila melanogaster] gb|AAF56391.1| CG7748-PA [Drosophila melanogaster]
  misc_feature: Gene Ontology Annotation: Molecular function=dolichyl-diphospho -oligosaccharide-protein glycosyltransferase activity; Cellular component=integral to plasma membrane; Biological process=protein modification
  misc_feature (145)..(145): Xaa can be any naturally occurring amino acid
  misc_feature (227)..(227): Xaa can be any naturally occurring amino acid
VIQRICCLRNYDSFRRRLCISYFWRCHRFSHQSNVTVIPRVIINQSSPIALVGKAMSSNESAAYEIMTALDVDYVLVIFGGVIGYSGDDINKFLWMVRIAEGEHPKDIRESDYFTEHGEFRIDAEGSPTLLNCLMYKLSYYRFGXLKLDYRSPAGFDRTRNAVIGNKDFQLNYLEEAYTTEHWLVRVYRVKKPDEFNRPRIPVANIVVKTSNYVSEKNTKRKKGSIXNQPIIVNGERLSTKL

SEQ ID NO: 32724 - protein, 53 aa, Diabrotica virgifera
  misc_feature: Coding regions on vcDNA: vcDNA=SeqID_12421; Strand=-; Position=1-159
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
PFXXXXXXXXXXXTNLAHTGLNXXXXXXXXSNXXXXXXXXXXXXXXPTSRSQS

SEQ ID NO: 32725 - protein, 189 aa, Diabrotica virgifera
  misc_feature: Coding regions on vcDNA: vcDNA=SeqID_12422; Strand=+; Position=252-821
  misc_feature: Homolog annotation: Hit_ID=BAD72127.1; Match level="QueryCoverage =97%, HitCoverage=19%, E-value=3e-28, Identity=39%"; Hit description =reverse transcriptase [Anguilla japonica]
  misc_feature: Pfam annotation: Pfam_ID=RVT_1; Match level="Score=-42.0, E-value =0.067, Copies=1"; Pfam description=Reverse transcriptase (RNA -dependent D
VIIHISNPFTHLVNLSITASQFPSIFKMAKVIPIFKNNDPHDISNYRPVSVLSVISKVIEKVVYNRMLNFIEEYNLLTPNQHRFRPKKSTLTAACSLFERIYDELDSRNHVAGLFFDLSRAFDCLDITFIRNKLYNVGFRGIFLEWVINFLSGRKSVVKIKESSSEPYTTNKGVPQGSVLGPLLFLNFY

SEQ ID NO: 32726 - protein, 80 aa, Diabrotica virgifera
  misc_feature: Coding regions on vcDNA: vcDNA=SeqID_12423; Strand=+; Position=258-500
  misc_feature (9)..(14): Xaa can be any naturally occurring amino acid
NFTLQPWLXXXXXXACTVLHNLCIGMHNVPPIGLGDEENNHIDIDYGHVNGINIEGRIRDRDLLTGRRLQQMLIQINFRN

SEQ ID NO: 32727 - protein, 57 aa, Diabrotica virgifera; identical to SEQ ID NO: 32497
  misc_feature: Coding regions on vcDNA: vcDNA=SeqID_12424; Strand=-; Position=159-332
  misc_feature (1)..(12): Xaa can be any naturally occurring amino acid
  misc_feature (14)..(38): Xaa can be any naturally occurring amino acid

SEQ ID NO: 32728 - protein, 18 aa, Diabrotica virgifera
  misc_feature: Coding regions on vcDNA: vcDNA=SeqID_12425; Strand=-; Position=2-55
  misc_feature (13)..(18): Xaa can be any naturally occurring amino acid
FKLISGQARLLYXXXXXX

SEQ ID NO: 32729 - protein, 312 aa, Diabrotica virgifera
  misc_feature: Coding regions on vcDNA: vcDNA=SeqID_12426; Strand=+; Position=1-936
  misc_feature (6)..(15): Xaa can be any naturally occurring amino acid
  misc_feature (18)..(311): Xaa can be any naturally occurring amino acid
LQGLVXXXXXXXXXXYQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 32730 - protein, 282 aa, Diabrotica virgifera
  misc_feature: Coding regions on vcDNA: vcDNA=SeqID_12427; Strand=-; Position=1-846
  misc_feature (2)..(13): Xaa can be any naturally occurring amino acid
  misc_feature (15)..(26): Xaa can be any naturally occurring amino acid
  misc_feature (34)..(34): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
  misc_feature (80)..(277): Xaa can be any naturally occurring amino acid
IXXXXXXXXXXXXPXXXXXXXXXXXXTNLAHTGXNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTPGR

SEQ ID NO: 32731 - protein, 296 aa, Diabrotica virgifera
  misc_feature: Coding regions on vcDNA: vcDNA=SeqID_12428; Strand=+; Position=2-892
  misc_feature: Homolog annotation: Hit_ID=XP_308285.1; Match level="QueryCoverage =95%, HitCoverage=46%, E-value=1e-67, Identity=48%"; Hit description =ENSANGP00000011010 [Anopheles gambiae]
  misc_feature: Pfam annotation: Pfam_ID=COG6; Match level="Score=-216.7, E-value =0.00071, Copies=1"; Pfam description=Conserved oligomeric complex COG6
  misc_feature (6)..(20): Xaa can be any naturally occurring amino acid
  misc_feature (171)..(176): Xaa can be any naturally occurring amino acid
  misc_feature (206)..(222): Xaa can be any naturally occurring amino acid
  misc_feature (286)..(286): Xaa can be any naturally occurring amino acid
DNEKEXXXXXXXXXXXXXXXENDEETVNAFKQLSTFYTENSLQARRNLRSQIEKRSLDVNKQFLRSFQEVKHAFDSIYNDIADMSKSIQDMESRLQSTKSRTKHLLQQTSVLQNERERSINQQKIVNVLLERFQLTSEQLYIIQGNKEFLLTPEIFNVLDKIQEIRNDCKXXXXXXLQTLALDIMEQMTTYQEAGLEKLYRWTQSXXXXXXXXXXXXXXXXXMARLQHRQVLFKYVIDEYCICRRSKITDDFINALTRGGPSGNPAPIEMRAHDSQIYVTDMLVWXTKRLLWKAEC

SEQ ID NO: 32732 - protein, 179 aa, Diabrotica virgifera
  misc_feature: Coding regions on vcDNA: vcDNA=SeqID_12429; Strand=+; Position=2-541
  misc_feature: Homolog annotation: Hit_ID=XP_393743.1; Match level="QueryCoverage =96%, HitCoverage=31%, E-value=3e-32, Identity=43%"; Hit description =similar to CG5558-PA [Apis mellifera]
KAIYALVSTLFQKLREIETLLKRSQLLIKETKFNPWLAKVLIVELLWGKTYLPGQSKPENTIRAYEQIFKAHLSDSTVTEIEHKDKGNKPRYVRINTLFSNLDEAVESFREDGWVLNRFLNKNDYNGFLEIISSLKEGEFMIDIHVPNLLVFPPKTEFYRHPAYKNGSIILQDKVCVFW

SEQ ID NO: 32733 - protein, 147 aa, Diabrotica virgifera
  misc_feature: Coding regions on vcDNA: vcDNA=SeqID_12430; Strand=+; Position=52-495
  misc_feature (14)..(21): Xaa can be any naturally occurring amino acid
ICASEFFLPLKKPXXXXXXXXLLACVAVFNAVSALDCYTCTDDACKKDVKEMQKVTCGKPADQNQESVCQKVTYKGKDGKEHIERKCAYAPKNGEAQCPASINKADVTDLKCPSCKADLCNSATTINFSLTAFAAVVFAIVGQKFLM

SEQ ID NO: 32734 - protein, 40 aa, Diabrotica virgifera
  misc_feature: Coding regions on vcDNA: vcDNA=SeqID_12431; Strand=+; Position=3-122
  misc_feature (1)..(8): Xaa can be any naturally occurring amino acid
XXXXXXXXENGVSYRAKLGVLFSTKIPYILIIQTQKCLTI

SEQ ID NO: 32735 - protein, 298 aa, Diabrotica virgifera
  misc_feature: Coding regions on vcDNA: vcDNA=SeqID_12432; Strand=-; Position=3-896
  misc_feature (5)..(15): Xaa can be any naturally occurring amino acid
  misc_feature (35)..(47): Xaa can be any naturally occurring amino acid
  misc_feature (54)..(66): Xaa can be any naturally occurring amino acid
  misc_feature (69)..(298): Xaa can be any naturally occurring amino acid
LVRLXXXXXXXXXXXPTLAHTGLNSNQVKFKSRTXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32736 - protein, 57 aa, Diabrotica virgifera
  misc_feature: Coding regions on vcDNA: vcDNA=SeqID_12433; Strand=-; Position=204-377
  misc_feature (20)..(25): Xaa can be any naturally occurring amino acid
CVGMKLKTGYFELSSGAELXXXXXXSGVSCGDQNSGTIQLNKSAGRGEIKYKTHGFI

SEQ ID NO: 32737 - protein, 35 aa, Diabrotica virgifera
  misc_feature: Coding regions on vcDNA: vcDNA=SeqID_12434; Strand=+; Position=29-136
KTLFSSYLLDVKKKAYVRLARDYDALDVANKIGII

SEQ ID NO: 32738 - protein, 302 aa, Diabrotica virgifera
  misc_feature: Coding regions on vcDNA: vcDNA=SeqID_12435; Strand=+; Position=3-908
  misc_feature: Homolog annotation: Hit_ID=XP_395639.1; Match level="QueryCoverage =99%, HitCoverage=21%, E-value=9e-91, Identity=57%"; Hit description =similar to ENSANGP00000003310 [Apis mellifera]
  misc_feature: Gene Ontology Annotation: Molecular function=general RNA polymerase II transcription factor activity; Cellular component=transcription factor TFIID complex; Biological process=G1-specific transcription in mitotic cell cycle
  misc_feature (163)..(168): Xaa can be any naturally occurring amino acid
  misc_feature (179)..(188): Xaa can be any naturally occurring amino acid
  misc_feature (205)..(211): Xaa can be any naturally occurring amino acid
QNYNPGRILKIFRTFRNPEGREFTRVEYVRKQVVIDAYVKIRMTKDEEFIRQFATLDEAQKEEMKREKRRIQEQLRRIKRNQEKEKMGGGHTHMHSTPIVPPAGTAIEKLPNPSDSLSTPVTPTSSKSMSSSPPKSRRKTKLKPDLKLKCGACGNVGHMRTNXXXXXXQATTGQNPPIXXXXXXXXXXDIEKQINTDDEDLVNVXXXXXXXSGKLLKNYFQHAEEIKRRSLMLKVPKDALGNRKRRRGVQDLHCDYLKKHNRPANRRRTDPVVVLSTILENILNEMRDMPDVQPFLIPCQSK

SEQ ID NO: 32739 - protein, 108 aa, Diabrotica virgifera; identical to SEQ ID NO: 27732
  misc_feature: Coding regions on vcDNA: vcDNA=SeqID_12436; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 32740 - protein, 68 aa, Diabrotica virgifera
  misc_feature: Coding regions on vcDNA: vcDNA=SeqID_12437; Strand=+; Position=508-714
  misc_feature (48)..(53): Xaa can be any naturally occurring amino acid
VAYTNDYATMPTFRGRWCFIEYGRRIFREDDNDNPTLRIPTLIIRLRXXXXXXSGITSILQCNLLKDF

SEQ ID NO: 32741 - protein, 189 aa, Diabrotica virgifera
  misc_feature: Coding regions on vcDNA: vcDNA=SeqID_12438; Strand=-; Position=3-569
  misc_feature (29)..(189): Xaa can be any naturally occurring amino acid
FYTYNIFIRIVTSVNKLYYHIYLYSNKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32742 - protein, 76 aa, Diabrotica virgifera
  misc_feature: Coding regions on vcDNA: vcDNA=SeqID_12439; Strand=-; Position=187-417
  misc_feature (47)..(47): Xaa can be any naturally occurring amino acid
  misc_feature (49)..(49): Xaa can be any naturally occurring amino acid
  misc_feature (68)..(68): Xaa can be any naturally occurring amino acid
FTYQLYLLIKIFLKIYLPHTSKHIKKKFLILQKSQIILISFSPIISXFXFIYTHSLNTIYNTIKYYSXIIHFIFLI

SEQ ID NO: 32743 - protein, 75 aa, Diabrotica virgifera
  misc_feature: Coding regions on vcDNA: vcDNA=SeqID_12440; Strand=+; Position=202-429
  misc_feature: Homolog annotation: Hit_ID=XP_393854.1; Match level="QueryCoverage =100%, HitCoverage=12%, E-value=4e-10, Identity=44%"; Hit description= similar to ENSANGP00000025090 [Apis mellifera]
  misc_feature (61)..(61): Xaa can be any naturally occurring amino acid
IPHGITYVFDACLPSQCDLYSEFLNCFMNFVILICNDIFIVPTLYMILMIHSYVSALGDAXGILITFLTDCHIFL

SEQ ID NO: 32744 - protein, 305 aa, Diabrotica virgifera
  misc_feature: Coding regions on vcDNA: vcDNA=SeqID_12441; Strand=-; Position=1-915
  misc_feature (4)..(301): Xaa can be any naturally occurring amino acid
QKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGG

SEQ ID NO: 32745 - protein, 84 aa, Diabrotica virgifera
  misc_feature: Coding regions on vcDNA: vcDNA=SeqID_12442; Strand=+; Position=80-334
  misc_feature (38)..(45): Xaa can be any naturally occurring amino acid
NRQQDHTKPWTTTDRPPQSQICRARRSDEEQRQERILXXXXXXXXTAGSEEESTSELKIAGPKGAATATTASQRGRAEIKASIV

SEQ ID NO: 32746 - protein, 137 aa, Diabrotica virgifera
  misc_feature: Coding regions on vcDNA: vcDNA=SeqID_12443; Strand=+; Position=67-482
  misc_feature: Homolog annotation: Hit_ID=AAF13316.1; Match level="QueryCoverage =86%, HitCoverage=74%, E-value=2e-19, Identity=44%"; Hit description =translation initiation factor 5A [Spodoptera frugiperda] gb|AAF13315.1| translation initiation factor 5A [
  misc_feature: Gene Ontology Annotation: Molecular function=translation initiation factor activity; Cellular component=ribosome; Biological process =translational initiation
  misc_feature (25)..(25): Xaa can be any naturally occurring amino acid
  misc_feature (39)..(39): Xaa can be any naturally occurring amino acid
  misc_feature (72)..(72): Xaa can be any naturally occurring amino acid
  misc_feature (76)..(76): Xaa can be any naturally occurring amino acid
  misc_feature (97)..(102): Xaa can be any naturally occurring amino acid
MEYDLDDSHYETEYYGACATYSNAXSTRLKNGILMLNSXPCEIVKMFKCKNGNLELATFQLSDIDIVTDKKXQIFXPSTPEMDAPHVTRADYQLTDXXXXXXLSLMSDNEELPVYLKAPHAECAVTVGAKDAADEDI

SEQ ID NO: 32747 - protein, 97 aa, Diabrotica virgifera
  misc_feature: Coding regions on vcDNA: vcDNA=SeqID_12444; Strand=+; Position=614-905
  misc_feature: Homolog annotation: Hit_ID=XP_319012.1; Match level="QueryCoverage =95%, HitCoverage=32%, E-value=7e-28, Identity=62%"; Hit description =ENSANGP00000024010 [Anopheles gambiae]
  misc_feature (19)..(28): Xaa can be any naturally occurring amino acid
  misc_feature (81)..(81): Xaa can be any naturally occurring amino acid
TRVDDIYFSFPYQGDVIFXXXXXXXXXXFVEITMGYHSLKGLAGMRSRGEEPPLNMGMLPEYQQKISICNYRFIREFTKGXVEGDWTVNLLNHFKPI

SEQ ID NO: 32748 - protein, 111 aa, Diabrotica virgifera
  misc_feature: Coding regions on vcDNA: vcDNA=SeqID_12445; Strand=+; Position=67-403
  misc_feature: Homolog annotation: Hit_ID=AAF13316.1; Match level="QueryCoverage =95%, HitCoverage=66%, E-value=1e-21, Identity=48%"; Hit description =translation initiation factor 5A [Spodoptera frugiperda] gb|AAF13315.1| translation initiation factor 5A [
  misc_feature: Gene Ontology Annotation: Molecular function=translation initiation factor activity; Cellular component=ribosome; Biological process =translational initiation
  misc_feature (24)..(24): Xaa can be any naturally occurring amino acid
  misc_feature (63)..(63): Xaa can be any naturally occurring amino acid
  misc_feature (72)..(72): Xaa can be any naturally occurring amino acid
  misc_feature (97)..(102): Xaa can be any naturally occurring amino acid
MEYNLDESPYETGYYGASANYPMXCSSQLNNGILMLYTRPCENVKMLKCNNGKLDQAKISIVXIDIFTGKKXANICPSTPVMDAPRVTRSDYQKTDXXXXXXLSLMSDHEE

SEQ ID NO: 32749 - protein, 59 aa, Diabrotica virgifera
  misc_feature: Coding regions on vcDNA: vcDNA=SeqID_12446; Strand=-; Position=2-178
  misc_feature (48)..(55): Xaa can be any naturally occurring amino acid
SVWSFRYLLILLCDIIGSLHLLIAFNLFYLQILFVLDQIKAVLISSTXXXXXXXXDLMI

SEQ ID NO: 32750 - protein, 59 aa, Diabrotica virgifera
  misc_feature: Coding regions on vcDNA: vcDNA=SeqID_12447; Strand=-; Position=1-177
TTDFFSEDSYNSLLRLCQYRLFVLVIRKSIPLKSRKNRLLYDITVSFKLIIRRGSPNFQ

SEQ ID NO: 32751 - protein, 211 aa, Diabrotica virgifera
  misc_feature: Coding regions on vcDNA: vcDNA=SeqID_12448; Strand=+; Position=1-633
  misc_feature (4)..(180): Xaa can be any naturally occurring amino acid
  misc_feature (182)..(195): Xaa can be any naturally occurring amino acid
LTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIIVYSLVQQLY

SEQ ID NO: 32752 - protein, 177 aa, Diabrotica virgifera
  misc_feature: Coding regions on vcDNA: vcDNA=SeqID_12449; Strand=+; Position=2-535
  misc_feature (5)..(143): Xaa can be any naturally occurring amino acid
ASPRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYIPMKNKNFHIIEYGIIYCHRLLSDICYQMNIII

SEQ ID NO: 32753 - protein, 241 aa, Diabrotica virgifera
  misc_feature: Coding regions on vcDNA: vcDNA=SeqID_12450; Strand=-; Position=3-725
  misc_feature (33)..(45): Xaa can be any naturally occurring amino acid
  misc_feature (47)..(57): Xaa can be any naturally occurring amino acid
  misc_feature (67)..(75): Xaa can be any naturally occurring amino acid
  misc_feature (77)..(90): Xaa can be any naturally occurring amino acid
  misc_feature (97)..(109): Xaa can be any naturally occurring amino acid
  misc_feature (111)..(241): Xaa can be any naturally occurring amino acid
VGSLERAPHCWFCGGRVYWEELDWFFSCTSLNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32754 - protein, 34 aa, Diabrotica virgifera
  misc_feature: Coding regions on vcDNA: vcDNA=SeqID_12451; Strand=+; Position=3-104
FFQRRQDPIELYNLINKPFHHKFIFIQIYSPGRA

SEQ ID NO: 32755 - protein, 143 aa, Diabrotica virgifera
  misc_feature: Coding regions on vcDNA: vcDNA=SeqID_12452; Strand=+; Position=537-966
  misc_feature: Homolog annotation: Hit_ID=CAB62280.1; Match level="QueryCoverage =99%, HitCoverage=72%, E-value=4e-13, Identity=35%"; Hit description =hydroxyproline-rich glycoprotein DZ-HRGP [Volvox carteri f. nagariensis]
  misc_feature: Gene Ontology Annotation: Molecular function=actin binding; Cellular component=actin cytoskeleton; Biological process=G-protein signaling, coupled to cAMP nucleotide second messenger
  misc_feature (46)..(59): Xaa can be any naturally occurring amino acid
  misc_feature (66)..(72): Xaa can be any naturally occurring amino acid
  misc_feature (74)..(84): Xaa can be any naturally occurring amino acid
  misc_feature (103)..(115): Xaa can be any naturally occurring amino acid
  misc_feature (127)..(133): Xaa can be any naturally occurring amino acid
TPPTLYARHTFPQTTHSPLPPPFPTPPPPPNPDLPPPPPTPPPLHXXXXXXXXXXXXXXLPTPPPXXXXXXXPXXXXXXXXXXXPPPPSPPPSITPHLPPHPXXXXXXXXXXXXXSNPSPSPSAPPXXXXXXXPRYQLPRSSS

SEQ ID NO: 32756 - protein, 55 aa, Diabrotica virgifera
  misc_feature: Coding regions on vcDNA: vcDNA=SeqID_12453; Strand=-; Position=0-164
  misc_feature (26)..(50): Xaa can be any naturally occurring amino acid
YFDQESHTHKYFQLDDYNFYLSILIXXXXXXXXXXXXXXXXXXXXXXXXXHNMKG

SEQ ID NO: 32757 - protein, 77 aa, Diabrotica virgifera
  misc_feature: Coding regions on vcDNA: vcDNA=SeqID_12454; Strand=+; Position=1-234
  misc_feature (53)..(60): Xaa can be any naturally occurring amino acid
PFCCDNVIYPLLRNSDLKKREINYICCKAVNGIDPKLRCDECELRCLGQGNSXXXXXXXXMRTFDLSVSGLERSGLS

SEQ ID NO: 32758 - protein, 71 aa, Diabrotica virgifera
  misc_feature: Coding regions on vcDNA: vcDNA=SeqID_12455; Strand=-; Position=49-264
CPHSMKKIPIWRGDKNAKSKELRHEDLYHESVLHSPSSAPVEQITKLQVVDIQRSLPCLGHLWLLKGNKAK

SEQ ID NO: 32759 - protein, 42 aa, Diabrotica virgifera
  misc_feature: Coding regions on vcDNA: vcDNA=SeqID_12456; Strand=+; Position=1-129
GRLGGPGRDFRGPFNGQTTRREEGRALLFGIGAYEKPEMTQN

SEQ ID NO: 32760 - protein, 77 aa, Diabrotica virgifera
  misc_feature: Coding regions on vcDNA: vcDNA=SeqID_12457; Strand=-; Position=1-231
AMKTVHLMAFLHTVIDHGRVHFSLCLDVHTSEFPPSRAFTLKCFTGVQVASGYYKLSYPKGEGKKSMFMSLRGKKRE

SEQ ID NO: 32761 - protein, 139 aa, Diabrotica virgifera
  misc_feature: Coding regions on vcDNA: vcDNA=SeqID_12458; Strand=-; Position=1-417
  misc_feature (11)..(138): Xaa can be any naturally occurring amino acid
VVIIKLFLIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 32762 - protein, 106 aa, Diabrotica virgifera
  misc_feature: Coding regions on vcDNA: vcDNA=SeqID_12459; Strand=-; Position=237-557
  misc_feature (17)..(26): Xaa can be any naturally occurring amino acid
KYSHFVFSQYNIMIVIXXXXXXXXXXYTLDYRRSKAILFFLIILQTYWSVFKFKCLNCQIIKSLVSFVSKKGNYFRNYQEIFFNLNITLKKSSFRHLRGTEQNAKF

SEQ ID NO: 32763 - protein, 271 aa, Diabrotica virgifera
  misc_feature: Coding regions on vcDNA: vcDNA=SeqID_12460; Strand=-; Position=1-813
  misc_feature (1)..(8): Xaa can be any naturally occurring amino acid
  misc_feature (11)..(267): Xaa can be any naturally occurring amino acid
XXXXXXXXKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTRV

SEQ ID NO: 32764 - protein, 239 aa, Diabrotica virgifera
  misc_feature: Coding regions on vcDNA: vcDNA=SeqID_12461; Strand=+; Position=101-817
  misc_feature: Homolog annotation: Hit_ID=XP_393498.1; Match level="QueryCoverage =97%, HitCoverage=57%, E-value=3e-67, Identity=51%"; Hit description =similar to CG2182-PA [Apis mellifera]
  misc_feature: Gene Ontology Annotation: Cellular component=nucleus
MNNKEKLPKLVDVHHQSNPLSRRQLPLVVDDNLTLVMDIKGSGIICDNQVLRGKELEEFACKWSVLPPCELRNALQITKSELMHVLNQNVPCVGCRRSVDRLYFQLFNYGHPTLDPLIVKPDGTITIREDKQAYPILGSIFHDHSVRLAKLIENQPKRNKKSVRCLLHSLDSQRSRPLTPVWRDVWECMKPECKKDVCLIKASSLHTTLETYLRKHRFCGECRTKVLKAYSLLVEEPEP

SEQ ID NO: 32765 - protein, 100 aa, Diabrotica virgifera
  misc_feature: Coding regions on vcDNA: vcDNA=SeqID_12462; Strand=+; Position=407-709
  misc_feature (50)..(60): Xaa can be any naturally occurring amino acid
  misc_feature (74)..(80): Xaa can be any naturally occurring amino acid
DVNDSVFILDRLIKDDQLVKALKEEYKYTSLQPKEVGILDTDVYKGMFTXXXXXXXXXXXEKFYVKCQVKNFRXXXXXXXGSINLFAFLIKFFHLFHLFI

SEQ ID NO: 32766 - protein, 61 aa, Diabrotica virgifera
  misc_feature: Coding regions on vcDNA: vcDNA=SeqID_12463; Strand=-; Position=43-228
VCISVLFYKSSGGSNTSSNMSSDSSQLSVNEPSSFNKVESIIGLFILLDTILYGTPHMSSS

SEQ ID NO: 32767 - protein, 211 aa, Diabrotica virgifera
  misc_feature: Coding regions on vcDNA: vcDNA=SeqID_12464; Strand=+; Position=68-703
  misc_feature: Homolog annotation: Hit_ID=NP_609081.1; Match level="QueryCoverage =100%, HitCoverage=81%, E-value=2e-22, Identity=30%"; Hit description= CG13773-PA [Drosophila melanogaster] gb|AAF52451.1| CG13773-PA [Drosophila melanogaster]
  misc_feature: Pfam annotation: Pfam_ID=RNA_pol_Rpa43; Match level="Score=68.5, E -value=1.9e-17, Copies=1"; Pfam description=RNA polymerase Rpa43 subunit
  misc_feature (138)..(145): Xaa can be any naturally occurring amino acid
MVKLSNARVNFNPKLLKKLTQKENSGVEVHTTVQHLAIYPHQLNNFNDSVKGLLNAKIAKYNKTFNGILLGYKNIKLLKDGGVIQDDSYYIHFDLQADFYIFKPEIGKIMEGVVKRKSKDHIGALVYEAFNVSIPLTXXXXXXXXGNTVKVGDTVTFQIIYINLTSRLPYIRGRLMSETTETETNEISKNKSKTETTETETNETTEKTEDD

SEQ ID NO: 32768 - protein, 168 aa, Diabrotica virgifera
  misc_feature: Coding regions on vcDNA: vcDNA=SeqID_12465; Strand=+; Position=96-602
  misc_feature: Homolog annotation: Hit_ID=AAV34856.1; Match level="QueryCoverage =63%, HitCoverage=34%, E-value=2e-13, Identity=41%"; Hit description =ribosomal protein SA [Bombyx mori]
  misc_feature: Gene Ontology Annotation: Molecular function=structural constituent of ribosome; Cellular component=cytosolic small ribosomal subunit (sensu Eukarya); Biological process=ribosomal small subunit assembly and maintenance
  misc_feature (105)..(105): Xaa can be any naturally occurring amino acid
MPPIRSFIPAIVDQNMYVFYWTRMFSSLAMALPSTSCAYGEYRKILLSPHAIAVIDHPDDIYLCTSLTCERGADLLLGAHTVPSPIAGIFTPGASTCLNPTASGXPPLLNGPDPGYDLLPISDASYECIPCLALSDNGPPSRYVEIAILERPERSRKIEELCGLWSYI

SEQ ID NO: 32769 - protein, 82 aa, Diabrotica virgifera
  misc_feature: Coding regions on vcDNA: vcDNA=SeqID_12466; Strand=+; Position=2-250
  misc_feature (22)..(33): Xaa can be any naturally occurring amino acid
FKQFFVLYLNIKLILERTKRIXXXXXXXXXXXXLSGFEQATSRSLGECSTDQLPRLLYSVDHFSDIITISVTDTLNENKHFQ

SEQ ID NO: 32770 - protein, 302 aa, Diabrotica virgifera
  misc_feature: Coding regions on vcDNA: vcDNA=SeqID_12467; Strand=+; Position=1-906
  misc_feature (2)..(275): Xaa can be any naturally occurring amino acid
  misc_feature (282)..(294): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITLGITXXXXXXXXXXXXXPTSMLDKV

SEQ ID NO: 32771 - protein, 219 aa, Diabrotica virgifera
  misc_feature: Coding regions on vcDNA: vcDNA=SeqID_12468; Strand=+; Position=245-901
  misc_feature: Homolog annotation: Hit_ID=XP_316595.1; Match level="QueryCoverage =98%, HitCoverage=76%, E-value=1e-54, Identity=50%"; Hit description =ENSANGP00000011437 [Anopheles gambiae]
  misc_feature: Gene Ontology Annotation: Molecular function=myo-inositol-1(or 4) -monophosphatase activity; Cellular component=cellular_component unknown; Biological process=signal transduction
  misc_feature: Pfam annotation: Pfam_ID=Inositol_P; Match level="Score=208.0, E -value=1.8e-59, Copies=1"; Pfam description=Inositol monophosphatase family
MSAEELDQYYETAVALAKRLGAIIKETALVRNKSTTSKLNRTDLVTETDKHIEKLLISTVNKEYPHHKIIGEESTFEGAECTLTDAPTWIVDPIDGTMNFVHSFPHSCISIALFVNKEPEIGIIYNPHLEQFFSARKGKGAFLNGEPINVSDTKTMADALVLTESFARENSVKEKVILENYKMLMRETHGPRSLGSAAMDMCMVACGAADAYYQYKLNI

SEQ ID NO: 32772 - protein, 239 aa, Diabrotica virgifera
  misc_feature: Coding regions on vcDNA: vcDNA=SeqID_12469; Strand=-; Position=111-830
  misc_feature (1)..(10): Xaa can be any naturally occurring amino acid
  misc_feature (12)..(50): Xaa can be any naturally occurring amino acid
  misc_feature (54)..(102): Xaa can be any naturally occurring amino acid
  misc_feature (105)..(129): Xaa can be any naturally occurring amino acid
  misc_feature (132)..(139): Xaa can be any naturally occurring amino acid
  misc_feature (143)..(163): Xaa can be any naturally occurring amino acid
  misc_feature (165)..(181): Xaa can be any naturally occurring amino acid
  misc_feature (185)..(191): Xaa can be any naturally occurring amino acid
  misc_feature (198)..(206): Xaa can be any naturally occurring amino acid
  misc_feature (223)..(239): Xaa can be any naturally occurring amino acid
XXXXXXXXXXKXXXXXXXXXXXXXXXXXXXXXXXXXXXXXXXXXXXXXXXHSKXXXXXXXXXXXXXXXXXXXXXXXXXXXXXXXXXXXXXXXXXXXXXXXXXLSXXXXXXXXXXXXXXXXXXXXXXXXXNMXXXXXXXXILIXXXXXXXXXXXXXXXXXXXXXIXXXXXXXXXXXXXXXXXCISXXXXXXXEGVSFHXXXXXXXXXFTIRILLGVGLLKAKVXXXXXXXXXXXXXXXXX

SEQ ID NO: 32773 - protein, 45 aa, Diabrotica virgifera
  misc_feature: Coding regions on vcDNA: vcDNA=SeqID_12470; Strand=+; Position=73-210
  misc_feature (3)..(10): Xaa can be any naturally occurring amino acid
RRXXXXXXXXYAKAEYMTRAWLDKGRLVNTSLSGLITIPPTSRKF

SEQ ID NO: 32774 - protein, 81 aa, Diabrotica virgifera
  misc_feature: Coding regions on vcDNA: vcDNA=SeqID_12471; Strand=-; Position=317-562
  misc_feature (73)..(79): Xaa can be any naturally occurring amino acid
GVHSTSSVFENAYPSFLNVLHYFVGPSIPPSENLQGAGESFRTHNTQIYSSSAAMPRYCKTTIFNFKHFNNLXXXXXXXIR

SEQ ID NO: 32775 - protein, 77 aa, Diabrotica virgifera
  misc_feature: Coding regions on vcDNA: vcDNA=SeqID_12472; Strand=+; Position=105-338
SIIKLLNLYLHGIVSSITMNSGPQHPKELVCCPLPWCTHVVFSQLLDPNTGEAERINCEKSTANPLKPPSFQLRTTS

SEQ ID NO: 32776 - protein, 91 aa, Diabrotica virgifera
  misc_feature: Coding regions on vcDNA: vcDNA=SeqID_12473; Strand=-; Position=155-430
MFRYGPNCSFITLLLSLFLKMPSPQLLSEGWLLQSQLLVCLQLFLLDVQNLVLSIVGCFLPTIVFSFLVLSFPRSFLSLLVLVLIVSQHVN

SEQ ID NO: 32777 - protein, 49 aa, Diabrotica virgifera
  misc_feature: Coding regions on vcDNA: vcDNA=SeqID_12474; Strand=+; Position=2-151
  misc_feature (1)..(22): Xaa can be any naturally occurring amino acid
XXXXXXXXXXXXXXXXXXXXXXRINYLRDNSGILWESSIDNKDCDLDVD

SEQ ID NO: 32778 - protein, 265 aa, Diabrotica virgifera
  misc_feature: Coding regions on vcDNA: vcDNA=SeqID_12475; Strand=-; Position=3-797
  misc_feature: Homolog annotation: Hit_ID=EAL39934.1; Match level="QueryCoverage =92%, HitCoverage=31%, E-value=8e-55, Identity=44%"; Hit description =ENSANGP00000028171 [Anopheles gambiae str. PEST] ref|XP_556470.1| ENSANGP00000028171 [Anopheles gambiae st
  misc_feature (91)..(91): Xaa can be any naturally occurring amino acid
  misc_feature (136)..(136): Xaa can be any naturally occurring amino acid
MVQKPISTEKRGHRANAIHTLRDNQGHMIIDDKELTEEWKGYFRDLLNIIQEEQHKEIYITADMPVENPSFEETQKALNKLKNHKAPDTDXPAEFLKYGGDALRRQIHHLITQIWLEERISARWKANIIVPIYKKXDKTKCANYRGISLLNTAYKILSNITLSRLTPYAENVLGEYQAGFRANRSTIDQLFTLRHLLEKGWEYNRPIHNLFIDFRQAYDSVERSQVWNAMSEFSIPKKLIRMTKVCMEGGISKVRVSIICLTALN

SEQ ID NO: 32779 - protein, 70 aa, Diabrotica virgifera
  misc_feature: Coding regions on vcDNA: vcDNA=SeqID_12476; Strand=-; Position=1-210
YVVYLKYRVSTYILPHSNRLQPPNGSRQKYEVLDEMLHPSKSPVRMDRIPYIAPKHEKTNGGPLKKTLLT

SEQ ID NO: 32780 - protein, 55 aa, Diabrotica virgifera
  misc_feature: Coding regions on vcDNA: vcDNA=SeqID_12477; Strand=-; Position=1-165
  misc_feature (2)..(26): Xaa can be any naturally occurring amino acid
  misc_feature (34)..(55): Xaa can be any naturally occurring amino acid
NXXXXXXXXXXXXXXXXXXXXXXXXXIGFSRLVXXXXXXXXXXXXXXXXXXXXXX

SEQ ID NO: 32781 - protein, 23 aa, Diabrotica virgifera
  misc_feature: Coding regions on vcDNA: vcDNA=SeqID_12478; Strand=-; Position=1-69
  misc_feature (1)..(23): Xaa can be any naturally occurring amino acid
XXXXXXXXXXXXXXXXXXXXXXX

SEQ ID NO: 32782 - protein, 246 aa, Diabrotica virgifera
  misc_feature: Coding regions on vcDNA: vcDNA=SeqID_12479; Strand=+; Position=63-805
  misc_feature: Homolog annotation: Hit_ID=XP_321339.1; Match level="QueryCoverage =89%, HitCoverage=90%, E-value=3e-31, Identity=33%"; Hit description =ENSANGP00000012821 [Anopheles gambiae]
  misc_feature: Pfam annotation: Pfam_ID=DUF800; Match level="Score=105.3, E-value =1.6e-28, Copies=1"; Pfam description=Protein of unknown function (DUF800)
  misc_feature (188)..(188): Xaa can be any naturally occurring amino acid
  misc_feature (211)..(211): Xaa can be any naturally occurring amino acid
  misc_feature (214)..(214): Xaa can be any naturally occurring amino acid
  misc_feature (223)..(223): Xaa can be any naturally occurring amino acid
VQRPSFVINAKMSTNSSPTHYTEDAFVRDANFKVGINQKMKVPDRISFATDLNGESRGSWTRDNLNMNVPERILVAGQHQHVGTRAPPREIVFDNAIIAKDPHPYDLPRVATPPRTLTLDKYPFPGVDEYQDHDIEDHLPVVKATPKVRMNDVSFQLGNSFNESTQIYSGAGEGLTPAEEVMHLRRQXAKLNRRIMALELENINRLQKEKXGLXFGVAYFLLXVIIWMNRLMVLNFVYRIVLGGSK

SEQ ID NO: 32783 - protein, 152 aa, Diabrotica virgifera
  misc_feature: Coding regions on vcDNA: vcDNA=SeqID_12480; Strand=-; Position=375-833
  misc_feature: Homolog annotation: Hit_ID=XP_313621.1; Match level="QueryCoverage =55%, HitCoverage=19%, E-value=1e-11, Identity=40%"; Hit description =ENSANGP00000024261 [Anopheles gambiae]
QCSQLLTITFKYETILSIQGVSPKIPRAKIPTRQNSGVSVFWPSGFWLSVFWLSGFWAPPAYNEPDVITCIKIGRLRWMGHVERMLETETSKHIMMPVGRRSKRRPKLRYMEQVEQDLKTLEITHWKNKARNRTEWRKILEQARTQKGLLSY

SEQ ID NO: 32784 - protein, 270 aa, Diabrotica virgifera
  misc_feature: Coding regions on vcDNA: vcDNA=SeqID_12481; Strand=-; Position=1-810
  misc_feature (1)..(17): Xaa can be any naturally occurring amino acid
  misc_feature (21)..(270): Xaa can be any naturally occurring amino acid
XXXXXXXXXXXXXXXXXLSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32785 - protein, 168 aa, Diabrotica virgifera
  misc_feature: Coding regions on vcDNA: vcDNA=SeqID_12482; Strand=+; Position=319-822
  misc_feature (73)..(80): Xaa can be any naturally occurring amino acid
SNMVLKTYSRKRKPSDIHDFDTPSPKRSAFEDPDANQIYEKGDPLALPSDVYVTKSSRVIKKKVIWDPDDEQXXXXXXXXIVDTTKVYGAKTEKSDRKQTGTPTGDKIKSDQKTTPKSAEKNTTEKNIVKKPVAKPKTPLKSKRGLSEVDRLLMDEGAVKMLYDLKSD

SEQ ID NO: 32786 - protein, 208 aa, Diabrotica virgifera
  misc_feature: Coding regions on vcDNA: vcDNA=SeqID_12483; Strand=+; Position=2-628
  misc_feature (168)..(175): Xaa can be any naturally occurring amino acid
VKVLLKILPELLGSSEQNCVDRKNINLKCIDVLFKNAHNKVDAMKIKDFQKKAEAEIRGGFQCLAFKSLKIILLNTNEEERLLHYHDLIKLFYNSLIQKVLELHKLDSLITFQEYEHLVRNLLPLVTLEILLEQYPTKNQILFEELVEYLDMPIVLREDIYEVLQKKXXXXXXXXIRYHLEAVSNKGLLSDCASLNVLIIEENEKKNL

SEQ ID NO: 32787 - protein, 244 aa, Diabrotica virgifera
  misc_feature: Coding regions on vcDNA: vcDNA=SeqID_12484; Strand=+; Position=174-905
  misc_feature: Homolog annotation: Hit_ID=XP_395261.1; Match level="QueryCoverage =100%, HitCoverage=50%, E-value=1e-108, Identity=79%"; Hit description=similar to ENSANGP00000005181 [Apis mellifera]
  misc_feature: Gene Ontology Annotation: Molecular function=3'-5' exoribonuclease activity; Cellular component=CCR4-NOT core complex; Biological process=regulation of transcription, DNA-dependent
  misc_feature: Pfam annotation: Pfam_ID=Not3; Match level="Score=481.8, E-value=6.9e- 142, Copies=1"; Pfam description=Not1 N-terminal domain, CCR4-Not comp
  misc_feature (148)..(148): Xaa can be any naturally occurring amino acid
  misc_feature (151)..(157): Xaa can be any naturally occurring amino acid
MAATRKLQGEIDRCLKKVTEGVDTFEDIWQKVHNATNSNQKEKYEADLKKEIKKLQRLRDQIKSWIASAEIKDKSILMDNRKLIETQMERFKVVERETKTKAYSKEGLGAAQKLDPAQKERDDIQYWLTSSIAKLNIGSDSLESEIEXLLXXXXXXXDKDKQDRIEDLKSRLDKHKFHIRKLETLLRMLDNMSVEVQQIKNIRDNVEYYIDFNTEPDFEDNEFIYDDIIGMDEVELSGVPLPSS

SEQ ID NO: 32788 - protein, 28 aa, Diabrotica virgifera
  misc_feature: Coding regions on vcDNA: vcDNA=SeqID_12485; Strand=-; Position=1-84
  misc_feature (2)..(28): Xaa can be any naturally occurring amino acid
RXXXXXXXXXXXXXXXXXXXXXXXXXXX

SEQ ID NO: 32789 - protein, 163 aa, Diabrotica virgifera
  misc_feature: Coding regions on vcDNA: vcDNA=SeqID_12486; Strand=-; Position=1-489
  misc_feature (7)..(28): Xaa can be any naturally occurring amino acid
  misc_feature (31)..(137): Xaa can be any naturally occurring amino acid
  misc_feature (140)..(162): Xaa can be any naturally occurring amino acid
CLLSPPXXXXXXXXXXXXXXXXXXXXXXSMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLXXXXXXXXXXXXXXXXXXXXXXXY

SEQ ID NO: 32790 - protein, 50 aa, Diabrotica virgifera
  misc_feature: Coding regions on vcDNA: vcDNA=SeqID_12487; Strand=-; Position=2-151
  misc_feature (3)..(13): Xaa can be any naturally occurring amino acid
  misc_feature (23)..(30): Xaa can be any naturally occurring amino acid
PFXXXXXXXXXXXTNLAHTGLNXXXXXXXXSNRLYNWCSSYIIKSVRRLN

SEQ ID NO: 32791 - protein, 82 aa, Diabrotica virgifera
  misc_feature: Coding regions on vcDNA: vcDNA=SeqID_12488; Strand=+; Position=10-258
IFFQNFFHAFTLFDCLLYLLFIVVSYVIHATSEQGTNQDRYELLQCILQGKIEGKRAPGRRRISWLAKLRACYRKPQHNYSV

SEQ ID NO: 32792 - protein, 84 aa, Diabrotica virgifera
  misc_feature: Coding regions on vcDNA: vcDNA=SeqID_12489; Strand=+; Position=556-807
  misc_feature (2)..(8): Xaa can be any naturally occurring amino acid
  misc_feature (32)..(52): Xaa can be any naturally occurring amino acid
  misc_feature (65)..(83): Xaa can be any naturally occurring amino acid
IXXXXXXXLIKEIGNIFFHRILKTCLIELNIXXXXXXXXXXXXXXXXXXXXXKSLAFLWNGGRKXXXXXXXXXXXXXXXXXXXG

SEQ ID NO: 32793 - protein, 62 aa, Diabrotica virgifera
  misc_feature: Coding regions on vcDNA: vcDNA=SeqID_12490; Strand=+; Position=3-191
  misc_feature (16)..(22): Xaa can be any naturally occurring amino acid
PCVSDTQYIIHTCFLXXXXXXXKSNFYRKKCIEHMFVRERCVSPFHISSFSRNRLHRLFKKI

SEQ ID NO: 32794 - protein, 136 aa, Diabrotica virgifera
  misc_feature: Coding regions on vcDNA: vcDNA=SeqID_12491; Strand=+; Position=557-967
  misc_feature (34)..(110): Xaa can be any naturally occurring amino acid
  misc_feature (113)..(131): Xaa can be any naturally occurring amino acid
DTYYIYKKVVYLAKNISGLINGILATYFFTLFIXXXXXXXXXXXXXXXXXXXXXXXXXXXXXXXXXXXXXXXXXXXXXXXXXXXXXXXXXXXXXXXXXXXXXXXXXXXXXIEXXXXXXXXXXXXXXXXXXXSFYLG

SEQ ID NO: 32795 - protein, 93 aa, Diabrotica virgifera
  misc_feature: Coding regions on vcDNA: vcDNA=SeqID_12492; Strand=-; Position=333-614
FKKDGQEKPKKDVCMDQIIYVLKCIQTLIKDVQQTIKRCLLTHILHNLKKMVRKSQKKRCLYGPNYLCVKMYPNTNKRCSADHKKVLTDPYFA

SEQ ID NO: 32796 - protein, 302 aa, Diabrotica virgifera
  misc_feature: Coding regions on vcDNA: vcDNA=SeqID_12493; Strand=+; Position=61-968
  misc_feature: Homolog annotation: Hit_ID=XP_319663.1; Match level="QueryCoverage =97%, HitCoverage=50%, E-value=7e-69, Identity=46%"; Hit description =ENSANGP00000013878 [Anopheles gambiae]
  misc_feature: Gene Ontology Annotation: Molecular function=gamma-glutamyl transferase activity; Cellular component=integral to plasma membrane; Biological process=spermatogenesis
  misc_feature: Pfam annotation: Pfam_ID=G_glu_transpept; Match level="Score=70.9, E -value=3.5e-18, Copies=1"; Pfam description=Gamma -glutamyltranspeptidase
  misc_feature (278)..(278): Xaa can be any naturally occurring amino acid
  misc_feature (290)..(290): Xaa can be any naturally occurring amino acid
  misc_feature (292)..(292): Xaa can be any naturally occurring amino acid
SILYNKFGGGVPWSALVEPTIKICEEGIEMNELTYNNVRDQIDVVRADPGLREIFINPATNQVYKKGETYKRVKLAQTLRVIAREGGNALHNGSLTKKFVADIKANGGIITAKDLADFKVEFLTPVNTTISGKQIYSVPLPGAGIIMTYILNILENYLPRNDHLSVKTYQRIVEALKYGYAMRSSLGDQDFVPGLDDLITKLSSKRYAADTRKKITDLKTFNEATHYGATFQSIQDHGTANLCVWGPNGDGISLTSSINYILGAGFVSESTGIILNDXMDDFSTPGLVNXYXYPPSPSNFIR

SEQ ID NO: 32797 - protein, 28 aa, Diabrotica virgifera
  misc_feature: Coding regions on vcDNA: vcDNA=SeqID_12494; Strand=-; Position=1-84
  misc_feature (1)..(24): Xaa can be any naturally occurring amino acid
XXXXXXXXXXXXXXXXXXXXXXXXVSRL

SEQ ID NO: 32798 - protein, 75 aa, Diabrotica virgifera
  misc_feature: Coding regions on vcDNA: vcDNA=SeqID_12495; Strand=-; Position=645-872
  misc_feature (26)..(34): Xaa can be any naturally occurring amino acid
  misc_feature (40)..(52): Xaa can be any naturally occurring amino acid
  misc_feature (63)..(71): Xaa can be any naturally occurring amino acid
KGGVKNDGLGGVCVLIKKVNLGAKGXXXXXXXXXMFFHPXXXXXXXXXXXXXLPLARSKFRGXXXXXXXXXSLYI

SEQ ID NO: 32799 - protein, 87 aa, Diabrotica virgifera
  misc_feature: Coding regions on vcDNA: vcDNA=SeqID_12496; Strand=+; Position=1-261
  misc_feature (1)..(56): Xaa can be any naturally occurring amino acid
  misc_feature (58)..(86): Xaa can be any naturally occurring amino acid
XXXXXXXXXXXXXXXXXXXXXXXXXXXXXXXXXXXXXXXXXXXXXXXXXXXXXXXXGXXXXXXXXXXXXXXXXXXXXXXXXXXXXXT

SEQ ID NO: 32800 - protein, 108 aa, Diabrotica virgifera
  misc_feature: Coding regions on vcDNA: vcDNA=SeqID_12497; Strand=-; Position=95-421
  misc_feature (29)..(39): Xaa can be any naturally occurring amino acid
  misc_feature (45)..(51): Xaa can be any naturally occurring amino acid
IITPMIYRYHFSPPQKSQYGSSFFLLGDXXXXXXXXXXXDFLLTXXXXXXXKKVGILFWGGGQLTERGGVFPFPERPRQGVFKGLYNGKFGVGNHMFPLTFRQSSSVC

SEQ ID NO: 32801 - protein, 65 aa, Diabrotica virgifera
  misc_feature: Coding regions on vcDNA: vcDNA=SeqID_12498; Strand=-; Position=376-573
SSPVPTRPIYHQIFNFPPINLLFICGIQTLLCELVIWLCIIRGETHPEGKSTHRHNITFFFSLTC

SEQ ID NO: 32802 - protein, 246 aa, Diabrotica virgifera
  misc_feature: Coding regions on vcDNA: vcDNA=SeqID_12499; Strand=-; Position=1-741
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(246): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32803 - protein, 75 aa, Diabrotica virgifera
  misc_feature: Coding regions on vcDNA: vcDNA=SeqID_12500; Strand=+; Position=294-521
  misc_feature (60)..(66): Xaa can be any naturally occurring amino acid
  misc_feature (69)..(75): Xaa can be any naturally occurring amino acid
CKMYSIVVNISKMVTFANIIYKSDTFALESLILLLVSNELHCYVVVVQKFVVVNVNWLKXXXXXXXLRXXXXXXX

SEQ ID NO: 32804 - protein, 79 aa, Diabrotica virgifera
  misc_feature: Coding regions on vcDNA: vcDNA=SeqID_12501; Strand=+; Position=51-290
PNFIVWKGLKYRFLHFSPFPKCKFSAKSMVMYFGSGEKCKKCVFIVFYTIKFDQNLVLNQNILYNDIFGSLLLKCYVFH

SEQ ID NO: 32805 - protein, 63 aa, Diabrotica virgifera
  misc_feature: Coding regions on vcDNA: vcDNA=SeqID_12502; Strand=-; Position=0-188
  misc_feature (3)..(3): Xaa can be any naturally occurring amino acid
  misc_feature (6)..(60): Xaa can be any naturally occurring amino acid
YFXITXXXXXXXXXXXXXXXXXXXXXXXXXXXXXXXXXXXXXXXXXXXXXXXXXXXXXXXNPS

SEQ ID NO: 32806 - protein, 60 aa, Diabrotica virgifera
  misc_feature: Coding regions on vcDNA: vcDNA=SeqID_12503; Strand=+; Position=53-235
  misc_feature: Homolog annotation: Hit_ID=XP_394301.1; Match level="QueryCoverage =95%, HitCoverage=3%, E-value=1e-10, Identity=50%"; Hit description =similar to RE14504p [Apis mellifera]
MELNNVATNNPSIVRWVTDILNQYNKTAIPPGNLPLNPRGNPKYWNYVWTNFGDYIDISI

SEQ ID NO: 32807 - protein, 61 aa, Diabrotica virgifera
  misc_feature: Coding regions on vcDNA: vcDNA=SeqID_12504; Strand=+; Position=2-184
  misc_feature (13)..(28): Xaa can be any naturally occurring amino acid
  misc_feature (32)..(59): Xaa can be any naturally occurring amino acid
VKKLYIFLQDERXXXXXXXXXXXXXXXXIIYXXXXXXXXXXXXXXXXXXXXXXXXXXXXQF

SEQ ID NO: 32808 - protein, 47 aa, Diabrotica virgifera
  misc_feature: Coding regions on vcDNA: vcDNA=SeqID_12505; Strand=-; Position=1-141
IGQTISYLHDRFVTPSPYYHHCFTEKAILIAPHIRAGGWRRGFRPGP

SEQ ID NO: 32809 - protein, 58 aa, Diabrotica virgifera
  misc_feature: Coding regions on vcDNA: vcDNA=SeqID_12506; Strand=+; Position=425-601
  misc_feature (32)..(47): Xaa can be any naturally occurring amino acid
RYLSLFNSNKYNQGDPTMFCTEQIIQYLLVFXXXXXXXXXXXXXXXXSWIRVPTFLSL

SEQ ID NO: 32810 - protein, 314 aa, Diabrotica virgifera
  misc_feature: Coding regions on vcDNA: vcDNA=SeqID_12507; Strand=+; Position=2-943
  misc_feature (1)..(60): Xaa can be any naturally occurring amino acid
  misc_feature (64)..(284): Xaa can be any naturally occurring amino acid
  misc_feature (301)..(307): Xaa can be any naturally occurring amino acid
XXXXXXXXXXXXXXXXXXXXXXXXXXXXXXXXXXXXXXXXXXXXXXXXXXXXXXXXXXXXVKCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGENKKTKLKLFFKINYXXXXXXXPPHSFFD

SEQ ID NO: 32811 - protein, 233 aa, Diabrotica virgifera
  misc_feature: Coding regions on vcDNA: vcDNA=SeqID_12508; Strand=+; Position=2-703
  misc_feature: Homolog annotation: Hit_ID=AAW56443.1; Match level="QueryCoverage =96%, HitCoverage=89%, E-value=2e-96, Identity=70%"; Hit description =PR-5-like protein [Diaprepes abbreviatus]
  misc_feature: Pfam annotation: Pfam_ID=Thaumatin; Match level="Score=213.5, E-value= 4.3e-61, Copies=1"; Pfam description=Thaumatin family
IGAVSAAEFEFRNREGGPVWVGIQGNPGHPHLEGGGFKLGQGQSRTIGAPDNWAGRFWGRTWCDEGSNHCLTGDCGNRVQCNGAGGVPPASLAEITMKGAGGLDFYDISFVDGYNIAISFEPVGGQGDGGQYSCKRAQCLKHLNDGCPNELKVQGPNGFAIACKSACLAFNTDQYCCRGAFGTPDTCKRSTWPRNYPQDVFKSQCPDAYSYAYDDHKSTFTCKASKYIVQFGV

SEQ ID NO: 32812 - protein, 70 aa, Diabrotica virgifera
  misc_feature: Coding regions on vcDNA: vcDNA=SeqID_12509; Strand=+; Position=3-215
  misc_feature (27)..(38): Xaa can be any naturally occurring amino acid
SHGVRNINYRVVLTLKKEERKEEREEXXXXXXXXXXXXARKEANNNWNGRRNDILLMFEELEMRTRLRFS

SEQ ID NO: 32813 - protein, 77 aa, Diabrotica virgifera
  misc_feature: Coding regions on vcDNA: vcDNA=SeqID_12510; Strand=+; Position=226-459
  misc_feature (52)..(70): Xaa can be any naturally occurring amino acid
QGKSASTTGELPIAYCRYHFLRSKRRQKSDFTVEPLYTVVLANLEVVFLLCXXXXXXXXXXXXXXXXXXXTILKIRY

SEQ ID NO: 32814 - protein, 174 aa, Diabrotica virgifera
  misc_feature: Coding regions on vcDNA: vcDNA=SeqID_12511; Strand=+; Position=62-583
  misc_feature: Homolog annotation: Hit_ID=XP_312606.1; Match level="QueryCoverage =89%, HitCoverage=35%, E-value=2e-25, Identity=40%"; Hit description =ENSANGP00000014953 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=28.2, E -value=1.8e-06, Copies=1"; Pfam description=ab-hydrolase associated lipase region
  misc_feature (27)..(34): Xaa can be any naturally occurring amino acid
  misc_feature (113)..(124): Xaa can be any naturally occurring amino acid
MIFEKTVIVAFCECKYSPRYNVMELTXXXXXXXXLHNVTTEDGYILKIFRIKAINGKEQENREPVLLQHGLLGSSEQFLHAKNNSLALILFNNGFDVWLGNSRGNFHSRKHVXXXXXXXXXXXXYTLDQMGQYDQPAVIDHILKTTGKQQISYIGHSRGGGSLLAMVSGRPEYS

SEQ ID NO: 32815 - protein, 130 aa, Diabrotica virgifera
  misc_feature: Coding regions on vcDNA: vcDNA=SeqID_12512; Strand=-; Position=532-923
  misc_feature: Homolog annotation: Hit_ID=XP_318076.1; Match level="QueryCoverage =100%, HitCoverage=59%, E-value=9e-38, Identity=61%"; Hit description= ENSANGP00000017729 [Anopheles gambiae]
  misc_feature: Gene Ontology Annotation: Molecular function=transporter activity; Cellular component=ER-Golgi transport vesicle membrane; Biological process=ER to Golgi transport
  misc_feature (31)..(31): Xaa can be any naturally occurring amino acid
  misc_feature (37)..(37): Xaa can be any naturally occurring amino acid
  misc_feature (54)..(54): Xaa can be any naturally occurring amino acid
  misc_feature (75)..(75): Xaa can be any naturally occurring amino acid
RETAGKKSHLQPTHLGIYTYCFSNKMSTMTXPKLVMXNMAVGESPKGRTTRRVXNANKLEEMIRELTNFIVWCKXNQEYMQVRDRIHRSINESTNSRVVMWSFFEAVILVAMTVGQVYYLKRFFEVRRVV

SEQ ID NO: 32816 - protein, 167 aa, Diabrotica virgifera
  misc_feature: Coding regions on vcDNA: vcDNA=SeqID_12513; Strand=+; Position=2-505
  misc_feature: Homolog annotation: Hit_ID=EAL27428.1; Match level="QueryCoverage =87%, HitCoverage=86%, E-value=6e-30, Identity=44%"; Hit description =GA15978-PA [Drosophila pseudoobscura]
VRLLKWKKLPEVFLTEYIPTIYTFPRTIQYLQKGKEKSCDVLAERDGVIIIVYNSTRDVLVLVKQFRASAYIQRVSEEDRNKLVDTQKYPAQLGITLEFCAGLVDKSIPSEEIAKEEIFEECGYEVRIDRLEKIGVIRNLSVTTGANLTFYYCEDTDGMKRGHGGGV

SEQ ID NO: 32817 - protein, 268 aa, Diabrotica virgifera
  misc_feature: Coding regions on vcDNA: vcDNA=SeqID_12514; Strand=+; Position=124-930
SYGSIDHAMNINADVEKVINTLSSKFHKIFCDRDFVCCVLEDFQVILRNRNRCCVVVFPLLGRNYLKAVQYQAELFDLVVFTLGSGKNCFVAVCDTKFLIKKEEIEEQIMPNNEEAGTGNNSKKKRPERQLYVPPAQRRLPISELPNGSKTDHGSSPKARKQISTTSRKKELPEKVKAVTETERPSYNEDNIRDAILNQFNEVSNFSYMWWKYELSDPLENEAKSVYFKSFMKKSRLCNLRIRNIYKLETTKSLYILSKNFVLWQPKI

SEQ ID NO: 32818 - protein, 34 aa, Diabrotica virgifera
  misc_feature: Coding regions on vcDNA: vcDNA=SeqID_12515; Strand=+; Position=2-103
  misc_feature (5)..(22): Xaa can be any naturally occurring amino acid
  misc_feature (30)..(30): Xaa can be any naturally occurring amino acid
EWKGXXXXXXXXXXXXXXXXXXLKSFKFFXKTRD

SEQ ID NO: 32819 - protein, 145 aa, Diabrotica virgifera
  misc_feature: Coding regions on vcDNA: vcDNA=SeqID_12516; Strand=+; Position=1-438
  misc_feature (1)..(122): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNDKLVKKYLDDYKNSINKLYIE

SEQ ID NO: 32820 - protein, 54 aa, Diabrotica virgifera
  misc_feature: Coding regions on vcDNA: vcDNA=SeqID_12517; Strand=-; Position=1-162
  misc_feature (3)..(50): Xaa can be any naturally occurring amino acid
KNXXXXXXXXXXXXXXXXXXXXXXXXXXXXXXXXXXXXXXXXXXXXXXXXVSRL

SEQ ID NO: 32821 - protein, 115 aa, Diabrotica virgifera
  misc_feature: Coding regions on vcDNA: vcDNA=SeqID_12518; Strand=+; Position=3-350
  misc_feature (1)..(35): Xaa can be any naturally occurring amino acid
  misc_feature (44)..(66): Xaa can be any naturally occurring amino acid
  misc_feature (69)..(79): Xaa can be any naturally occurring amino acid
XXXXXXXXXXXXXXXXXXXXXXXXXXXXXXXXXXXFFSFPLSRXXXXXXXXXXXXXXXXXXXXXXXGGXXXXXXXXXXXLSFCPLRIPPQVSDCPLIKKNARPTLTPLRENNQKR

SEQ ID NO: 32822 - protein, 182 aa, Diabrotica virgifera
  misc_feature: Coding regions on vcDNA: vcDNA=SeqID_12519; Strand=-; Position=1-546
  misc_feature (36)..(53): Xaa can be any naturally occurring amino acid
  misc_feature (55)..(182): Xaa can be any naturally occurring amino acid
KLLLVHTCISILVYTSAGPLYNLVGIYVIVKLYSIXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32823 - protein, 23 aa, Diabrotica virgifera
  misc_feature: Coding regions on vcDNA: vcDNA=SeqID_12520; Strand=-; Position=1-69
  misc_feature (3)..(13): Xaa can be any naturally occurring amino acid
  misc_feature (18)..(18): Xaa can be any naturally occurring amino acid
  misc_feature (21)..(21): Xaa can be any naturally occurring amino acid
KKXXXXXXXXXXXVSRLXKKXKL

SEQ ID NO: 32824 - protein, 38 aa, Diabrotica virgifera
  misc_feature: Coding regions on vcDNA: vcDNA=SeqID_12521; Strand=-; Position=2-115
  misc_feature (17)..(37): Xaa can be any naturally occurring amino acid
ITPFFLKVIFFLLSKKXXXXXXXXXXXXXXXXXXXXXP

SEQ ID NO: 32825 - protein, 109 aa, Diabrotica virgifera
  misc_feature: Coding regions on vcDNA: vcDNA=SeqID_12522; Strand=+; Position=15-344
  misc_feature (1)..(9): Xaa can be any naturally occurring amino acid
  misc_feature (11)..(23): Xaa can be any naturally occurring amino acid
XXXXXXXXXKXXXXXXXXXXXXXCYILVVCGSDPSFGSNSDLFSLILSVNWISPNSTSITLDSGFSESSFSPNSSFTTLPLEDSSTTRSSTSCTSLEPSRIFPPRSRFS

SEQ ID NO: 32826 - protein, 148 aa, Diabrotica virgifera
  misc_feature: Coding regions on vcDNA: vcDNA=SeqID_12523; Strand=+; Position=32-478
  misc_feature: Homolog annotation: Hit_ID=XP_396160.1; Match level="QueryCoverage =84%, HitCoverage=19%, E-value=8e-29, Identity=49%"; Hit description =similar to ENSANGP00000013353 [Apis mellifera]
  misc_feature (50)..(68): Xaa can be any naturally occurring amino acid
  misc_feature (73)..(78): Xaa can be any naturally occurring amino acid
MGDYVWVDTRNPWDFPGNAVRGGTDANGDEIYVGKALHQGDWLPAKVIPXXXXXXXXXXXXXXXXXXXQVMCXXXXXXTWVPCKGNNIPSNAVEGGETADGEPLYVGRVIHRSSQTVGKVHPSHSVCYIPFGGRELNFGNYEILVKRN

SEQ ID NO: 32827 - protein, 18 aa, Diabrotica virgifera
  misc_feature: Coding regions on vcDNA: vcDNA=SeqID_12524; Strand=-; Position=0-53
  misc_feature (7)..(16): Xaa can be any naturally occurring amino acid
AGDTLYXXXXXXXXXXQG

SEQ ID NO: 32828 - protein, 62 aa, Diabrotica virgifera
  misc_feature: Coding regions on vcDNA: vcDNA=SeqID_12525; Strand=-; Position=154-342
DRKETLYGSFLLNLKQSQTLAKAIKETTRPPLELAVTVTHLRTSQSRSCETASEKILESSNV

SEQ ID NO: 32829 - protein, 103 aa, Diabrotica virgifera
  misc_feature: Coding regions on vcDNA: vcDNA=SeqID_12526; Strand=+; Position=49-360
  misc_feature (20)..(31): Xaa can be any naturally occurring amino acid
LLCMVEAFGSFLGEPIHLKXXXXXXXXXXXXFYDSQSIAEIMLTLYLQLSPLSDLPMGCPPHPNCSPLPPYSIHLAWRFFSGLTGWTTLFFGPKPDDPLINFP

SEQ ID NO: 32830 - protein, 67 aa, Diabrotica virgifera
  misc_feature: Coding regions on vcDNA: vcDNA=SeqID_12527; Strand=+; Position=348-551
AKDMMLQTSVGYPCCEGLIQQKIFDSNSYIRLLHQFTYQTLKIFLLILVLNPSFGYTVRCLLAGKKR

SEQ ID NO: 32831 - protein, 195 aa, Diabrotica virgifera
  misc_feature: Coding regions on vcDNA: vcDNA=SeqID_12528; Strand=+; Position=254-838
  misc_feature: Homolog annotation: Hit_ID=EAL32670.1; Match level="QueryCoverage =94%, HitCoverage=81%, E-value=5e-49, Identity=51%"; Hit description =GA21505-PA [Drosophila pseudoobscura]
  misc_feature: Pfam annotation: Pfam_ID=EMP24_GP25L; Match level="Score=68.0, E -value=2.7e-17, Copies=1"; Pfam description=emp24/gp25L/p24 family
  misc_feature (183)..(183): Xaa can be any naturally occurring amino acid
MNYFLLYIFLFILHQVNSLEKEITVYVEAGTESCFYQPIKKGEIVDLDYQVIDGGHGDLDINFNLVHPNGRILLTDFKKSENTHRLDAEVEGDYRFCFDNSFSSYNTKTVFFELIVEGDDNGEWSSENMKFNTEDEDFEAQISDVQKIVSTVRIHLTKIRYLQELIKSSEARDRNIAEDNFFXVNSYSMGTVVPD

SEQ ID NO: 32832 - protein, 43 aa, Diabrotica virgifera
  misc_feature: Coding regions on vcDNA: vcDNA=SeqID_12529; Strand=-; Position=3-131
  misc_feature (10)..(23): Xaa can be any naturally occurring amino acid
  misc_feature (30)..(42): Xaa can be any naturally occurring amino acid
RSSKILKVEXXXXXXXXXXXXXXSNIEVAXXXXXXXXXXXXXC

SEQ ID NO: 32833 - protein, 74 aa, Diabrotica virgifera
  misc_feature: Coding regions on vcDNA: vcDNA=SeqID_12530; Strand=-; Position=193-417
SYSLTASPQHTFHHWLFAHLGCGIYINVIPSITSQNPPVTYIVIVVIRGDKMSSDILSLMFLIVWYTPHIGTHQ

SEQ ID NO: 32834 - protein, 266 aa, Diabrotica virgifera
  misc_feature: Coding regions on vcDNA: vcDNA=SeqID_12531; Strand=+; Position=95-896
  misc_feature: Homolog annotation: Hit_ID=XP_392012.1; Match level="QueryCoverage =100%, HitCoverage=69%, E-value=1e-31, Identity=33%"; Hit description= similar to Nuclear autoantigenic sperm protein (histone-binding) [Apis mellifera]
  misc_feature: Gene Ontology Annotation: Molecular function=histone binding; Cellular component=nucleus; Biological process=spermatogenesis
  misc_feature: Pfam annotation: Pfam_ID=TPR_2; Match level="Score=23.3, E-value =0.00076, Copies=2"; Pfam description=Tetratricopeptide repeat
  misc_feature (61)..(80): Xaa can be any naturally occurring amino acid
  misc_feature (251)..(251): Xaa can be any naturally occurring amino acid
MADVVVDAESKNSKELYGQGVRAFILRDFSTAVSALGKASQLLADEHGDDLHESLGEVYLXXXXXXXXXXXXXXXXXXXXVPRNEESSEEDNADETEENDEEGENSTEPQENNENEAKEAEKSDDAKKTDDAKQSDGEKQNGTTVANGSGEGTSNGITKEDGADEDTAAETEDEPTDLQVAWEVLELAKKIFQKQGTAAKKNLAETLIVLGEVSLESENFESAVNDITEGLKIQKDIFAKDSRTVAETYYXLGVAYSTNTQIDESL

SEQ ID NO: 32835 - protein, 25 aa, Diabrotica virgifera
  misc_feature: Coding regions on vcDNA: vcDNA=SeqID_12532; Strand=-; Position=3-77
  misc_feature (4)..(25): Xaa can be any naturally occurring amino acid
INNXXXXXXXXXXXXXXXXXXXXXX

SEQ ID NO: 32836 - protein, 101 aa, Diabrotica virgifera
  misc_feature: Coding regions on vcDNA: vcDNA=SeqID_12533; Strand=+; Position=3-308
  misc_feature: Homolog annotation: Hit_ID=XP_322024.1; Match level="QueryCoverage =97%, HitCoverage=38%, E-value=1e-25, Identity=59%"; Hit description =ENSANGP00000012069 [Anopheles gambiae]
  misc_feature (31)..(31): Xaa can be any naturally occurring amino acid
  misc_feature (37)..(37): Xaa can be any naturally occurring amino acid
QISDEEKAQKSMEGQTLLVEAKRENVALQSXALMRRXCNWPLTEVKKRLDYQVEKQNIERRITQKNLVDYVVAKVRSSITADQEKQNINKCISDLAGLAKA

SEQ ID NO: 32837 - protein, 257 aa, Diabrotica virgifera
  misc_feature: Coding regions on vcDNA: vcDNA=SeqID_12534; Strand=+; Position=75-848
  misc_feature: Homolog annotation: Hit_ID=XP_393366.1; Match level="QueryCoverage =79%, HitCoverage=77%, E-value=4e-44, Identity=46%"; Hit description =similar to ENSANGP00000020267 [Apis mellifera]
  misc_feature (185)..(196): Xaa can be any naturally occurring amino acid
MSIFGPLMGDMEDDPFFGCHMRHMRQMSNMMNSLFSDPFSMLRPPMLGYDDYENRALTSRHNMHNSLMSPFSMPIMPNFNRLLSGSLDSMANTGNYHSSNTGNYHSSSTVISMTSGPDGRQQVYKATSSTRVAPGGVKETQKTVTDSMTGTKKMSIGHHIGERAHIIEKEQNIHTGERVESEDLXXXXXXXXXXXXNEWESKTRRSEIPRITAGSSRNRHGSYIHSSIPAITAGSSAAGRHPYSSPNQPQQPKKSNH

SEQ ID NO: 32838 - protein, 71 aa, Diabrotica virgifera
  misc_feature: Coding regions on vcDNA: vcDNA=SeqID_12535; Strand=-; Position=121-336
  misc_feature (11)..(20): Xaa can be any naturally occurring amino acid
  misc_feature (55)..(63): Xaa can be any naturally occurring amino acid
CISLNRFTEFXXXXXXXXXXKYAQISSELLNIITFLSFIHKIYQHHSRNKKQAEXXXXXXXXXNNGQCFIQ

SEQ ID NO: 32839 - protein, 191 aa, Diabrotica virgifera
  misc_feature: Coding regions on vcDNA: vcDNA=SeqID_12536; Strand=+; Position=355-930
  misc_feature: Homolog annotation: Hit_ID=AAK14815.1; Match level="QueryCoverage =95%, HitCoverage=17%, E-value=4e-13, Identity=28%"; Hit description =polyprotein [Schistosoma japonicum]
  misc_feature (142)..(142): Xaa can be any naturally occurring amino acid
IFFPIICVSNDSVVSEKEIFFQTLHQEISKIGDTREIIILGDINSRTGKMENNNIIGPFGEEIVNDNGERLIDLCDQLQLRINNGYFNHKEVHKYTWTQPTRNLRSIIDYAILKQQTLLKVEDIRVCRGICNISDHHFLRAXIFFPIRHTITKTKTIPDADKNTNITDEKYNFRELLHKCNISQRDSTMTY

SEQ ID NO: 32840 - protein, 90 aa, Diabrotica virgifera
  misc_feature: Coding regions on vcDNA: vcDNA=SeqID_12537; Strand=+; Position=137-407
  misc_feature (52)..(52): Xaa can be any naturally occurring amino acid
EEQIYGTKNLFKNKRKNNDVTNDHERERFLQRVLLDFLAVNALDDEAYKYAXRYLYIAQWYKEDVSDKALLNMGAWKNISFREHNHRSNR

SEQ ID NO: 32841 - protein, 290 aa, Diabrotica virgifera
  misc_feature: Coding regions on vcDNA: vcDNA=SeqID_12538; Strand=+; Position=15-884
  misc_feature: Homolog annotation: Hit_ID=CAA35618.1; Match level="QueryCoverage =90%, HitCoverage=82%, E-value=3e-47, Identity=35%"; Hit description =unnamed protein product [Mus musculus] pir||A37107 spermatogenesis protein Zfp-35 - mouse sp|P15620|ZF35_M
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=125.5, E-value =1.3e-34, Copies=7"; Pfam description=Zinc finger, C2H2 type
  misc_feature (94)..(100): Xaa can be any naturally occurring amino acid
  misc_feature (156)..(162): Xaa can be any naturally occurring amino acid
  misc_feature (164)..(170): Xaa can be any naturally occurring amino acid
  misc_feature (184)..(190): Xaa can be any naturally occurring amino acid
  misc_feature (240)..(246): Xaa can be any naturally occurring amino acid
  misc_feature (248)..(255): Xaa can be any naturally occurring amino acid
  misc_feature (268)..(282): Xaa can be any naturally occurring amino acid
RVHTEKHLRVHTEDSPYKCEFCFKQFGEARGLKRHLILHSGEKPHECEICSMQFYRLFDVKKHMRSHTGEKPHKCETCLKQFITSSNRSRHLKXXXXXXXHECETCFKQFITMSELKKHLRVHTGEKPHTGEKPHKCETCLKQFTTKRDLKRHLRXXXXXXXYXXXXXXXPFSWSGDLKVHLRXXXXXXXHKCDTCLKQFFTISHLNAHLGTHSLEKSNKCKICFKQFSTTSVLYRHLRXXXXXXXYXXXXXXXXFAQTSELKKHLRXXXXXXXXXXXXXXXQFADDSSL

SEQ ID NO: 32842 - protein, 296 aa, Diabrotica virgifera
  misc_feature: Coding regions on vcDNA: vcDNA=SeqID_12539; Strand=+; Position=3-893
IDKIAEASLHLRLQDGNIYVLPGEKGGIQTTISKYAWKIAGLNVEILEPLRKLRITFNGLLKNQSCTDFEKVEHIQFNFIYTAICSPHFFPQDIDTALFAKAVASDHWRDGSWRNNMIHQYGYEQLGTIKGFVKGDSYPVENILNLPGNRSRTKGISDRFLLKRALRLIVIDEYGSIFNIILKVLPEGNFQLNYGFALLSNERRYPITDIDLQMRHVGEHKTFPDCIKSRVKVNGKTYKIVVYLNKQKIISSSYTEYGYEYYTIPACHVDLYSGNGLVEDAIRGEKVFIPPQMFKN

SEQ ID NO: 32843 - protein, 101 aa, Diabrotica virgifera
  misc_feature: Coding regions on vcDNA: vcDNA=SeqID_12540; Strand=+; Position=1-306
VSDSSTATFNNSFPGLKSKWTLSNSQPVETDSMSQMSGQSYASAMGTRRQFSSAMGNRGSQRESSNNSNNGDTSDSNTDYFNSQSFPALGRGRGMARNRRN

SEQ ID NO: 32844 - protein, 101 aa, Diabrotica virgifera
  misc_feature: Coding regions on vcDNA: vcDNA=SeqID_12541; Strand=-; Position=231-533
  misc_feature (75)..(81): Xaa can be any naturally occurring amino acid
LPPHNSTTLPNSQPFKPIHIPPILPTTNTSHSTKQHHPTLQPNPPFPTTPPQLNHIYPIKTKPPPKQNSHPKNTXXXXXXXHQTTTPPTENPTKPPKTALI

SEQ ID NO: 32845 - protein, 33 aa, Diabrotica virgifera
  misc_feature: Coding regions on vcDNA: vcDNA=SeqID_12542; Strand=-; Position=1-99
  misc_feature (1)..(13): Xaa can be any naturally occurring amino acid
  misc_feature (16)..(33): Xaa can be any naturally occurring amino acid
XXXXXXXXXXXXXYLXXXXXXXXXXXXXXXXXX

SEQ ID NO: 32846 - protein, 100 aa, Diabrotica virgifera; identical to SEQ ID NO: 29597
  misc_feature: Coding regions on vcDNA: vcDNA=SeqID_12543; Strand=-; Position=1-300
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(100): Xaa can be any naturally occurring amino acid

SEQ ID NO: 32847 - protein, 156 aa, Diabrotica virgifera
  misc_feature: Coding regions on vcDNA: vcDNA=SeqID_12544; Strand=+; Position=349-818
  misc_feature: Homolog annotation: Hit_ID=NP_728821.2; Match level="QueryCoverage =98%, HitCoverage=33%, E-value=2e-40, Identity=50%"; Hit description =CG32281-PA [Drosophila melanogaster] gb|AAN11538.2| CG32281-PA [Drosophila melanogaster]
  misc_feature: Gene Ontology Annotation: Molecular function=tRNA (guanine) methyltransferase activity; Cellular component=cytoplasm; Biological process=tRNA methylation
  misc_feature: Pfam annotation: Pfam_ID=Met_10; Match level="Score=-109.0, E-value =0.019, Copies=1"; Pfam description=Met-10+ like-protein
  misc_feature (147)..(147): Xaa can be any naturally occurring amino acid
TGLPDEVKTSLEEVHITEDDLKTKHVELTYDNFSAEDLLKAVLPTEKDGLSSFSQMGHIVHINLIEHLFPFKSIIADILYDKIPGCKSVVNKINVIDNTYRNFSMEVLKGDNNMITTVKENTCSFKFDFSKVYWNSRLCTEHERTVXKINSSDVLF

SEQ ID NO: 32848 - protein, 120 aa, Diabrotica virgifera
  misc_feature: Coding regions on vcDNA: vcDNA=SeqID_12545; Strand=+; Position=421-783
ILALKDSLQQSAFIAVAHYEAEILFLLLMVYFTSLSFPILRNTVALVIMSADDILMIRLHSLISKASSCFSIASYREQYMINNEDFLWTSKRRKYRVGGGKSTDGGKERPYVFSALLLCC

SEQ ID NO: 32849 - protein, 34 aa, Diabrotica virgifera; identical to SEQ ID NO: 27603
  misc_feature: Coding regions on vcDNA: vcDNA=SeqID_12546; Strand=-; Position=80-184

SEQ ID NO: 32850 - protein, 286 aa, Diabrotica virgifera
  misc_feature: Coding regions on vcDNA: vcDNA=SeqID_12547; Strand=+; Position=33-893
  misc_feature: Homolog annotation: Hit_ID=EAL26913.1; Match level="QueryCoverage =94%, HitCoverage=98%, E-value=2e-53, Identity=43%"; Hit description =GA19292-PA [Drosophila pseudoobscura]
  misc_feature: Gene Ontology Annotation: Molecular function=pyrroline 5-carboxylate reductase activity; Cellular component=cytoplasm; Biological process= proline biosynthesis
  misc_feature: Pfam annotation: Pfam_ID=P5CR; Match level="Score=235.9, E-value=7.3e- 68, Copies=1"; Pfam description=Delta 1-pyrroline-5-carboxylate reduc
  misc_feature (239)..(239): Xaa can be any naturally occurring amino acid
MSLTTNVPELTEKIGFIGGGKMAKAICEGIVNKGLVSYQQVYVSSTVLENLSWWKEKGCYVFQEIRFVTPNVDVIFICVKPEFEFVLNQIYNIPACRELFAPKLYLSFMAGISLNWLDNKLNTSKRERIVRIMTNTPMTVGEGCSLFSGKGATKDDMKLVNKLLSATGTCKQVPEYILNAAEALIASGPAFIYMAIEALADGAVKMGVPMDLATELAAQMTLGAAKIARDSGKHTGQLXGEVCFPGGTTIQGVHALTRGGMRAAFIDAVKCASKPADHLRDNKSFF

SEQ ID NO: 32851 - protein, 78 aa, Diabrotica virgifera
  misc_feature: Coding regions on vcDNA: vcDNA=SeqID_12548; Strand=-; Position=49-285
AVDADLRSSSASAAYFSMKDREGDNRAVTSFYTMISLAVEYSWHLLACTIVNEFLHGIFSYSTEGYLILRSKFLLLGY

SEQ ID NO: 32852 - protein, 86 aa, Diabrotica virgifera
  misc_feature: Coding regions on vcDNA: vcDNA=SeqID_12549; Strand=+; Position=224-484
  misc_feature (38)..(44): Xaa can be any naturally occurring amino acid
NAQVPSLVQHQQIHRATRIEQLHSKNCFTKLTDYLRHXXXXXXXTEIITYFRMILDFSEPTRVQVNHTRKIRIITLKKSFVKIKSS

SEQ ID NO: 32853 - protein, 55 aa, Diabrotica virgifera
  misc_feature: Coding regions on vcDNA: vcDNA=SeqID_12550; Strand=+; Position=1-165
  misc_feature (1)..(54): Xaa can be any naturally occurring amino acid
XXXXXXXXXXXXXXXXXXXXXXXXXXXXXXXXXXXXXXXXXXXXXXXXXXXXXXL

SEQ ID NO: 32854 - protein, 313 aa, Diabrotica virgifera
  misc_feature: Coding regions on vcDNA: vcDNA=SeqID_12551; Strand=-; Position=0-938
  misc_feature (2)..(45): Xaa can be any naturally occurring amino acid
  misc_feature (48)..(311): Xaa can be any naturally occurring amino acid
TXXXXXXXXXXXXXXXXXXXXXXXXXXXXXXXXXXXXXXXXXXXXINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEG

SEQ ID NO: 32855 - protein, 80 aa, Diabrotica virgifera
  misc_feature: Coding regions on vcDNA: vcDNA=SeqID_12552; Strand=-; Position=64-306
  misc_feature (72)..(80): Xaa can be any naturally occurring amino acid
SQSPTCSFRQDFLTWITFLPSLIGQSDPYPSILYVGLKSYTWCIIYIIKYSSTFKILHDVSLQRCEPGWFLXXXXXXXXX

SEQ ID NO: 32856 - protein, 38 aa, Diabrotica virgifera
  misc_feature: Coding regions on vcDNA: vcDNA=SeqID_12553; Strand=-; Position=1-114
VKISLDYFFHGFVLSFGVSRRGQLFHLFFGFLFSLKSS

SEQ ID NO: 32857 - protein, 67 aa, Diabrotica virgifera
  misc_feature: Coding regions on vcDNA: vcDNA=SeqID_12554; Strand=-; Position=1-201
NRNSKTINKKYYLRVLGTDKLIYKVLSKYLSSGFASCHFITIFNRKTWRALCISFSCIFFNITSCFF

SEQ ID NO: 32858 - protein, 197 aa, Diabrotica virgifera
  misc_feature: Coding regions on vcDNA: vcDNA=SeqID_12555; Strand=+; Position=276-865
  misc_feature: Homolog annotation: Hit_ID=XP_309022.1; Match level="QueryCoverage =72%, HitCoverage=34%, E-value=6e-26, Identity=40%"; Hit description =ENSANGP00000005847 [Anopheles gambiae]
  misc_feature (165)..(165): Xaa can be any naturally occurring amino acid
  misc_feature (189)..(189): Xaa can be any naturally occurring amino acid
TSYDDLKSSSNFLKSLITIISKQCYFWLSGFRTSPSISHSKKLFIHSKGLSALGNLTPIYKSGNRECVNTYRGITIQSAIPKLLDKLVSINLTWACRNIIIDEQHGFSNGKSTVTNLVNYQQYLLGGFENKIQVDSIYTDFSKAFDRVNHNLLVHKLHASGFGDXIVNWIKSFLMGHTEQVRINNYVFXEFHCCSGV

SEQ ID NO: 32859 - protein, 160 aa, Diabrotica virgifera
  misc_feature: Coding regions on vcDNA: vcDNA=SeqID_12556; Strand=-; Position=148-630
  misc_feature (33)..(52): Xaa can be any naturally occurring amino acid
  misc_feature (64)..(73): Xaa can be any naturally occurring amino acid
  misc_feature (75)..(82): Xaa can be any naturally occurring amino acid
  misc_feature (98)..(120): Xaa can be any naturally occurring amino acid
  misc_feature (122)..(128): Xaa can be any naturally occurring amino acid
  misc_feature (131)..(156): Xaa can be any naturally occurring amino acid
GKKFWGGKKFSRGKGKKKFPRGNFKTHPFFCNXXXXXXXXXXXXXXXXXXXXPFFNLSPKGATXXXXXXXXXXKXXXXXXXXLLRGKGGVFPQIFGLXXXXXXXXXXXXXXXXXXXXXXXKXXXXXXXPFXXXXXXXXXXXXXXXXXXXXXXXXXXKRGS

SEQ ID NO: 32860 - protein, 227 aa, Diabrotica virgifera
  misc_feature: Coding regions on vcDNA: vcDNA=SeqID_12557; Strand=+; Position=187-865
  misc_feature: Homolog annotation: Hit_ID=XP_392811.1; Match level="QueryCoverage =79%, HitCoverage=50%, E-value=4e-88, Identity=88%"; Hit description =similar to ENSANGP00000023556 [Apis mellifera]
  misc_feature: Gene Ontology Annotation: Molecular function=isocitrate dehydrogenase (NAD+) activity; Cellular component=mitochondrion; Biological process= carbohydrate metabolism
  misc_feature: Pfam annotation: Pfam_ID=Iso_dh; Match level="Score=-17.6, E-value =1.1e-11, Copies=1"; Pfam description=Isocitrate/isopropylmalate dehydrogen
  misc_feature (105)..(105): Xaa can be any naturally occurring amino acid
  misc_feature (191)..(191): Xaa can be any naturally occurring amino acid
  misc_feature (216)..(216): Xaa can be any naturally occurring amino acid
MRLFTNLSNIKTETSIWTKLINYFNRTPSNRQPNEIDLSTSQALGSRLFSSEVKKCTLIPGDGIGPEISAAVQKIFQTASVPIEWESVDVTPVRGPDGKFGIPQXAIDSVNKNKIGLKGPLMTPVGKGHRSLNLALRKEFNLYANVRPCRSLEGYKTLYDHVDVVTIRENTEGEYSGIEHEIVDGVVQSIXLITEDASRSVAEFAFQYAKKNNRKXVTAVHKANIMR

SEQ ID NO: 32861 - protein, 210 aa, Diabrotica virgifera
  misc_feature: Coding regions on vcDNA: vcDNA=SeqID_12558; Strand=-; Position=189-821
  misc_feature (4)..(190): Xaa can be any naturally occurring amino acid
KKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITFHYKKTRYNSYRSIKRRI

SEQ ID NO: 32862 - protein, 78 aa, Diabrotica virgifera
  misc_feature: Coding regions on vcDNA: vcDNA=SeqID_12559; Strand=+; Position=18-254
  misc_feature: Homolog annotation: Hit_ID=NP_648163.1; Match level="QueryCoverage =98%, HitCoverage=100%, E-value=1e-19, Identity=53%"; Hit description= CG8268-PA [Drosophila melanogaster] gb|AAF50504.1| CG8268-PA [Drosophila melanogaster]
  misc_feature: Pfam annotation: Pfam_ID=SRP9; Match level="Score=152.5, E-value=9.8e- 43, Copies=1"; Pfam description=Signal recognition particle 9 kDa prot
MTYLKSWEEFEKAAEKLYLQSPSKVRYTMKYAHSKNHLILKMTDDVVCLQFKTEIAQDVRKVDKFVNNLLRHMVSKEH

SEQ ID NO: 32863 - protein, 282 aa, Diabrotica virgifera
  misc_feature: Coding regions on vcDNA: vcDNA=SeqID_12560; Strand=+; Position=3-850
  misc_feature: Homolog annotation: Hit_ID=EAL33698.1; Match level="QueryCoverage =100%, HitCoverage=98%, E-value=1e-106, Identity=69%"; Hit description=GA20091-PA [Drosophila pseudoobscura]
  misc_feature: Gene Ontology Annotation: Molecular function=molecular_function unknown; Cellular component=Golgi apparatus; Biological process =locomotory behavior
  misc_feature: Pfam annotation: Pfam_ID=GPP34; Match level="Score=503.7, E-value =1.7e-148, Copies=1"; Pfam description=Golgi phosphoprotein 3 (GPP34)
  misc_feature (90)..(100): Xaa can be any naturally occurring amino acid
  misc_feature (174)..(183): Xaa can be any naturally occurring amino acid
  misc_feature (255)..(255): Xaa can be any naturally occurring amino acid
SEGFVKRRNVTRENSEGLNKEEQNNDKKSSRDEDIDDGDSKETRLTLMEEVLLLGLKDKEGYTSFWNDCISSGLRGCILIELGLRGRVEXXXXXXXXXXXLARKLIIKSDTPIGDVLLDEALKHLKETEPPETVQSWIEYLSGETWNPLKLRYQLKNVRERLAKNLVEKGVLTXXXXXXXXXXMTTHPLTDNVTKSRLIKKIQDAVLSKWVNNPQQMDKRMLALIFLAHASDVLENAFAPLNDDDYELATKRVRXLLDLNFEEEANKQTSDGVCGCFRCFTK

SEQ ID NO: 32864 - protein, 85 aa, Diabrotica virgifera
  misc_feature: Coding regions on vcDNA: vcDNA=SeqID_12561; Strand=-; Position=177-434
VAVVLAFRPTGERGTAARRHQIGTPMVLPIIDLCIEVSNKFTLIVTIDAKTCHIPASVTSDPLAPQTHFLLYRNRISFNLYRYML

SEQ ID NO: 32865 - protein, 66 aa, Diabrotica virgifera
  misc_feature: Coding regions on vcDNA: vcDNA=SeqID_12562; Strand=-; Position=182-382
  misc_feature (12)..(23): Xaa can be any naturally occurring amino acid
  misc_feature (32)..(55): Xaa can be any naturally occurring amino acid
STHYKFYIHSFXXXXXXXXXXXXNFTINFINXXXXXXXXXXXXXXXXXXXXXXXXRYTRIYYILCK

SEQ ID NO: 32866 - protein, 206 aa, Diabrotica virgifera
  misc_feature: Coding regions on vcDNA: vcDNA=SeqID_12563; Strand=+; Position=3-620
  misc_feature: Homolog annotation: Hit_ID=NP_608336.1; Match level="QueryCoverage =96%, HitCoverage=62%, E-value=2e-41, Identity=40%"; Hit description =CG12237-PA [Drosophila melanogaster] gb|AAF48992.1| CG12237-PA [Drosophila melanogaster]
  misc_feature: Pfam annotation: Pfam_ID=Put_Phosphatase; Match level="Score=150.7, E- value=3.3e-42, Copies=1"; Pfam description=Putative Phosphatase
RSDGWTAYMQGIFNLLHQTGITEDRIRKTIEALTEVQGMCRLIRELSEDLNYDVIIVSDSNSYFIETWLAVNKLQDNVLKVFSNPAKFDKNGLLVISMYHLQETCKLSTKNMCKGQIMQDFITKMKKQGTNYEKVVYCGDGMNDFCPMLRLNETDLACVRKGFKCEDIIRKSKEGTYKDALGITRVVNCEVLYWNNGDDNLTHASG

SEQ ID NO: 32867 - protein, 86 aa, Diabrotica virgifera
  misc_feature: Coding regions on vcDNA: vcDNA=SeqID_12564; Strand=-; Position=1-258
  misc_feature (22)..(30): Xaa can be any naturally occurring amino acid
LIQNLFSENLYMPQCGMSYQTXXXXXXXXXEFTRRLFFLQLSTFSHIEIQLYLAFLKLGTHMRAELYASTSHTVPLAFLKLGTHMR

SEQ ID NO: 32868 - protein, 293 aa, Diabrotica virgifera
  misc_feature: Coding regions on vcDNA: vcDNA=SeqID_12565; Strand=+; Position=3-884
  misc_feature (1)..(256): Xaa can be any naturally occurring amino acid
  misc_feature (258)..(270): Xaa can be any naturally occurring amino acid
  misc_feature (282)..(290): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXCDLDVGLKLIIXXXXXXXXXFDF

SEQ ID NO: 32869 - protein, 266 aa, Diabrotica virgifera
  misc_feature: Coding regions on vcDNA: vcDNA=SeqID_12566; Strand=+; Position=129-926
MDQIKQTNNKTDELQGAEPGSLSSIACKESEENTGINTERDAENPLQETAVENQDFSPELNASKCDEKDTTTGPSEINSTADTLDIRTDPNEINSTSNTLDMDISKSKDELLSTTSEEISTTNQLDIVKKAEPVVPVHMRSSLQHILQYNSDDSEDEDIQTPLKPALASSSSSSDSESDIQEVDNAEEDEDVDEFVLSNDRRKTKVTSNPDCELLDPSLLVNLTNLKIDYEKEEFTHIGNIANFIDTTVTVEAYREVRIIRYGIQF

SEQ ID NO: 32870 - protein, 59 aa, Diabrotica virgifera
  misc_feature: Coding regions on vcDNA: vcDNA=SeqID_12567; Strand=-; Position=0-176
  misc_feature (1)..(25): Xaa can be any naturally occurring amino acid
  misc_feature (28)..(57): Xaa can be any naturally occurring amino acid
XXXXXXXXXXXXXXXXXXXXXXXXXVSXXXXXXXXXXXXXXXXXXXXXXXXXXXXXXIP

SEQ ID NO: 32871 - protein, 51 aa, Diabrotica virgifera
  misc_feature: Coding regions on vcDNA: vcDNA=SeqID_12568; Strand=+; Position=329-484
  misc_feature (26)..(36): Xaa can be any naturally occurring amino acid
  misc_feature (44)..(51): Xaa can be any naturally occurring amino acid
EYFTLFIQYRVFRNYNVDANQELCDXXXXXXXXXXXDSTKDIIXXXXXXXX

SEQ ID NO: 32872 - protein, 220 aa, Diabrotica virgifera
  misc_feature: Coding regions on vcDNA: vcDNA=SeqID_12569; Strand=+; Position=55-714
  misc_feature: Homolog annotation: Hit_ID=XP_317786.1; Match level="QueryCoverage =98%, HitCoverage=71%, E-value=2e-46, Identity=40%"; Hit description =ENSANGP00000022197 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=-28.7, E-value =0.042, Copies=1"; Pfam description=Major Facilitator Superfamily
MKYIQQRYVLGFMGFLASVIAYTLRVCLNIAITKMVLYRENAHIDPDACPDEDSNHQILTEEVPTNLYHWDETTKGIILSSFFWGYAVSHIPGGLLAQKFGGKNSLGLSILCSSVLTLMTPWVIVTTNGNWIILVVWRSIIGLAQGVMHPALNNLLSKWIPLSERAKIGTLVFAGGQIGTISSNLINETLVNATGTWTSVVYLLGAGAIICDIFRVIFCY

SEQ ID NO: 32873 - protein, 88 aa, Diabrotica virgifera
  misc_feature: Coding regions on vcDNA: vcDNA=SeqID_12570; Strand=-; Position=1-264
  misc_feature (11)..(88): Xaa can be any naturally occurring amino acid
LFLFNQKKIGXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32874 - protein, 119 aa, Diabrotica virgifera
  misc_feature: Coding regions on vcDNA: vcDNA=SeqID_12571; Strand=+; Position=12-368
  misc_feature (12)..(17): Xaa can be any naturally occurring amino acid
  misc_feature (48)..(56): Xaa can be any naturally occurring amino acid
  misc_feature (86)..(119): Xaa can be any naturally occurring amino acid
NLDYFSELVKNXXXXXXKLSISDRIFYMLSKRNLFSAPLGITDDYLLXXXXXXXXXQDLTHYNFYWKTSILNNLFALNCDSIVHIXXXXXXXXXXXXXXXXXXXXXXXXXXXXXXXXXX

SEQ ID NO: 32875 - protein, 52 aa, Diabrotica virgifera
  misc_feature: Coding regions on vcDNA: vcDNA=SeqID_12572; Strand=+; Position=1-159
  misc_feature (22)..(39): Xaa can be any naturally occurring amino acid
LYAPRDIFYFYKSPPLFLEPWXXXXXXXXXXXXXXXXXXDYKIKTVIVDEVF

SEQ ID NO: 32876 - protein, 92 aa, Diabrotica virgifera
  misc_feature: Coding regions on vcDNA: vcDNA=SeqID_12573; Strand=+; Position=49-324
  misc_feature (61)..(61): Xaa can be any naturally occurring amino acid
  misc_feature (68)..(68): Xaa can be any naturally occurring amino acid
HKGATEKKPQEKGKKKKQRKKPQTQTQRATGRQKKHSARRDTSTGEQADRKRKRRGAPANXKEGQRGXRRATSAERQRRRGRRHGRPATGTD

SEQ ID NO: 32877 - protein, 29 aa, Diabrotica virgifera
  misc_feature: Coding regions on vcDNA: vcDNA=SeqID_12574; Strand=+; Position=1-87
  misc_feature (1)..(5): Xaa can be any naturally occurring amino acid
XXXXXLSYKSLHFSQTPTNNPIKLLYNFL

SEQ ID NO: 32878 - protein, 33 aa, Diabrotica virgifera; identical to SEQ ID NO: 29667
  misc_feature: Coding regions on vcDNA: vcDNA=SeqID_12575; Strand=-; Position=1-99
  misc_feature (1)..(33): Xaa can be any naturally occurring amino acid

SEQ ID NO: 32879 - protein, 280 aa, Diabrotica virgifera
  misc_feature: Coding regions on vcDNA: vcDNA=SeqID_12576; Strand=-; Position=1-840
  misc_feature (17)..(29): Xaa can be any naturally occurring amino acid
  misc_feature (32)..(280): Xaa can be any naturally occurring amino acid
KENKRLCRGLLVRLGKXXXXXXXXXXXXXRYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32880 - protein, 55 aa, Diabrotica virgifera
  misc_feature: Coding regions on vcDNA: vcDNA=SeqID_12577; Strand=-; Position=3-167
  misc_feature (43)..(43): Xaa can be any naturally occurring amino acid
SSSLSLIPSNISTTSPTTRLRKRILISLSSPAAAKKKTGIHGXGTCTAYPAFLYS

SEQ ID NO: 32881 - protein, 235 aa, Diabrotica virgifera
  misc_feature: Coding regions on vcDNA: vcDNA=SeqID_12578; Strand=-; Position=41-748
  misc_feature (9)..(23): Xaa can be any naturally occurring amino acid
  misc_feature (27)..(43): Xaa can be any naturally occurring amino acid
  misc_feature (56)..(175): Xaa can be any naturally occurring amino acid
  misc_feature (179)..(199): Xaa can be any naturally occurring amino acid
  misc_feature (201)..(214): Xaa can be any naturally occurring amino acid
  misc_feature (218)..(232): Xaa can be any naturally occurring amino acid
IKPVFFPSXXXXXXXXXXXXXXXPLAXXXXXXXXXXXXXXXXXIFNPKSHVFNNQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFHXXXXXXXXXXXXXXXXXXXXXIXXXXXXXXXXXXXXPQGXXXXXXXXXXXXXXXNIN

SEQ ID NO: 32882 - protein, 209 aa, Diabrotica virgifera
  misc_feature: Coding regions on vcDNA: vcDNA=SeqID_12579; Strand=+; Position=34-661
  misc_feature (22)..(23): Xaa can be any naturally occurring amino acid
  misc_feature (33)..(34): Xaa can be any naturally occurring amino acid
  misc_feature (37)..(37): Xaa can be any naturally occurring amino acid
  misc_feature (48)..(48): Xaa can be any naturally occurring amino acid
  misc_feature (53)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (64)..(64): Xaa can be any naturally occurring amino acid
  misc_feature (68)..(68): Xaa can be any naturally occurring amino acid
  misc_feature (73)..(74): Xaa can be any naturally occurring amino acid
  misc_feature (77)..(78): Xaa can be any naturally occurring amino acid
  misc_feature (83)..(84): Xaa can be any naturally occurring amino acid
  misc_feature (88)..(88): Xaa can be any naturally occurring amino acid
  misc_feature (93)..(93): Xaa can be any naturally occurring amino acid
  misc_feature (104)..(105): Xaa can be any naturally occurring amino acid
  misc_feature (108)..(108): Xaa can be any naturally occurring amino acid
  misc_feature (113)..(114): Xaa can be any naturally occurring amino acid
  misc_feature (117)..(117): Xaa can be any naturally occurring amino acid
  misc_feature (119)..(119): Xaa can be any naturally occurring amino acid
  misc_feature (122)..(122): Xaa can be any naturally occurring amino acid
  misc_feature (124)..(125): Xaa can be any naturally occurring amino acid
  misc_feature (127)..(128): Xaa can be any naturally occurring amino acid
  misc_feature (130)..(130): Xaa can be any naturally occurring amino acid
  misc_feature (133)..(134): Xaa can be any naturally occurring amino acid
  misc_feature (137)..(137): Xaa can be any naturally occurring amino acid
  misc_feature (141)..(141): Xaa can be any naturally occurring amino acid
  misc_feature (144)..(146): Xaa can be any naturally occurring amino acid
  misc_feature (152)..(153): Xaa can be any naturally occurring amino acid
  misc_feature (157)..(157): Xaa can be any naturally occurring amino acid
  misc_feature (160)..(161): Xaa can be any naturally occurring amino acid
  misc_feature (164)..(164): Xaa can be any naturally occurring amino acid
  misc_feature (167)..(167): Xaa can be any naturally occurring amino acid
  misc_feature (169)..(170): Xaa can be any naturally occurring amino acid
  misc_feature (172)..(173): Xaa can be any naturally occurring amino acid
  misc_feature (180)..(180): Xaa can be any naturally occurring amino acid
  misc_feature (183)..(183): Xaa can be any naturally occurring amino acid
  misc_feature (189)..(189): Xaa can be any naturally occurring amino acid
PIRGPDYHNELFHPRQPGAGSXXRGKKRPRHRXXGKXAARAEARAKRXEESGXXDKAXAGXQAXGKKXEETGXXDRXXAGAEXXAKRXEQTGXRDKAKQTAGQXXKQXEDTGXXGKXQXEAXRXXKXXDXTGXXNQXKEQXKAXXXSPPAEXXRQRXHQXXEKXGEXKXXEXXAARAEPXKQXGAKPGXAPAKPANQEGQKPPPTTTAP

SEQ ID NO: 32883 - protein, 45 aa, Diabrotica virgifera
  misc_feature: Coding regions on vcDNA: vcDNA=SeqID_12580; Strand=-; Position=1-135
  misc_feature (1)..(29): Xaa can be any naturally occurring amino acid
  misc_feature (32)..(41): Xaa can be any naturally occurring amino acid
XXXXXXXXXXXXXXXXXXXXXXXXXXXXXCKXXXXXXXXXXGREE

SEQ ID NO: 32884 - protein, 138 aa, Diabrotica virgifera
  misc_feature: Coding regions on vcDNA: vcDNA=SeqID_12581; Strand=-; Position=1-414
  misc_feature (1)..(138): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32885 - protein, 179 aa, Diabrotica virgifera
  misc_feature: Coding regions on vcDNA: vcDNA=SeqID_12582; Strand=-; Position=2-541
  misc_feature (9)..(15): Xaa can be any naturally occurring amino acid
  misc_feature (25)..(32): Xaa can be any naturally occurring amino acid
  misc_feature (35)..(48): Xaa can be any naturally occurring amino acid
  misc_feature (54)..(67): Xaa can be any naturally occurring amino acid
  misc_feature (69)..(167): Xaa can be any naturally occurring amino acid
  misc_feature (171)..(171): Xaa can be any naturally occurring amino acid
WGPFVLGCXXXXXXXTNLAHRGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCPCXGSISAALE

SEQ ID NO: 32886 - protein, 300 aa, Diabrotica virgifera
  misc_feature: Coding regions on vcDNA: vcDNA=SeqID_12583; Strand=+; Position=2-904
  misc_feature (8)..(10): Xaa can be any naturally occurring amino acid
  misc_feature (17)..(23): Xaa can be any naturally occurring amino acid
  misc_feature (98)..(106): Xaa can be any naturally occurring amino acid
  misc_feature (162)..(168): Xaa can be any naturally occurring amino acid
  misc_feature (230)..(237): Xaa can be any naturally occurring amino acid
  misc_feature (261)..(268): Xaa can be any naturally occurring amino acid
LPRPGCFXXXRAHPHIXXXXXXXRSDHPPQRQRKPKPNKPKTQIIHSEGFISQEQIQTSTLKLEHTSTIDTTSSAFIESEKADNEIHQIDVDHPIEKXXXXXXXXXPQLPENTTLEPVTKQEPIIEPQQTSNINISTSALIESEKATSETQKLKVDQPIEKXXXXXXXNKTPAKVPEHRVNMHINAMFITEEINNSLLPEITKTTDEQDVPDKIEIPVELPKMDHKEKSXXXXXXXXKPVPEETFTETISEKSVPKDEPKXXXXXXXXQTKHEDVVSTEISKNEAIGEKTPQAITQEVKQ

SEQ ID NO: 32887 - protein, 169 aa, Diabrotica virgifera
  misc_feature: Coding regions on vcDNA: vcDNA=SeqID_12584; Strand=+; Position=21-527
  misc_feature: Homolog annotation: Hit_ID=AAH43903.1; Match level="QueryCoverage =94%, HitCoverage=39%, E-value=1e-18, Identity=35%"; Hit description =Nap1l1-prov protein [Xenopus laevis]
  misc_feature: Gene Ontology Annotation: Molecular function=chaperone activity; Cellular component=chromatin assembly complex; Biological process =nucleosome assembly
  misc_feature (5)..(5): Xaa can be any naturally occurring amino acid
  misc_feature (7)..(7): Xaa can be any naturally occurring amino acid
  misc_feature (12)..(13): Xaa can be any naturally occurring amino acid
  misc_feature (17)..(19): Xaa can be any naturally occurring amino acid
  misc_feature (21)..(21): Xaa can be any naturally occurring amino acid
  misc_feature (26)..(26): Xaa can be any naturally occurring amino acid
  misc_feature (29)..(29): Xaa can be any naturally occurring amino acid
  misc_feature (31)..(31): Xaa can be any naturally occurring amino acid
  misc_feature (36)..(37): Xaa can be any naturally occurring amino acid
  misc_feature (39)..(40): Xaa can be any naturally occurring amino acid
  misc_feature (42)..(45): Xaa can be any naturally occurring amino acid
  misc_feature (52)..(52): Xaa can be any naturally occurring amino acid
  misc_feature (54)..(54): Xaa can be any naturally occurring amino acid
  misc_feature (57)..(57): Xaa can be any naturally occurring amino acid
  misc_feature (63)..(63): Xaa can be any naturally occurring amino acid
  misc_feature (68)..(69): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(86): Xaa can be any naturally occurring amino acid
  misc_feature (90)..(90): Xaa can be any naturally occurring amino acid
  misc_feature (94)..(94): Xaa can be any naturally occurring amino acid
  misc_feature (99)..(100): Xaa can be any naturally occurring amino acid
  misc_feature (103)..(103): Xaa can be any naturally occurring amino acid
  misc_feature (105)..(107): Xaa can be any naturally occurring amino acid
  misc_feature (110)..(111): Xaa can be any naturally occurring amino acid
  misc_feature (113)..(113): Xaa can be any naturally occurring amino acid
  misc_feature (115)..(117): Xaa can be any naturally occurring amino acid
  misc_feature (121)..(122): Xaa can be any naturally occurring amino acid
  misc_feature (126)..(129): Xaa can be any naturally occurring amino acid
  misc_feature (134)..(134): Xaa can be any naturally occurring amino acid
  misc_feature (138)..(152): Xaa can be any naturally occurring amino acid
  misc_feature (155)..(155): Xaa can be any naturally occurring amino acid
  misc_feature (157)..(157): Xaa can be any naturally occurring amino acid
  misc_feature (160)..(160): Xaa can be any naturally occurring amino acid
HEGPXEXLSKTXXTKEXXXKXAPEEXDPXSXEGPEXXKXXGXXXXGNKGKNXTXKTXKKKQKXKSRGXXRTXTKTXQKXXXXXXXXPPTXPEDXKEEDXXEEXRXXXTTXXEXGXXXRERXXPRAXXXXTGEAXEDEXXXXXXXXXXXXXXXGDXEXKEXTKNKEQQKQ

SEQ ID NO: 32888 - protein, 211 aa, Diabrotica virgifera
  misc_feature: Coding regions on vcDNA: vcDNA=SeqID_12585; Strand=+; Position=93-725
  misc_feature: Homolog annotation: Hit_ID=XP_318008.1; Match level="QueryCoverage =91%, HitCoverage=19%, E-value=4e-53, Identity=52%"; Hit description =ENSANGP00000010722 [Anopheles gambiae]
  misc_feature: Gene Ontology Annotation: Molecular function=actin binding; Cellular component=coated pit; Biological process=biological_process unknown
  misc_feature: Pfam annotation: Pfam_ID=ANTH; Match level="Score=83.9, E-value=4.1e -22, Copies=1"; Pfam description=ANTH domain
MAKEYTYRDLEKYAQALQKAINSNETPVKQKHVRSAIIGTFHTQSAKIFWSYALRLPAMDDRIVAWKLCHVVHKVLREGHPLCLVDSQRHRNDLDEIGKLWGHLKEGYGKMIRLYTSLLLYKLEFHMRNPRFPGNLGVTAEELESIAGNDINNYFEMTVEMFDYLDHILELQEAVFGSLNMGRSNSMLKRRVRPVFVPLLPCILPRPPPLY

SEQ ID NO: 32889 - protein, 307 aa, Diabrotica virgifera
  misc_feature: Coding regions on vcDNA: vcDNA=SeqID_12586; Strand=-; Position=2-922
  misc_feature (30)..(51): Xaa can be any naturally occurring amino acid
  misc_feature (53)..(59): Xaa can be any naturally occurring amino acid
  misc_feature (81)..(253): Xaa can be any naturally occurring amino acid
  misc_feature (257)..(300): Xaa can be any naturally occurring amino acid
KIPLLLPLYPTPLYPLPIHSIKTLLNFLTXXXXXXXXXXXXXXXXXXXXXXSXXXXXXXKLSSLNTIKIPRPFKLINSQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTTXXXXXXXXXXXXXXXXXXXXXXXXXXXXXXXXXXXXXXXXXXXXISPPPSK

SEQ ID NO: 32890 - protein, 114 aa, Diabrotica virgifera
  misc_feature: Coding regions on vcDNA: vcDNA=SeqID_12587; Strand=-; Position=51-395
KLASGETKWRCVKDNCKAFIKTIGENKNRITTSINHNHNHDPESENLLERKVLSHGIKRKAENDLFEKPSKLIRKKLNNKDNNLTNLTTNDLHCAKKSVLCSSEVTTSFSKINF

SEQ ID NO: 32891 - protein, 248 aa, Diabrotica virgifera
  misc_feature: Coding regions on vcDNA: vcDNA=SeqID_12588; Strand=+; Position=26-772
  misc_feature: Homolog annotation: Hit_ID=XP_309807.1; Match level="QueryCoverage =66%, HitCoverage=49%, E-value=2e-25, Identity=39%"; Hit description =ENSANGP00000018174 [Anopheles gambiae]
  misc_feature: Pfam annotation: Pfam_ID=Chitin_bind_4; Match level="Score=97.6, E -value=3.3e-26, Copies=1"; Pfam description=Insect cuticle protein
MTLAAFFMLIAYAVADKLQNNYLPPSNSGASDGGEFLTAPSRVANVFAGFRSSRPTSASYNVYHSSQFGKSAPLVDRPNVAFRNSEFSSSGPQIPILRLTSENNGEGSYRFAYETDNSISHEEEGHQETIGAEQGTVVHGSYTYQSPEGQTFTVHYIADENGFRATGDHLPVAPPVPEAIQRSLNHNLITKQSLVDVSRTNNEDHIGANSDNSEAHDLNSVEVGRNDGGNVNRQYLGPFKNNNNGYRY

SEQ ID NO: 32892 - protein, 258 aa, Diabrotica virgifera
  misc_feature: Coding regions on vcDNA: vcDNA=SeqID_12589; Strand=+; Position=164-937
  misc_feature: Homolog annotation: Hit_ID=XP_534585.1; Match level="QueryCoverage =52%, HitCoverage=55%, E-value=1e-24, Identity=36%"; Hit description =PREDICTED: similar to hypothetical protein FLJ32191 [Canis familiaris]
  misc_feature: Pfam annotation: Pfam_ID=zf-C2H2; Match level="Score=64.1, E-value=4e- 16, Copies=4"; Pfam description=Zinc finger, C2H2 type
MFNSSICEKNNVFLVPEDIENSCRLCLNKNALVDIFKTKYQETTFADIFTMVSILEINPTDYLPKKICTVCENLVIEFYKFSEKVKDTQIILRNSLMLITETLETDKFDYISDDGTNQECSHIVLKTLEKTITCSFCNSQFETYSAYIAHRKMEADSRRKKQHCSVCKKFISTYKLKDHMNSHTKEKPHQCQICGEKFRFLSSLSRHKFRHRDKKPHVCHICGKGFIQAPSLNDHIRTHSGEKSCMCNACGITFITKH

SEQ ID NO: 32893 - protein, 125 aa, Diabrotica virgifera
  misc_feature: Coding regions on vcDNA: vcDNA=SeqID_12590; Strand=+; Position=167-544
TKMKFLVKVMDLIILQFLWIGYVIYRSVCPEKKLYHSIQDDRSLSQDETKNKRHFIHLYTTTSMNGKPVCYMDVYQIYSASDEEHLRSVCSKGVPNKTYYRHKERLTKERSYIPDEWKDYSIMAV

SEQ ID NO: 32894 - protein, 69 aa, Diabrotica virgifera
  misc_feature: Coding regions on vcDNA: vcDNA=SeqID_12591; Strand=-; Position=97-306
LINLTSLTYIYTSEKWDNWIGSTSQLVYSSFWSPGISENGNAHKLINTCPCYCNPIFPGPPSTCNSSRS

SEQ ID NO: 32895 - protein, 44 aa, Diabrotica virgifera
  misc_feature: Coding regions on vcDNA: vcDNA=SeqID_12592; Strand=-; Position=41-175
MVYPIFIFPFEVIKKYSLFFIQCSLYLNVIITEFLLHLNYLCRS

SEQ ID NO: 32896 - protein, 164 aa, Diabrotica virgifera
  misc_feature: Coding regions on vcDNA: vcDNA=SeqID_12593; Strand=-; Position=31-525
  misc_feature (55)..(60): Xaa can be any naturally occurring amino acid
  misc_feature (109)..(117): Xaa can be any naturally occurring amino acid
WYTLKRLIGEAGPCIMSEKVHPLCSHIPHLGNHGRYIPSRTSYIHLIYLVVSSRXXXXXXFSSAIDIKSGYLIHLILDSPMIYSYYIWNILTVSSNHGTLVDTVVTRYXXXXXXXXXLNLHVRLHASPHHHQALKASAGKSVCLPYIQLATSDAKYNKRQLNYT

SEQ ID NO: 32897 - protein, 35 aa, Diabrotica virgifera
  misc_feature: Coding regions on vcDNA: vcDNA=SeqID_12594; Strand=-; Position=3-107
  misc_feature (3)..(15): Xaa can be any naturally occurring amino acid
RTXXXXXXXXXXXXXIQHRGRNLYYRFDSPIKLRC

SEQ ID NO: 32898 - protein, 214 aa, Diabrotica virgifera
  misc_feature: Coding regions on vcDNA: vcDNA=SeqID_12595; Strand=+; Position=77-721
  misc_feature: Homolog annotation: Hit_ID=AAL28535.1; Match level="QueryCoverage =95%, HitCoverage=92%, E-value=6e-73, Identity=65%"; Hit description =GM14561p [Drosophila melanogaster]
  misc_feature (68)..(74): Xaa can be any naturally occurring amino acid
MVFNGYFIILFCTLALVYSESPEEEQGVKYANKCEVCKILAIELESRLEETGKTSEVLETGYSVDDVXXXXXXXYKKSELRLVESLEGVCDRILEYNIHKEREDSTRFAKGQSQTFQTLHGLVDKGVKVELGIPYELWDKPSAEITKLKTQCETLLEENEAAIEDWYFNHQGKLTLKKYLCEDRALKNQEAKCLYEQLKGETGARKSPKKKQEL

SEQ ID NO: 32899 - protein, 31 aa, Diabrotica virgifera
  misc_feature: Coding regions on vcDNA: vcDNA=SeqID_12596; Strand=-; Position=0-92
  misc_feature (3)..(30): Xaa can be any naturally occurring amino acid
SLXXXXXXXXXXXXXXXXXXXXXXXXXXXXP

SEQ ID NO: 32900 - protein, 50 aa, Diabrotica virgifera
  misc_feature: Coding regions on vcDNA: vcDNA=SeqID_12597; Strand=-; Position=379-531
  misc_feature (40)..(46): Xaa can be any naturally occurring amino acid
SIRWNFGNYWPSMFYTVSLLATKLKTMELTAYFSTIYTKXXXXXXXKELF

SEQ ID NO: 32901 - protein, 211 aa, Diabrotica virgifera
  misc_feature: Coding regions on vcDNA: vcDNA=SeqID_12598; Strand=+; Position=111-746
  misc_feature: Homolog annotation: Hit_ID=XP_392382.1; Match level="QueryCoverage =92%, HitCoverage=17%, E-value=4e-39, Identity=42%"; Hit description =similar to Hypoxia-inducible factor 1 alpha (HIF-1 alpha) (HIF1 alpha) (ARNT interacting
  misc_feature: Gene Ontology Annotation: Molecular function=transcription factor activity; Cellular component=nucleus; Biological process =transcription from Pol II promoter
  misc_feature (28)..(28): Xaa can be any naturally occurring amino acid
  misc_feature (145)..(150): Xaa can be any naturally occurring amino acid
  misc_feature (182)..(182): Xaa can be any naturally occurring amino acid
MEKKQKAPKEKRRNNEKRKEKSRNAARXRRSKETELYLDLASSLPFSSEQISQLDKDSFMRLAISYLKIRNMMTAVTDFITSNETKSQEYCMVFLKSLNIYEMILSDEGDFVYLTDNAIKYLIINLIELMSQNIFEYKHPCYHEXXXXXXFGNTRGDLNPKKSLFVRMKCALTKKGRSVTLXSPANKAIHCTEHVSKKKDLANKTTKNQPE

SEQ ID NO: 32902 - protein, 228 aa, Diabrotica virgifera
  misc_feature: Coding regions on vcDNA: vcDNA=SeqID_12599; Strand=+; Position=212-899
  misc_feature: Homolog annotation: Hit_ID=XP_315290.1; Match level="QueryCoverage =83%, HitCoverage=88%, E-value=3e-31, Identity=34%"; Hit description =ENSANGP00000000887 [Anopheles gambiae]
  misc_feature: Gene Ontology Annotation: Molecular function=signal transducer activity; Cellular component=integral to plasma membrane; Biological process=cell adhesion
  misc_feature: Pfam annotation: Pfam_ID=Tetraspannin; Match level="Score=52.5, E -value=1.2e-12, Copies=1"; Pfam description=Tetraspanin family
  misc_feature (45)..(52): Xaa can be any naturally occurring amino acid
  misc_feature (111)..(111): Xaa can be any naturally occurring amino acid
LRSISYESWIVTSYSTAFYLFLATGCLVILVFLLGCCAIPKRWTXXXXXXXXLLVLLFLFEILIGVLAFIFQDNIEEDLNLNFNKTIISTYQFDDSKTISIDYIQEKLHCXGAVNYIDWRQNEWIKSGSVLNRVPDSCCKTVSEHCGYRDHPSNIHEEGCISYVAEKIKTNFWIIFIAALGLSAFHAIGIILGIILFIKVESGKHDGEYSTKNGGTEALLSDDRQLHF

SEQ ID NO: 32903 - protein, 64 aa, Diabrotica virgifera
  misc_feature: Coding regions on vcDNA: vcDNA=SeqID_12600; Strand=-; Position=367-561
HQLPHSIHPALYLVIFLIYPRIGKCILPTPLSILSRIIHYHEIKSFLPRRYRLLINTPYYITTS

SEQ ID NO: 32904 - protein, 77 aa, Diabrotica virgifera
  misc_feature: Coding regions on vcDNA: vcDNA=SeqID_12601; Strand=+; Position=326-559
  misc_feature (21)..(27): Xaa can be any naturally occurring amino acid
  misc_feature (44)..(53): Xaa can be any naturally occurring amino acid
  misc_feature (55)..(67): Xaa can be any naturally occurring amino acid
YFYNKVPAYLYQSTEKYPFSXXXXXXXLFGLQIFIYDNMFIIYXXXXXXXXXXEXXXXXXXXXXXXXEMIMIYTMVY

SEQ ID NO: 32905 - protein, 262 aa, Diabrotica virgifera
  misc_feature: Coding regions on vcDNA: vcDNA=SeqID_12602; Strand=-; Position=2-787
  misc_feature (2)..(39): Xaa can be any naturally occurring amino acid
  misc_feature (41)..(205): Xaa can be any naturally occurring amino acid
  misc_feature (208)..(246): Xaa can be any naturally occurring amino acid
  misc_feature (248)..(262): Xaa can be any naturally occurring amino acid
IXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXX

SEQ ID NO: 32906 - protein, 59 aa, Diabrotica virgifera
  misc_feature: Coding regions on vcDNA: vcDNA=SeqID_12603; Strand=-; Position=193-372
  misc_feature (5)..(12): Xaa can be any naturally occurring amino acid
  misc_feature (15)..(20): Xaa can be any naturally occurring amino acid
SISSXXXXXXXXSLXXXXXXASIILLILVLSLLIYHLYIHSHVNPRLILKASNKVLKIL

SEQ ID NO: 32907 - protein, 146 aa, Diabrotica virgifera
  misc_feature: Coding regions on vcDNA: vcDNA=SeqID_12604; Strand=+; Position=390-830
  misc_feature: Homolog annotation: Hit_ID=CAA75108.1; Match level="QueryCoverage =79%, HitCoverage=73%, E-value=4e-10, Identity=36%"; Hit description =beta-galactosidase [Phagemid cloning vector pTZ19U]
  misc_feature (93)..(100): Xaa can be any naturally occurring amino acid
  misc_feature (106)..(106): Xaa can be any naturally occurring amino acid
VRNVTVLFKGSKFKYRGVGPQNFFKGAPKFNSRARFLKRRGGENPGGPPINPLGKTPPFPRWGKKKKAPPHPPSQKLATLKGKGAPPLKRPLXXXXXXXXASGTRXILPAPKPPFFFFFLLFPPRSAGFPGKFKKGGSLLGFQLRV

SEQ ID NO: 32908 - protein, 293 aa, Diabrotica virgifera
  misc_feature: Coding regions on vcDNA: vcDNA=SeqID_12605; Strand=+; Position=49-923
  misc_feature: Homolog annotation: Hit_ID=NP_728821.2; Match level="QueryCoverage =87%, HitCoverage=54%, E-value=8e-60, Identity=45%"; Hit description =CG32281-PA [Drosophila melanogaster] gb|AAN11538.2| CG32281-PA [Drosophila melanogaster]
  misc_feature: Gene Ontology Annotation: Molecular function=tRNA (guanine) methyltransferase activity; Cellular component=cytoplasm; Biological process=tRNA methylation
  misc_feature: Pfam annotation: Pfam_ID=Met_10; Match level="Score=-87.1, E-value =0.001, Copies=1"; Pfam description=Met-10+ like-protein
  misc_feature (218)..(218): Xaa can be any naturally occurring amino acid
  misc_feature (240)..(240): Xaa can be any naturally occurring amino acid
  misc_feature (243)..(243): Xaa can be any naturally occurring amino acid
  misc_feature (251)..(251): Xaa can be any naturally occurring amino acid
  misc_feature (257)..(257): Xaa can be any naturally occurring amino acid
  misc_feature (267)..(267): Xaa can be any naturally occurring amino acid
  misc_feature (275)..(275): Xaa can be any naturally occurring amino acid
MIYNFHKQVLNCIKNRSSLLSTQFYSTQLQSAMENILKPPNVRGMQVLNKDLIKKDIEVPYLSLKKDNLNKVLPALTKYLLKIKKFKPVQHIEENKVDVCLSPEFIKDWTGLPDEVKTSLEEVHITEDDLKTKHVELTYDNFSAEDLLKAVLPTEKDGLSSFSQMGHIVHINLREHLFPFKSIIADILYDKIPGCKSVVNKINVIDNTYRNLGMEVLXGDNNMITTVKENTCSFKFDFSXVYXDSRLCTEXHERIVXKINSSDVLFXDFFAGYRXPFSYPAAKKKCYVYANDL

SEQ ID NO: 32909 - protein, 312 aa, Diabrotica virgifera
  misc_feature: Coding regions on vcDNA: vcDNA=SeqID_12606; Strand=-; Position=2-937
  misc_feature (4)..(28): Xaa can be any naturally occurring amino acid
  misc_feature (30)..(55): Xaa can be any naturally occurring amino acid
  misc_feature (60)..(296): Xaa can be any naturally occurring amino acid
  misc_feature (298)..(312): Xaa can be any naturally occurring amino acid
KKIXXXXXXXXXXXXXXXXXXXXXXXXXPXXXXXXXXXXXXXXXXXXXXXXXXXXLLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 32910 - protein, 281 aa, Diabrotica virgifera
  misc_feature: Coding regions on vcDNA: vcDNA=SeqID_12607; Strand=+; Position=42-887
  misc_feature: Homolog annotation: Hit_ID=CAF93481.1; Match level="QueryCoverage =98%, HitCoverage=79%, E-value=3e-39, Identity=35%"; Hit description =unnamed protein product [Tetraodon nigroviridis]
  misc_feature: Gene Ontology Annotation: Molecular function=molecular_function unknown; Cellular component=endoplasmic reticulum membrane; Biological process=response to unfolded protein
  misc_feature: Pfam annotation: Pfam_ID=ubiquitin; Match level="Score=39.0, E-value =1.4e-08, Copies=1"; Pfam description=Ubiquitin family
  misc_feature (252)..(252): Xaa can be any naturally occurring amino acid
  misc_feature (259)..(259): Xaa can be any naturally occurring amino acid
MESFVTLIVKAPNQQIEDQTIQCEPSWTIHKLKQHLSEVYPSKPPKHEQKLIYSGQLLNDTVTLKEILRQYEGQEAHTVHLVCSSKYMQNVPETKPVSQTSTPNNTQNTTNSTTSSPTTNDNASGGQNTAGFPPNMPYFNMNSGQVDPNQYAMQLAWMQQAYFQYMSQYMQLAANSYGTAGQAIPNNGDPVPNQPEQPPAAPAEAPAVARDPDNPERDWLEVFYMLTRATVLFIVIYFYSSPIRFLFVLLLXFSLYLYXIGFFRNMKHNNNNINGPPEQPQ

SEQ ID NO: 32911 - protein, 80 aa, Diabrotica virgifera
  misc_feature: Coding regions on vcDNA: vcDNA=SeqID_12608; Strand=+; Position=442-681
RSYFDLKLFKHMSRIVDCCKLISHVYQPLYVTGIYNYVTAGQATASNVDPGPCLTYPDPVDPADVPAVVKSPRYPRKRCA

SEQ ID NO: 32912 - protein, 21 aa, Diabrotica virgifera
  misc_feature: Coding regions on vcDNA: vcDNA=SeqID_12609; Strand=+; Position=9-74
LLIKNFDSLEYVIIYYHILLG

SEQ ID NO: 32913 - protein, 280 aa, Diabrotica virgifera
  misc_feature: Coding regions on vcDNA: vcDNA=SeqID_12610; Strand=-; Position=0-839
  misc_feature (2)..(23): Xaa can be any naturally occurring amino acid
  misc_feature (28)..(37): Xaa can be any naturally occurring amino acid
  misc_feature (47)..(55): Xaa can be any naturally occurring amino acid
  misc_feature (58)..(70): Xaa can be any naturally occurring amino acid
  misc_feature (77)..(89): Xaa can be any naturally occurring amino acid
  misc_feature (92)..(279): Xaa can be any naturally occurring amino acid
RXXXXXXXXXXXXXXXXXXXXXXGPFVXXXXXXXXXXPNLAHTGLNXXXXXXXXXRTXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 32914 - protein, 108 aa, Diabrotica virgifera; identical to SEQ ID NO: 27732
  misc_feature: Coding regions on vcDNA: vcDNA=SeqID_12611; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 32915 - protein, 38 aa, Diabrotica virgifera
  misc_feature: Coding regions on vcDNA: vcDNA=SeqID_12612; Strand=-; Position=49-165
SPRYITSKYTYSFIISFSQYFAPPLMIRTLYETSQHTH

SEQ ID NO: 32916 - protein, 72 aa, Diabrotica virgifera
  misc_feature: Coding regions on vcDNA: vcDNA=SeqID_12613; Strand=-; Position=567-785
  misc_feature (23)..(36): Xaa can be any naturally occurring amino acid
  misc_feature (40)..(46): Xaa can be any naturally occurring amino acid
FIRTVIPGFTKKSNDYSTVARSXXXXXXXXXXXXXXIICXXXXXXXYYTVVRYVGECEIRSSGSIKREQVHI

SEQ ID NO: 32917 - protein, 39 aa, Diabrotica virgifera
  misc_feature: Coding regions on vcDNA: vcDNA=SeqID_12614; Strand=-; Position=8-127
EILSLFHNLISNFLETKKRTVLFKRNCVNKCIYLLLLNK

SEQ ID NO: 32918 - protein, 278 aa, Diabrotica virgifera
  misc_feature: Coding regions on vcDNA: vcDNA=SeqID_12615; Strand=-; Position=0-833
  misc_feature (2)..(273): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVYQG

SEQ ID NO: 32919 - protein, 255 aa, Diabrotica virgifera
  misc_feature: Coding regions on vcDNA: vcDNA=SeqID_12616; Strand=+; Position=2-766
  misc_feature (6)..(14): Xaa can be any naturally occurring amino acid
  misc_feature (17)..(228): Xaa can be any naturally occurring amino acid
PLSRPXXXXXXXXXLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWPRYFDRAKGAYSFSFLLEAGNERPVQ

SEQ ID NO: 32920 - protein, 123 aa, Diabrotica virgifera
  misc_feature: Coding regions on vcDNA: vcDNA=SeqID_12617; Strand=+; Position=93-464
  misc_feature (53)..(70): Xaa can be any naturally occurring amino acid
PTRAQSRPDLFSMSESLSLIFFLKYVLISDLPKPGNTKICYILIMLYVHILSXXXXXXXXXXXXXXXXXXMVEVLPTYLFSTSSTTNAASICRNLGLLPLPRLKISRCYLLNVHSWCHIITSP

SEQ ID NO: 32921 - protein, 201 aa, Diabrotica virgifera
  misc_feature: Coding regions on vcDNA: vcDNA=SeqID_12618; Strand=+; Position=1-606
  misc_feature: Homolog annotation: Hit_ID=AAH84978.1; Match level="QueryCoverage =98%, HitCoverage=22%, E-value=7e-40, Identity=39%"; Hit description =Unknown (protein for MGC:86390) [Xenopus laevis]
  misc_feature: Gene Ontology Annotation: Cellular component=nuclear pore; Biological process=protein-nucleus import
RTRGLIALCYPFLASSVNEYIPLIIKNLDEHTDGVCNNAAWVIGKLCAVMGNAIQPFLPEILNAFVHILRTPAVARTMHKTVAISLCIVFYVCPDVTIPEMDVIVKNCCMLVRNVRDSDEKDLAFRGLCEVIIRHPEFNKNYFIFFCDAAASWINIRVDLKQTIRNVLLAFKQQCGEDNWRQFYCQFPEALKLKLQELYGV

SEQ ID NO: 32922 - protein, 238 aa, Diabrotica virgifera
  misc_feature: Coding regions on vcDNA: vcDNA=SeqID_12619; Strand=+; Position=2-717
  misc_feature: Homolog annotation: Hit_ID=XP_315081.1; Match level="QueryCoverage =91%, HitCoverage=33%, E-value=4e-22, Identity=33%"; Hit description =ENSANGP00000002442 [Anopheles gambiae]
  misc_feature (46)..(46): Xaa can be any naturally occurring amino acid
LLRVRQTQVFQVEPTSFVFRYIIFKEDVKEYEIHERFLEFSDCNEXTGEDIANLIKEVLKKYDISLDDCRGQGFDNGSNMSGKYKGVQAHILKSNPLAVYSPCGCHSLNLCGVCATENCTEAQTFFGVVQNLYNLFSCSPKRWELLKEIVGSSLHSLSDTRWSARVECVKPIAAHIGKIIEAVSSLLNLNVTVETRATINGVLEYLNTFKCILMASIWVKVLVPINYRSQLLQTMDAT

SEQ ID NO: 32923 - protein, 71 aa, Diabrotica virgifera
  misc_feature: Coding regions on vcDNA: vcDNA=SeqID_12620; Strand=+; Position=379-594
  misc_feature (1)..(18): Xaa can be any naturally occurring amino acid
XXXXXXXXXXXXXXXXXXINIRIKKFHILKYVIMYFYVLLFLFCTDLLLKYKFRLFEFTNDDDITVTKLDI

SEQ ID NO: 32924 - protein, 82 aa, Diabrotica virgifera
  misc_feature: Coding regions on vcDNA: vcDNA=SeqID_12621; Strand=+; Position=486-734
  misc_feature: Homolog annotation: Hit_ID=AAK48712.1; Match level="QueryCoverage =98%, HitCoverage=13%, E-value=6e-11, Identity=39%"; Hit description =E-selectin [Equus caballus] sp|Q95LG1|LEM2_HORSE E-selectin precursor (Endothelial leukocyte adhesion mole
  misc_feature: Pfam annotation: Pfam_ID=Lectin_C; Match level="Score=-3.5, E-value =0.0011, Copies=1"; Pfam description=Lectin C-type domain
YSLLVSSYAEFWSAGSRLANERDWVWMSTGRPINVFDWGTGEPNNDGDEKCISLYYKNYSHGWWNDENCNNELAVICETRDC

SEQ ID NO: 32925 - protein, 77 aa, Diabrotica virgifera
  misc_feature: Coding regions on vcDNA: vcDNA=SeqID_12622; Strand=-; Position=2-232
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(73): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXDLNS

SEQ ID NO: 32926 - protein, 210 aa, Diabrotica virgifera
  misc_feature: Coding regions on vcDNA: vcDNA=SeqID_12623; Strand=+; Position=28-660
  misc_feature: Homolog annotation: Hit_ID=AAL90881.1; Match level="QueryCoverage =85%, HitCoverage=96%, E-value=2e-40, Identity=45%"; Hit description =cuticle protein 20 [Manduca sexta]
  misc_feature: Pfam annotation: Pfam_ID=Chitin_bind_4; Match level="Score=97.2, E -value=4.1e-26, Copies=1"; Pfam description=Insect cuticle protein
MKILLALAFVKIVACTQLHQNYLPPQRSSSFSSSGSFGGSHASAYSGASSYSGSYSGSGQQIPIVRLDNVNEGDGSYHFNYETGNGISAQEQGEARGDGTRANGGFSYTSPEGQQIHISYTADENGFHPEGNAIPTPPPIPEAILKSIQQNLADEARGVSDDGSYRSDNSGQYNAGGAGGFRQSAHFGGGGAAFNRGGSAAYNRGGGYQY

SEQ ID NO: 32927 - protein, 80 aa, Diabrotica virgifera
  misc_feature: Coding regions on vcDNA: vcDNA=SeqID_12624; Strand=-; Position=2-241
  misc_feature (74)..(80): Xaa can be any naturally occurring amino acid
LDFLNLQSYLVRLLKTLKIKTHVLRVYIHICTFYYSPFLQYSCKVVFLLLQPLQREAIFCLFSFYFPFLQVHYXXXXXXX

SEQ ID NO: 32928 - protein, 234 aa, Diabrotica virgifera
  misc_feature: Coding regions on vcDNA: vcDNA=SeqID_12625; Strand=+; Position=188-889
  misc_feature: Homolog annotation: Hit_ID=XP_311262.1; Match level="QueryCoverage =97%, HitCoverage=67%, E-value=2e-72, Identity=59%"; Hit description =ENSANGP00000011928 [Anopheles gambiae]
  misc_feature: Gene Ontology Annotation: Molecular function=signal transducer activity; Cellular component=cytoplasm; Biological process =xenobiotic metabolism
  misc_feature: Pfam annotation: Pfam_ID=FKBP_C; Match level="Score=6.9, E-value =0.0024, Copies=1"; Pfam description=FKBP-type peptidyl-prolyl cis -trans is
  misc_feature (217)..(217): Xaa can be any naturally occurring amino acid
MATEKDLIVKETIYAGTKSVPFKDGTKIHFHFQTRQCNSEKILLDDSRKLGTGKPFELVLGKKFKLEVWEAIVQKMALNEVAKFTVDKSLVIQYPFVSKTLRDINKPHGERNHHVCAMTLQTTGIGYDDLNSFLKNPTDLEFIIEITNIEQPESYEKETWQMEEGEKIELIPKLKEQGNEEYKNKNYKKASELYAKAIGILEQLMLKEKPHDIEWKXMNKQKVPILLNYAQCKL

SEQ ID NO: 32929 - protein, 44 aa, Diabrotica virgifera
  misc_feature: Coding regions on vcDNA: vcDNA=SeqID_12626; Strand=-; Position=2-133
TMFDTEQTFKTSVECLSLAYTLSVLYILHLYLTIPHTLLKRYRC

SEQ ID NO: 32930 - protein, 174 aa, Diabrotica virgifera
  misc_feature: Coding regions on vcDNA: vcDNA=SeqID_12627; Strand=-; Position=202-726
  misc_feature: Homolog annotation: Hit_ID=EAL33487.1; Match level="QueryCoverage =91%, HitCoverage=90%, E-value=6e-46, Identity=54%"; Hit description =GA15462-PA [Drosophila pseudoobscura]
  misc_feature: Gene Ontology Annotation: Molecular function=benzodiazepine receptor activity; Cellular component=mitochondrial outer membrane; Biological process=mitochondrial translocation
  misc_feature: Pfam annotation: Pfam_ID=TspO_MBR; Match level="Score=211.2, E-value =2e-60, Copies=1"; Pfam description=TspO/MBR family
  misc_feature (54)..(59): Xaa can be any naturally occurring amino acid
MIQLNWPALGFTILPNLGGIAGGFITRKSINPWYENLKKPKCRPPNWAFGPVWXXXXXXMGYASYLVYRDGGGFQGPAKLPLIVYGVNLAANWAWTPIFFGKKDLQLALIEIQLINGTALGMVYLFHKINPTAGYLIVPYCIWLGLATALNYCIWRDNKTTPAITEAKAEAKEQ

SEQ ID NO: 32931 - protein, 66 aa, Diabrotica virgifera; identical to SEQ ID NO: 26808
  misc_feature: Coding regions on vcDNA: vcDNA=SeqID_12628; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32932 - protein, 264 aa, Diabrotica virgifera
  misc_feature: Coding regions on vcDNA: vcDNA=SeqID_12629; Strand=+; Position=29-820
  misc_feature: Homolog annotation: Hit_ID=BAC82199.1; Match level="QueryCoverage =96%, HitCoverage=98%, E-value=2e-81, Identity=48%"; Hit description =acaloleptin A precursor [Acalolepta luxuriosa]
  misc_feature: Pfam annotation: Pfam_ID=Coleoptericin; Match level="Score=1.8, E -value=0.01, Copies=1"; Pfam description=Coleoptericin
MKFKHGSTFILIFALIVLTGAEDDNEQRIKRSPKPDWEVNPGANRDDDGNTNAGVQVKNHGNDHDFEAGWSKVVSGPDRAKPTWHVGGTWRFKRSPRPDWEVNPGANRDDDGNTNAGVQVKNHGNDHDFEAGWSKVVSGPDRAKPTWHVGGTWRFKRSPRPDWEVNPGANGDGNGNTNAGVEVRNKGKDHDFEAGWNKVVHGPNRAKPTWHVGGTWRFKRSPKPDWEVNPGANRDDDGNTNAGVQVKHHGNDHDFEAGWSKVVS

SEQ ID NO: 32933 - protein, 67 aa, Diabrotica virgifera
  misc_feature: Coding regions on vcDNA: vcDNA=SeqID_12630; Strand=-; Position=1-201
YGQSKGMLLTCSPQSAHNDTHHTDSARIKLALFSVDSYHNYDGLPCCTARIPQRRDMNIPTSNTLNK

SEQ ID NO: 32934 - protein, 45 aa, Diabrotica virgifera
  misc_feature: Coding regions on vcDNA: vcDNA=SeqID_12631; Strand=+; Position=1-138
AKALVIEIWLLFQYIYVKIFWGFCSFKPPKCLCTLQSNHYRGTIS

SEQ ID NO: 32935 - protein, 204 aa, Diabrotica virgifera
  misc_feature: Coding regions on vcDNA: vcDNA=SeqID_12632; Strand=+; Position=2-616
  misc_feature: Homolog annotation: Hit_ID=BAA86911.1; Match level="QueryCoverage =100%, HitCoverage=36%, E-value=7e-81, Identity=69%"; Hit description= homologue of Sarcophaga 26,29kDa proteinase [Periplaneta americana]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=171.7, E -value=1.5e-48, Copies=1"; Pfam description=Papain family cysteine protease
  misc_feature (51)..(71): Xaa can be any naturally occurring amino acid
  misc_feature (152)..(158): Xaa can be any naturally occurring amino acid
KDQSVCGSCWSFGTVGAIEGAYFLKNGGNLVRLSQQALIDCSWGYGNNGCXXXXXXXXXXXXXXXXXXXXXEDYGPYLGQDGYCHSNTVPKVAHITGWVNVTSGDENALRMALVRHGPISVAIDASHKTFSFYSNGVYYDPQCGNKEEDLDXXXXXXXYGIINGNKYWLVKNSWSTYWGNDGYVLMSSKNNNCGVMTTPTYVTM

SEQ ID NO: 32936 - protein, 228 aa, Diabrotica virgifera
  misc_feature: Coding regions on vcDNA: vcDNA=SeqID_12633; Strand=+; Position=38-724
  misc_feature (70)..(76): Xaa can be any naturally occurring amino acid
  misc_feature (155)..(161): Xaa can be any naturally occurring amino acid
  misc_feature (211)..(222): Xaa can be any naturally occurring amino acid
LYKVLKTMSKRKNIIMALAKENKVVCVQEVGDLEKRYSELASFGQDCLKSIQDTVKDDYLVDNLMMDGLXXXXXXXNPSTNENHFYDIQPICLVRDIRKEENTKVYTELKPLPLIDGTKDGSQNDTDVNNECHKEKSVDVIDVCQHNKDDTVDDXXXXXXXYDPQESEEISYETKKKRRIAKFFQTENEKSVVGTVMENEGLVDKQLKDIXXXXXXXXXXXXFVFHMN

SEQ ID NO: 32937 - protein, 105 aa, Diabrotica virgifera
  misc_feature: Coding regions on vcDNA: vcDNA=SeqID_12634; Strand=+; Position=290-607
KTTCLDKFWYACFLKNTRNKKQVQLSFLPPTSAAAHRHFFRVYYRVQVWLVYQLDPKYWGWKLVDSSLEPIQTLFPPAPQKLLNTIFCNCKKGCSAKCGCKKVGH

SEQ ID NO: 32938 - protein, 238 aa, Diabrotica virgifera
  misc_feature: Coding regions on vcDNA: vcDNA=SeqID_12635; Strand=+; Position=55-771
  misc_feature: Homolog annotation: Hit_ID=XP_418994.1; Match level="QueryCoverage =92%, HitCoverage=22%, E-value=1e-58, Identity=51%"; Hit description =PREDICTED: similar to Phosphatidylinositol glycan, class N [Gallus gallus]
  misc_feature: Gene Ontology Annotation: Molecular function=molecular_function unknown; Cellular component=cell wall (sensu Fungi); Biological process=GPI anchor biosynthesis
  misc_feature (17)..(17): Xaa can be any naturally occurring amino acid
  misc_feature (228)..(228): Xaa can be any naturally occurring amino acid
MNSEDANSIMEEESEAXIVSGLVIHFLLLLAVFDVYFASPLDNGMSPIRSTSNPPAKRLVLFVADGLRAEAIFGEGKEELIPFLADKLKNVGSWGVAHTRVPTESRPGHVAMLAGIYEDPSAILKGWKSNPVNFDSVINQSTNAWAWGSPDIGKIFNKDNLSKIHISSYDAQIEDFGNQDTGILDTWVFQQVHKFLTNEVKSCTTNCDQYFKIGKTFFLHLLRIDSAXHDYEPTSKEY

SEQ ID NO: 32939 - protein, 24 aa, Diabrotica virgifera
  misc_feature: Coding regions on vcDNA: vcDNA=SeqID_12636; Strand=-; Position=1-72
  misc_feature (8)..(20): Xaa can be any naturally occurring amino acid
SLAGTKNXXXXXXXXXXXXXHIHL

SEQ ID NO: 32940 - protein, 197 aa, Diabrotica virgifera
  misc_feature: Coding regions on vcDNA: vcDNA=SeqID_12637; Strand=+; Position=158-751
  misc_feature: Homolog annotation: Hit_ID=CAA29656.1; Match level="QueryCoverage =85%, HitCoverage=40%, E-value=1e-48, Identity=52%"; Hit description =serine pyruvate aminotransferase precursor (AA -22 to 392) [Rattus rattus] pir||XNRTSP serine-pyruvate tra
  misc_feature: Gene Ontology Annotation: Molecular function=alanine-glyoxylate aminotransferase activity; Cellular component=extracellular space
  misc_feature (136)..(142): Xaa can be any naturally occurring amino acid
MEIPAPETLKKPLVVPNKLLMGAGPANLSPRVLHAMSHGVLGHMHEETFKIMDEIKEGIKYVFQTKNETSLAISASGHTGMEAILCNILEPGDRVLIAVNGLWGLRAADMAERYGAVPIKMSTLPGDNFSFTEIEXXXXXXXPKLLFIVQGETSTGVHQPIEGLGDLCHKMHICEEHSNQSLLLGYESSRPTVELLQ

SEQ ID NO: 32941 - protein, 303 aa, Diabrotica virgifera
  misc_feature: Coding regions on vcDNA: vcDNA=SeqID_12638; Strand=+; Position=2-913
  misc_feature: Homolog annotation: Hit_ID=AAF87760.1; Match level="QueryCoverage =99%, HitCoverage=68%, E-value=1e-109, Identity=70%"; Hit description= cytochrome oxidase subunit I [Diabrotica virgifera zeae]
  misc_feature: Pfam annotation: Pfam_ID=COX1; Match level="Score=54.0, E-value=4.2e -13, Copies=1"; Pfam description=Cytochrome C and Quinol oxidase polyp
  misc_feature (41)..(49): Xaa can be any naturally occurring amino acid
  misc_feature (53)..(59): Xaa can be any naturally occurring amino acid
  misc_feature (70)..(77): Xaa can be any naturally occurring amino acid
  misc_feature (98)..(98): Xaa can be any naturally occurring amino acid
  misc_feature (133)..(133): Xaa can be any naturally occurring amino acid
  misc_feature (150)..(150): Xaa can be any naturally occurring amino acid
  misc_feature (153)..(159): Xaa can be any naturally occurring amino acid
  misc_feature (186)..(192): Xaa can be any naturally occurring amino acid
  misc_feature (206)..(206): Xaa can be any naturally occurring amino acid
  misc_feature (214)..(230): Xaa can be any naturally occurring amino acid
  misc_feature (260)..(260): Xaa can be any naturally occurring amino acid
  misc_feature (276)..(283): Xaa can be any naturally occurring amino acid
TAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXKVFSFQRKRLKPLRITSFIG

SEQ ID NO: 32942 - protein, 190 aa, Diabrotica virgifera
  misc_feature: Coding regions on vcDNA: vcDNA=SeqID_12639; Strand=-; Position=4-576
  misc_feature (21)..(27): Xaa can be any naturally occurring amino acid
  misc_feature (41)..(49): Xaa can be any naturally occurring amino acid
  misc_feature (51)..(64): Xaa can be any naturally occurring amino acid
  misc_feature (71)..(83): Xaa can be any naturally occurring amino acid
  misc_feature (85)..(185): Xaa can be any naturally occurring amino acid
FFLHFNIDVNIKIMLYIWSFXXXXXXXLKDRTQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAKVA

SEQ ID NO: 32943 - protein, 34 aa, Diabrotica virgifera
  misc_feature: Coding regions on vcDNA: vcDNA=SeqID_12640; Strand=-; Position=3-104
  misc_feature (5)..(34): Xaa can be any naturally occurring amino acid
MIIVXXXXXXXXXXXXXXXXXXXXXXXXXXXXXX

SEQ ID NO: 32944 - protein, 49 aa, Diabrotica virgifera
  misc_feature: Coding regions on vcDNA: vcDNA=SeqID_12641; Strand=+; Position=588-734
  misc_feature: Homolog annotation: Hit_ID=CAE47502.1; Match level="QueryCoverage =93%, HitCoverage=13%, E-value=8e-11, Identity=67%"; Hit description =cathepsin B-like proteinase [Diabrotica virgifera virgifera]
MFNYHTKGIRETCSTLDYDTPSWRHMCDHSALNYLSELTFGSRCERNSY

SEQ ID NO: 32945 - protein, 74 aa, Diabrotica virgifera
  misc_feature: Coding regions on vcDNA: vcDNA=SeqID_12642; Strand=-; Position=105-329
FLFIRMFHLKNLLNPLSTSRINTNLLHILIKERSSHSILHLAFLIKERSSRSILHLAFHQLYKFTSSRASKTIS

SEQ ID NO: 32946 - protein, 165 aa, Diabrotica virgifera
  misc_feature: Coding regions on vcDNA: vcDNA=SeqID_12643; Strand=+; Position=49-546
  misc_feature: Homolog annotation: Hit_ID=XP_392247.1; Match level="QueryCoverage =98%, HitCoverage=100%, E-value=6e-22, Identity=37%"; Hit description= similar to RIKEN cDNA 2610510L01 [Apis mellifera]
  misc_feature: Pfam annotation: Pfam_ID=zf-U1; Match level="Score=29.0, E-value=8.4e- 06, Copies=1"; Pfam description=U1 zinc finger
  misc_feature (76)..(81): Xaa can be any naturally occurring amino acid
MMGRRYYCDYCEKCFIDDLDARKKHLQSANHIKLRNMHYESCRDPETVLKEELLKIPCRRFSQGSCPFEGVCRFTXXXXXXLCELRKQVENIQQMRRKQKEEVPPVPPLEKWIEHYEINNKDASDKVHLFWTYPENLENRNDLPPSLIKFRPEHFYDDNFEEWGK

SEQ ID NO: 32947 - protein, 251 aa, Diabrotica virgifera
  misc_feature: Coding regions on vcDNA: vcDNA=SeqID_12644; Strand=+; Position=67-819
  misc_feature: Homolog annotation: Hit_ID=XP_392698.1; Match level="QueryCoverage =76%, HitCoverage=33%, E-value=6e-25, Identity=38%"; Hit description =similar to carboxylesterase [Apis mellifera]
  misc_feature: Gene Ontology Annotation: Molecular function=carboxylesterase activity
  misc_feature: Pfam annotation: Pfam_ID=COesterase; Match level="Score=-224.2, E -value=0.065, Copies=1"; Pfam description=Carboxylesterase
TVWWRMNSLGFLSTEDNVFPANLGLKDQLMVLKWVNKNIELFGGDPTKVTLGGHSAGAILTGYHLLSKKSKGLFRSAIVQSGTPLMSFGYIANPRKFAFMLGEKLSRDFHSSMNTSQDLLKLLRSLPGKEVAQVNLGNIEGFDYKLVEFRSTWAPTKEDPNYEHAFLTDDTMHENFKKGHFNQVPVMIGITDEEFKDYGNLTRAGLLVDSNYSLLIDPVVPMVNTNRFAQNATGMAKILSDILYGIPIMTN

SEQ ID NO: 32948 - protein, 183 aa, Diabrotica virgifera
  misc_feature: Coding regions on vcDNA: vcDNA=SeqID_12645; Strand=+; Position=1-552
  misc_feature: Homolog annotation: Hit_ID=NP_608540.1; Match level="QueryCoverage =98%, HitCoverage=57%, E-value=1e-09, Identity=27%"; Hit description =CG2839-PA [Drosophila melanogaster] gb|AAF51469.2| CG2839-PA [Drosophila melanogaster]
  misc_feature (105)..(127): Xaa can be any naturally occurring amino acid
FRRPEQRRRRGGRFFKNGGKPPKEDSRNEEKRRTEGKIIDRREEETEPKEQGKHERDSNERHRRPERPEERKGREKRPKPRTREQPKGRHRQKEEEREEQTTRRXXXXXXXXXXXXXXXXXXXXXXXPKGTKHTDAGRRRQRAAKGTPKDKPRADARQRRRRGKPGGDPKETPGRKAPIRRVG

SEQ ID NO: 32949 - protein, 288 aa, Diabrotica virgifera
  misc_feature: Coding regions on vcDNA: vcDNA=SeqID_12646; Strand=+; Position=1-862
  misc_feature: Homolog annotation: Hit_ID=XP_308929.1; Match level="QueryCoverage =100%, HitCoverage=28%, E-value=1e-130, Identity=80%"; Hit description=ENSANGP00000013171 [Anopheles gambiae]
  misc_feature: Gene Ontology Annotation: Molecular function=positive transcription elongation factor activity; Cellular component=nucleoplasm; Biological process=nucleosome disassembly
  misc_feature (77)..(83): Xaa can be any naturally occurring amino acid
  misc_feature (138)..(148): Xaa can be any naturally occurring amino acid
  misc_feature (202)..(209): Xaa can be any naturally occurring amino acid
  misc_feature (239)..(239): Xaa can be any naturally occurring amino acid
  misc_feature (245)..(245): Xaa can be any naturally occurring amino acid
  misc_feature (262)..(262): Xaa can be any naturally occurring amino acid
  misc_feature (272)..(272): Xaa can be any naturally occurring amino acid
  misc_feature (280)..(280): Xaa can be any naturally occurring amino acid
IEGDYTYLRINFFHPGTTMGRNEGNVWSQPEATFLKELTYRSTNTKEPGVVTAPSSNLNTAFRLIKEVQRKFKTREXXXXXXXDLVKQDTLVLSQNKGNPKLKDLYIRPNIVSKRMTGSLEAHTNGFRYTSVRGDKVXXXXXXXXXXXFQPCDGEMIILLHFHLKHAIMFGKKKHVDVQFYTEVGEITTDLGKHQHMHDRDXXXXXXXXRELRQKLKTAFKSFCEKVESMTKQEIEFDXPFRELXFPGAPFRSTVLLQPTSXGCLVNLTEWXPPFVVTLXEDVELVHF

SEQ ID NO: 32950 - protein, 47 aa, Diabrotica virgifera
  misc_feature: Coding regions on vcDNA: vcDNA=SeqID_12647; Strand=+; Position=85-228
QSRLSCLFDISYIIGKSWIPDLDLTYSVWLNFKIRRMVLGLLSCLLH

SEQ ID NO: 32951 - protein, 252 aa, Diabrotica virgifera
  misc_feature: Coding regions on vcDNA: vcDNA=SeqID_12648; Strand=+; Position=7-760
  misc_feature: Homolog annotation: Hit_ID=XP_515547.1; Match level="QueryCoverage =99%, HitCoverage=63%, E-value=1e-62, Identity=46%"; Hit description =PREDICTED: similar to NN8-4AG [Pan troglodytes]
  misc_feature: Gene Ontology Annotation: Molecular function=molecular_function unknown; Cellular component=cellular_component unknown; Biological process=biological_process unknown
  misc_feature (230)..(230): Xaa can be any naturally occurring amino acid
MDVEVRITDSLKGKGLYAKRDFPKDAVIFQEDPLVSCQFSWNAEYKYLACDHCLRPLETAHENATRLAGHPMVLPYPDCCSTDKSKIVSCPHCSTKYCSDPRRVEAYSQYHNTLCHENNSNHPLERLNDVWKKVHYPPETNSIMLIVRLLARIRQAPNRDAAIAQTLQFCHRTVNEDADLAHKLLGDKFADQLSLLHNSLVAAIPNDGIEQFLPYEGFLRMMGLIGTNGXQGVGTSAIALWVSKKKNLTLLN

SEQ ID NO: 32952 - protein, 66 aa, Diabrotica virgifera; identical to SEQ ID NO: 26808
  misc_feature: Coding regions on vcDNA: vcDNA=SeqID_12649; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32953 - protein, 120 aa, Diabrotica virgifera
  misc_feature: Coding regions on vcDNA: vcDNA=SeqID_12650; Strand=-; Position=529-891
  misc_feature (3)..(3): Xaa can be any naturally occurring amino acid
  misc_feature (7)..(7): Xaa can be any naturally occurring amino acid
  misc_feature (29)..(29): Xaa can be any naturally occurring amino acid
  misc_feature (31)..(31): Xaa can be any naturally occurring amino acid
  misc_feature (33)..(33): Xaa can be any naturally occurring amino acid
  misc_feature (108)..(113): Xaa can be any naturally occurring amino acid
NMXMQSXLKYTYSIVIFVKLNIYISNRQXHXRXNIMPVTFLNPSNICTGMSIYHGFKYIIFDFNKSTKNTGAILPYNILLLNHLSNLQLAQTRHIVYLDVLQYLCWVXXXXXXSNILLLC

SEQ ID NO: 32954 - protein, 66 aa, Diabrotica virgifera; identical to SEQ ID NO: 26808
  misc_feature: Coding regions on vcDNA: vcDNA=SeqID_12651; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32955 - protein, 57 aa, Diabrotica virgifera
  misc_feature: Coding regions on vcDNA: vcDNA=SeqID_12652; Strand=-; Position=0-170
  misc_feature (5)..(26): Xaa can be any naturally occurring amino acid
  misc_feature (28)..(54): Xaa can be any naturally occurring amino acid
KKIGXXXXXXXXXXXXXXXXXXXXXXAXXXXXXXXXXXXXXXXXXXXXXXXXXXSSR

SEQ ID NO: 32956 - protein, 140 aa, Diabrotica virgifera
  misc_feature: Coding regions on vcDNA: vcDNA=SeqID_12653; Strand=-; Position=1-420
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(133): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXHPRTREG

SEQ ID NO: 32957 - protein, 179 aa, Diabrotica virgifera
  misc_feature: Coding regions on vcDNA: vcDNA=SeqID_12654; Strand=-; Position=0-536
  misc_feature (3)..(10): Xaa can be any naturally occurring amino acid
  misc_feature (12)..(178): Xaa can be any naturally occurring amino acid
KKXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 32958 - protein, 66 aa, Diabrotica virgifera; identical to SEQ ID NO: 26808
  misc_feature: Coding regions on vcDNA: vcDNA=SeqID_12655; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32959 - protein, 18 aa, Diabrotica virgifera
  misc_feature: Coding regions on vcDNA: vcDNA=SeqID_12656; Strand=+; Position=1-54
  misc_feature (1)..(8): Xaa can be any naturally occurring amino acid
XXXXXXXXQYETLLITVY

SEQ ID NO: 32960 - protein, 101 aa, Diabrotica virgifera
  misc_feature: Coding regions on vcDNA: vcDNA=SeqID_12657; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (60)..(82): Xaa can be any naturally occurring amino acid
RXXXXXXXXXXXXXXXXXXXKKXXXXXXXRRPYRXXXXXXXXXXXXXXXXXXXXXXGVIXXXXXXXXXXXXXXXXXXXXXXXIRINYLRDNSVILLESSNR

SEQ ID NO: 32961 - protein, 34 aa, Diabrotica virgifera; identical to SEQ ID NO: 27603
  misc_feature: Coding regions on vcDNA: vcDNA=SeqID_12658; Strand=-; Position=80-184

SEQ ID NO: 32962 - protein, 34 aa, Diabrotica virgifera
  misc_feature: Coding regions on vcDNA: vcDNA=SeqID_12659; Strand=-; Position=80-184
FYWRVQIDNKDCDLDVGLKFIIGVEAILLSLFDF

SEQ ID NO: 32963 - protein, 95 aa, Diabrotica virgifera
  misc_feature: Coding regions on vcDNA: vcDNA=SeqID_12660; Strand=+; Position=224-511
  misc_feature (27)..(34): Xaa can be any naturally occurring amino acid
PRLAIALVMKPQLLKKSFSSLYNSLIXXXXXXXXSTSLAFPHTIIRLGLRNYEYLTTFDPGISIFLQLRFLHPFLYLPMTWYFSNYPTFPSKINI

SEQ ID NO: 32964 - protein, 73 aa, Diabrotica virgifera
  misc_feature: Coding regions on vcDNA: vcDNA=SeqID_12661; Strand=+; Position=605-823
  misc_feature (24)..(68): Xaa can be any naturally occurring amino acid
NFVNFSMCFVINTLSICYFSKRLXXXXXXXXXXXXXXXXXXXXXXXXXXXXXXXXXXXXXXXXXXXXXFKRIQ

SEQ ID NO: 32965 - protein, 130 aa, Diabrotica virgifera
  misc_feature: Coding regions on vcDNA: vcDNA=SeqID_12662; Strand=-; Position=33-425
QRKTQVVKNVPLEHIDACNHARKEASYKQALSYVYTGATSCSTNACVTAHGVMNKRQTLRMPCLKLKSRNFIAHGLTHEVQNLLDFSFNFPFNSCCLLRLISVIKSNIAIMSSENITETCRVAAVSKKIM

SEQ ID NO: 32966 - protein, 206 aa, Diabrotica virgifera
  misc_feature: Coding regions on vcDNA: vcDNA=SeqID_12663; Strand=-; Position=1-618
  misc_feature (1)..(206): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32967 - protein, 40 aa, Diabrotica virgifera
  misc_feature: Coding regions on vcDNA: vcDNA=SeqID_12664; Strand=+; Position=3-125
  misc_feature (1)..(23): Xaa can be any naturally occurring amino acid
XXXXXXXXXXXXXXXXXXXXXXXVGLTIFILDYMLFFMYK

SEQ ID NO: 32968 - protein, 30 aa, Diabrotica virgifera
  misc_feature: Coding regions on vcDNA: vcDNA=SeqID_12665; Strand=+; Position=2-94
  misc_feature (2)..(27): Xaa can be any naturally occurring amino acid
MXXXXXXXXXXXXXXXXXXXXXXXXXXGTL

SEQ ID NO: 32969 - protein, 61 aa, Diabrotica virgifera
  misc_feature: Coding regions on vcDNA: vcDNA=SeqID_12666; Strand=-; Position=3-185
  misc_feature (2)..(19): Xaa can be any naturally occurring amino acid
  misc_feature (21)..(30): Xaa can be any naturally occurring amino acid
  misc_feature (35)..(35): Xaa can be any naturally occurring amino acid
  misc_feature (37)..(38): Xaa can be any naturally occurring amino acid
  misc_feature (42)..(61): Xaa can be any naturally occurring amino acid
HXXXXXXXXXXXXXXXXXXFXXXXXXXXXXSSRLXKXXKAFXXXXXXXXXXXXXXXXXXXX

SEQ ID NO: 32970 - protein, 76 aa, Diabrotica virgifera
  misc_feature: Coding regions on vcDNA: vcDNA=SeqID_12667; Strand=+; Position=205-435
TFLGGQLLCKVSWYCVDILFSFAIRSLGRAPYSPGCSMSPSLLLFLSFPPPSIYTSFIILSTGYLVTFAVGARFLY

SEQ ID NO: 32971 - protein, 40 aa, Diabrotica virgifera; identical to SEQ ID NO: 29961
  misc_feature: Coding regions on vcDNA: vcDNA=SeqID_12668; Strand=-; Position=1-120
  misc_feature (1)..(40): Xaa can be any naturally occurring amino acid

SEQ ID NO: 32972 - protein, 82 aa, Diabrotica virgifera
  misc_feature: Coding regions on vcDNA: vcDNA=SeqID_12669; Strand=-; Position=0-245
  misc_feature (3)..(50): Xaa can be any naturally occurring amino acid
  misc_feature (54)..(81): Xaa can be any naturally occurring amino acid
KMXXXXXXXXXXXXXXXXXXXXXXXXXXXXXXXXXXXXXXXXXXXXXXXXLLVXXXXXXXXXXXXXXXXXXXXXXXXXXXXS

SEQ ID NO: 32973 - protein, 72 aa, Diabrotica virgifera
  misc_feature: Coding regions on vcDNA: vcDNA=SeqID_12670; Strand=+; Position=87-305
  misc_feature: Homolog annotation: Hit_ID=XP_320749.1; Match level="QueryCoverage =94%, HitCoverage=78%, E-value=4e-34, Identity=100%"; Hit description= ENSANGP00000020255 [Anopheles gambiae]
  misc_feature: Pfam annotation: Pfam_ID=RNA_pol_N; Match level="Score=132.4, E-value= 1.1e-36, Copies=1"; Pfam description=RNA polymerases N / 8 kDa subunit
SVRFTMIIPVRCFTCGKVIGNKWEAYLGLLQAEYTEGDALDALGLKRYCCRRMLLGHVDLIEKLLNYAPLEK

SEQ ID NO: 32974 - protein, 84 aa, Diabrotica virgifera
  misc_feature: Coding regions on vcDNA: vcDNA=SeqID_12671; Strand=+; Position=3-257
  misc_feature (2)..(27): Xaa can be any naturally occurring amino acid
  misc_feature (40)..(53): Xaa can be any naturally occurring amino acid
  misc_feature (58)..(70): Xaa can be any naturally occurring amino acid
  misc_feature (74)..(83): Xaa can be any naturally occurring amino acid
PXXXXXXXXXXXXXXXXXXXXXXXXXXQSKLRINKLFTKXXXXXXXXXXXXXXMLNYXXXXXXXXXXXXXKKRXXXXXXXXXXI

SEQ ID NO: 32975 - protein, 96 aa, Diabrotica virgifera
  misc_feature: Coding regions on vcDNA: vcDNA=SeqID_12672; Strand=+; Position=2-292
  misc_feature (2)..(80): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXYRFSMWNSATLFSPVN

SEQ ID NO: 32976 - protein, 90 aa, Diabrotica virgifera
  misc_feature: Coding regions on vcDNA: vcDNA=SeqID_12673; Strand=+; Position=1-273
  misc_feature: Homolog annotation: Hit_ID=AAK69205.1; Match level="QueryCoverage =93%, HitCoverage=10%, E-value=3e-22, Identity=55%"; Hit description =transglutaminase [Pacifastacus leniusculus]
  misc_feature: Gene Ontology Annotation: Molecular function=protein-glutamine gamma -glutamyltransferase activity; Cellular component=cellular_component unknown; Biological process=epidermal differentiation
GGWQVIDATPQEVSDSVMRCGPASIEAVRKGEVGFLYDTPFVFSEVNADVVHFQEDEESDWGFSTTSVNQDHVGSLILSNETGPTVYNGD

SEQ ID NO: 32977 - protein, 204 aa, Diabrotica virgifera
  misc_feature: Coding regions on vcDNA: vcDNA=SeqID_12674; Strand=+; Position=6-654
  misc_feature: Homolog annotation: Hit_ID=XP_396097.1; Match level="QueryCoverage =97%, HitCoverage=97%, E-value=3e-76, Identity=69%"; Hit description =similar to hypothetical protein FLJ22965 [Apis mellifera]
  misc_feature (5)..(5): Xaa can be any naturally occurring amino acid
  misc_feature (8)..(8): Xaa can be any naturally occurring amino acid
LSRRXSRXIAWAASKDQEEYGDEKPLHIYYCLCGQMTLILDCSIEKLPLRKRDAARVLDGTNHAHKITCNPDETVYLKRPEGIERQYRMKCKKCGLLLYYKHEPQSPISFIVKGSLIKSTNEGPINNIYNQVAIQKPKKIMVTKHTKNMGKFSSVTKPLEVADSYANNARIIEKQLERKGMTKRKQEQNKINDIKKVRGTLIDK

SEQ ID NO: 32978 - protein, 169 aa, Diabrotica virgifera
  misc_feature: Coding regions on vcDNA: vcDNA=SeqID_12675; Strand=-; Position=1-507
  misc_feature (1)..(45): Xaa can be any naturally occurring amino acid
  misc_feature (51)..(65): Xaa can be any naturally occurring amino acid
  misc_feature (67)..(73): Xaa can be any naturally occurring amino acid
  misc_feature (89)..(122): Xaa can be any naturally occurring amino acid
  misc_feature (125)..(135): Xaa can be any naturally occurring amino acid
  misc_feature (145)..(152): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(166): Xaa can be any naturally occurring amino acid
XXXXXXXXXXXXXXXXXXXXXXXXXXXXXXXXXXXXXXXXXXXXXSPGKNXXXXXXXXXXXXXXXLXXXXXXXLKQSDINKDALQRTPXXXXXXXXXXXXXXXXXXXXXXXXXXXXXXXXXXPFXXXXXXXXXXXTNLAHTGLNXXXXXXXXSKKGYNIIXVXTRXPIE

SEQ ID NO: 32979 - protein, 74 aa, Diabrotica virgifera
  misc_feature: Coding regions on vcDNA: vcDNA=SeqID_12676; Strand=+; Position=1-222
  misc_feature (1)..(58): Xaa can be any naturally occurring amino acid
XXXXXXXXXXXXXXXXXXXXXXXXXXXXXXXXXXXXXXXXXXXXXXXXXXXXXXXXXXTNPYKGCFKIISISCF

SEQ ID NO: 32980 - protein, 65 aa, Diabrotica virgifera
  misc_feature: Coding regions on vcDNA: vcDNA=SeqID_12677; Strand=+; Position=87-284
  misc_feature (6)..(14): Xaa can be any naturally occurring amino acid
  misc_feature (24)..(32): Xaa can be any naturally occurring amino acid
  misc_feature (34)..(42): Xaa can be any naturally occurring amino acid
GIETAXXXXXXXXXEFSLWTSGIXXXXXXXXXLXXXXXXXXXDQYYDRKINTLHNFCVKVCVLHF

SEQ ID NO: 32981 - protein, 167 aa, Diabrotica virgifera
  misc_feature: Coding regions on vcDNA: vcDNA=SeqID_12678; Strand=+; Position=4-507
  misc_feature (2)..(14): Xaa can be any naturally occurring amino acid
  misc_feature (22)..(55): Xaa can be any naturally occurring amino acid
  misc_feature (60)..(111): Xaa can be any naturally occurring amino acid
  misc_feature (122)..(149): Xaa can be any naturally occurring amino acid
  misc_feature (158)..(166): Xaa can be any naturally occurring amino acid
LXXXXXXXXXXXXXFVACVSGXXXXXXXXXXXXXXXXXXXXXXXXXXXXXXXXXXWNVIXXXXXXXXXXXXXXXXXXXXXXXXXXXXXXXXXXXXXXXXXXXXXXXXXXXXMIINLHILMYXXXXXXXXXXXXXXXXXXXXXXXXXXXXKDDNIIINXXXXXXXXXG

SEQ ID NO: 32982 - protein, 113 aa, Diabrotica virgifera
  misc_feature: Coding regions on vcDNA: vcDNA=SeqID_12679; Strand=-; Position=106-447
LLINNIVPQEIISNFSLMFLRSPSLHIFIYAASIIAISCSLSIFFKDVSPFAHRHPSFSVDIRRYRYIYEEGIANISYLFCFFVVYINLCNHNTFYKLYFLCFLYYKYSDHCL

SEQ ID NO: 32983 - protein, 38 aa, Diabrotica virgifera
  misc_feature: Coding regions on vcDNA: vcDNA=SeqID_12680; Strand=+; Position=1-114
  misc_feature (2)..(9): Xaa can be any naturally occurring amino acid
  misc_feature (14)..(22): Xaa can be any naturally occurring amino acid
  misc_feature (32)..(38): Xaa can be any naturally occurring amino acid
QXXXXXXXXKRPLXXXXXXXXXFSTYNFFEYXXXXXXX

SEQ ID NO: 32984 - protein, 38 aa, Diabrotica virgifera
  misc_feature: Coding regions on vcDNA: vcDNA=SeqID_12681; Strand=-; Position=0-113
  misc_feature (22)..(34): Xaa can be any naturally occurring amino acid
VSTTHLMIIIPKHGQNRPAIQXXXXXXXXXXXXXKRQS

SEQ ID NO: 32985 - protein, 54 aa, Diabrotica virgifera
  misc_feature: Coding regions on vcDNA: vcDNA=SeqID_12682; Strand=+; Position=1-165
  misc_feature (1)..(36): Xaa can be any naturally occurring amino acid
XXXXXXXXXXXXXXXXXXXXXXXXXXXXXXXXXXXXVFGGTPGIKLNLDYYVHL

SEQ ID NO: 32986 - protein, 44 aa, Diabrotica virgifera
  misc_feature: Coding regions on vcDNA: vcDNA=SeqID_12683; Strand=-; Position=2-133
  misc_feature (16)..(44): Xaa can be any naturally occurring amino acid
NPCQMNFLNLDRGMVXXXXXXXXXXXXXXXXXXXXXXXXXXXXX

SEQ ID NO: 32987 - protein, 156 aa, Diabrotica virgifera
  misc_feature: Coding regions on vcDNA: vcDNA=SeqID_12684; Strand=+; Position=162-629
EEEIISSMNRIQVLRVTTKSEFLKYLLFIKHSVDNGKPIKLVIIDSLPPLCFISSDQTENNAFLCYTANILHYLAKEHNMVIIVTNLITLWNEGDFKNIDVMKERISCGTYWFGMPNVRICLKKDKYNCRMTLTKAIKVIPEVNFCDVKFTDEGFV

SEQ ID NO: 32988 - protein, 60 aa, Diabrotica virgifera
  misc_feature: Coding regions on vcDNA: vcDNA=SeqID_12685; Strand=-; Position=170-352
GGKPVDPVPPPLFHFCVYSILKEPGVAIEYIQLFYAGIGYDVSTNYKAFQSNSLTYLYTK

SEQ ID NO: 32989 - protein, 131 aa, Diabrotica virgifera
  misc_feature: Coding regions on vcDNA: vcDNA=SeqID_12686; Strand=-; Position=344-739
  misc_feature (11)..(30): Xaa can be any naturally occurring amino acid
  misc_feature (37)..(66): Xaa can be any naturally occurring amino acid
  misc_feature (71)..(90): Xaa can be any naturally occurring amino acid
  misc_feature (92)..(111): Xaa can be any naturally occurring amino acid
  misc_feature (122)..(128): Xaa can be any naturally occurring amino acid
NKGTFFFIRPXXXXXXXXXXXXXXXXXXXXPRPFKFXXXXXXXXXXXXXXXXXXXXXXXXXXXXXXSYILXXXXXXXXXXXXXXXXXXXXEXXXXXXXXXXXXXXXXXXXXNYMFSYMKIYXXXXXXXLKF

SEQ ID NO: 32990 - protein, 166 aa, Diabrotica virgifera
  misc_feature: Coding regions on vcDNA: vcDNA=SeqID_12687; Strand=+; Position=87-587
  misc_feature: Homolog annotation: Hit_ID=EAL26089.1; Match level="QueryCoverage =93%, HitCoverage=29%, E-value=7e-23, Identity=38%"; Hit description =GA20937-PA [Drosophila pseudoobscura]
  misc_feature: Gene Ontology Annotation: Cellular component=actin filament; Biological process=cell organization and biogenesis
  misc_feature (43)..(43): Xaa can be any naturally occurring amino acid
MPLHPPFAPMFAQMVRDYSRYYSGVIKTVITSIVLCQEFEHAXETADVPNVMINLVVNHFDTQFATTDTPTLMLELPIDHPVILLMILRNSEEDAETIYVTIFAIILFEDLVEQAQQLFPPVLTPKEIAKVLDKCLYNLPKLISNLICDPRNIVKIFVYLLNLHTN

SEQ ID NO: 32991 - protein, 75 aa, Diabrotica virgifera
  misc_feature: Coding regions on vcDNA: vcDNA=SeqID_12688; Strand=+; Position=443-670
YIYIHNNTHSKIEDHYRNKFKNGFLYSCDVSLSTTVGVGNRSKCLRTLTPRCTERPIPYLIYSYYVYALYTSLNI

SEQ ID NO: 32992 - protein, 252 aa, Diabrotica virgifera
  misc_feature: Coding regions on vcDNA: vcDNA=SeqID_12689; Strand=-; Position=1-756
  misc_feature (4)..(252): Xaa can be any naturally occurring amino acid
SRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32993 - protein, 109 aa, Diabrotica virgifera
  misc_feature: Coding regions on vcDNA: vcDNA=SeqID_12690; Strand=-; Position=315-644
  misc_feature: Homolog annotation: Hit_ID=EAA21331.1; Match level="QueryCoverage =96%, HitCoverage=90%, E-value=6e-21, Identity=58%"; Hit description =hypothetical protein [Plasmodium yoelii yoelii]
  misc_feature (36)..(36): Xaa can be any naturally occurring amino acid
  misc_feature (75)..(75): Xaa can be any naturally occurring amino acid
QNSNTSFLTATTLIYAIGAGISAAAGTRLALQLILXKGLECTHSDYGASDESRIVIFRHYLPVPGVGNLRACCLXLDVVAVSQAPSPESNPDSPLPVTTMVGAEPTIDS

SEQ ID NO: 32994 - protein, 261 aa, Diabrotica virgifera
  misc_feature: Coding regions on vcDNA: vcDNA=SeqID_12691; Strand=+; Position=93-878
  misc_feature: Homolog annotation: Hit_ID=EAA44839.2; Match level="QueryCoverage =88%, HitCoverage=43%, E-value=2e-69, Identity=51%"; Hit description =ENSANGP00000024908 [Anopheles gambiae str. PEST] ref|XP_563105.1| ENSANGP00000024908 [Anopheles gambiae st
  misc_feature (129)..(136): Xaa can be any naturally occurring amino acid
MKLQEYPELNKMDEPATTRYSNKFLHYFKYVTVEPTMLLYMMAFMTTNVAEQSFYVYKTCTINHGYNKTICDNINAPEYKNISKEVQASTAKFHVWNNIAGHVTPIILALFIGAWSDKRGRKLPLLIGXXXXXXXXLMIIVNTLQPSWPVEYVVFTATLPSALTGADVTIFATAFAYLVDVSSVSNRTMRVTILEVCYLASMPLGIAFGAYLFKFVFNRSYTYMFVVNSILMVLAILYTSLRLSWRSNSMQRPLSEASTNF

SEQ ID NO: 32995 - protein, 303 aa, Diabrotica virgifera
  misc_feature: Coding regions on vcDNA: vcDNA=SeqID_12692; Strand=+; Position=1-909
  misc_feature: Homolog annotation: Hit_ID=XP_396765.1; Match level="QueryCoverage =100%, HitCoverage=19%, E-value=2e-72, Identity=43%"; Hit description= similar to ENSANGP00000020352 [Apis mellifera]
  misc_feature (67)..(74): Xaa can be any naturally occurring amino acid
  misc_feature (146)..(152): Xaa can be any naturally occurring amino acid
  misc_feature (245)..(253): Xaa can be any naturally occurring amino acid
  misc_feature (257)..(257): Xaa can be any naturally occurring amino acid
  misc_feature (268)..(268): Xaa can be any naturally occurring amino acid
NHFNIPVGKTDLLKPPKSFPTPVTRYTLCDMTVEWHMYGGNDFKIAESENKKKTVQFSETQLNDTVXXXXXXXXEVHITSNMDKKRANMNWIVKGGVNRDHDVHMELHLNKVRFQHEVYPETTTQASRQVLIISDVEIVDRLESSXXXXXXXQYTSQSRPKQSHAHMVVIKSLHIRPDPKLPTQECCLKVSILPLRLNIDQDSLLFLINFFSDLSDDHCEKTDDQGNISKHNTPTHHPPVMTISXXXXXXXXXQALXVVDENLILLMXESRHQFDLDNDSVNSTSTTSDGSPVFFRNLISSLE

SEQ ID NO: 32996 - protein, 108 aa, Diabrotica virgifera
  misc_feature: Coding regions on vcDNA: vcDNA=SeqID_12693; Strand=-; Position=1-324
  misc_feature (8)..(15): Xaa can be any naturally occurring amino acid
  misc_feature (17)..(41): Xaa can be any naturally occurring amino acid
  misc_feature (48)..(65): Xaa can be any naturally occurring amino acid
  misc_feature (70)..(87): Xaa can be any naturally occurring amino acid
  misc_feature (90)..(106): Xaa can be any naturally occurring amino acid
ETKPNPSXXXXXXXXLXXXXXXXXXXXXXXXXXXXXXXXXXPLIYSSXXXXXXXXXXXXXXXXXXDIQSXXXXXXXXXXXXXXXXXXITXXXXXXXXXXXXXXXXXLK

SEQ ID NO: 32997 - protein, 70 aa, Diabrotica virgifera
  misc_feature: Coding regions on vcDNA: vcDNA=SeqID_12694; Strand=+; Position=216-428
NIFKKSGLKKSMYHYSFIFGYRNVHNMHNAFLYKFSNTKFSKKNMLKNLLTLRIVPLPICTYSYEMSWNQ

SEQ ID NO: 32998 - protein, 69 aa, Diabrotica virgifera
  misc_feature: Coding regions on vcDNA: vcDNA=SeqID_12695; Strand=-; Position=633-842
TTTDGRRSRRRCDFTNKRILKWYNKNSKNGKAVGPDQIPVRQLKFVNDKTLVDMYTTTYKTQDIFIPKE

SEQ ID NO: 32999 - protein, 54 aa, Diabrotica virgifera
  misc_feature: Coding regions on vcDNA: vcDNA=SeqID_12696; Strand=+; Position=2-163
  misc_feature (3)..(46): Xaa can be any naturally occurring amino acid
LLXXXXXXXXXXXXXXXXXXXXXXXXXXXXXXXXXXXXXXXXXXXXNNYPRDTA

SEQ ID NO: 33000 - protein, 255 aa, Diabrotica virgifera
  misc_feature: Coding regions on vcDNA: vcDNA=SeqID_12697; Strand=+; Position=3-770
  misc_feature: Homolog annotation: Hit_ID=XP_393231.1; Match level="QueryCoverage =98%, HitCoverage=27%, E-value=3e-28, Identity=35%"; Hit description =similar to Myb protein [Apis mellifera]
  misc_feature: Gene Ontology Annotation: Molecular function=transcription factor activity; Cellular component=chromatin; Biological process=anti -apoptosis
MSSTPKGPQSALVSTPVKDRARPDRDYSPLSTPRGPSSILKAEPTASCSTTDVTATPNKRFTSDTPRTPTPFKKALADLEMKSGPIKNLPDTPSSRLEDITEIMKKDQDSSHYETDTSVMVTNDSGYMTGKRKGAASSAAGKENVLPSKRVRKALAPSWASSSSQMSSSDISFAVETPSKSLGGDTSILFSTPSSIMKDSLGVTGMMDYHPQAGSSKLDYLWVMIACGQTKDQLELTEQAHKFLKTSGLKPRSNF

SEQ ID NO: 33001 - protein, 19 aa, Diabrotica virgifera
  misc_feature: Coding regions on vcDNA: vcDNA=SeqID_12698; Strand=+; Position=1-57
  misc_feature (1)..(1): Xaa can be any naturally occurring amino acid
  misc_feature (9)..(9): Xaa can be any naturally occurring amino acid
  misc_feature (13)..(13): Xaa can be any naturally occurring amino acid
XITLGDTAXFLLXRVKSII

SEQ ID NO: 33002 - protein, 112 aa, Diabrotica virgifera
  misc_feature: Coding regions on vcDNA: vcDNA=SeqID_12699; Strand=-; Position=479-817
  misc_feature (53)..(60): Xaa can be any naturally occurring amino acid
  misc_feature (64)..(74): Xaa can be any naturally occurring amino acid
MHGNFYNICTNLLHISTCEDKLCIDYMVINITKKFKIFPKKYFYALFNAGITXXXXXXXXGERXXXXXXXXXXXKIRKNTIFGKPILPVQELDLIHKKRTHIPNLVDVGLFV

SEQ ID NO: 33003 - protein, 42 aa, Diabrotica virgifera
  misc_feature: Coding regions on vcDNA: vcDNA=SeqID_12700; Strand=-; Position=3-128
  misc_feature (29)..(36): Xaa can be any naturally occurring amino acid
  misc_feature (38)..(42): Xaa can be any naturally occurring amino acid
HRCCCRISAYKNHDLLFPYLTYANFIILXXXXXXXXNXXXXX

SEQ ID NO: 33004 - protein, 132 aa, Diabrotica virgifera
  misc_feature: Coding regions on vcDNA: vcDNA=SeqID_12701; Strand=+; Position=32-430
  misc_feature: Homolog annotation: Hit_ID=CAE73149.1; Match level="QueryCoverage =88%, HitCoverage=50%, E-value=1e-20, Identity=38%"; Hit description =Hypothetical protein CBG20540 [Caenorhabditis briggsae]
  misc_feature: Gene Ontology Annotation: Cellular component=extracellular space; Biological process=positive regulation of growth rate
MYKVAVLVCFLIAAINASPYGTYGHQDKHVQPVPHVPDHPHGSHGHEEHGGYGPHHGGHQDYTHGSHGHEEHGEHGSHHGGHQDYTYGSHGHEQHGEHGSHHGGQHPGAYGPHGHEQEHQHESHHTYGGHAY

SEQ ID NO: 33005 - protein, 29 aa, Diabrotica virgifera
  misc_feature: Coding regions on vcDNA: vcDNA=SeqID_12702; Strand=-; Position=0-86
  misc_feature (1)..(27): Xaa can be any naturally occurring amino acid
XXXXXXXXXXXXXXXXXXXXXXXXXXXSR

SEQ ID NO: 33006 - protein, 100 aa, Diabrotica virgifera
  misc_feature: Coding regions on vcDNA: vcDNA=SeqID_12703; Strand=+; Position=240-542
  misc_feature: Homolog annotation: Hit_ID=XP_392282.1; Match level="QueryCoverage =84%, HitCoverage=47%, E-value=6e-16, Identity=50%"; Hit description =similar to CG32912-PA [Apis mellifera]
  misc_feature: Gene Ontology Annotation: Molecular function=G-protein coupled receptor activity; Cellular component=integral to plasma membrane; Biological process=signal transduction
  misc_feature (73)..(78): Xaa can be any naturally occurring amino acid
MDTGERSLHSTNVADIREGYYNEFSQACFSMELEKALERRCSIIVIEPTRLDDETARWISFGNYLHKTAIISXXXXXXSGFAWSDTFVSSSTVKNYFFIM

SEQ ID NO: 33007 - protein, 100 aa, Diabrotica virgifera
  misc_feature: Coding regions on vcDNA: vcDNA=SeqID_12704; Strand=+; Position=1-303
  misc_feature (53)..(59): Xaa can be any naturally occurring amino acid
LGSACKVARLRDVGNIRTILMRKDICKHNKLNYIDCELKVTYDSLLQTLHYIXXXXXXXDHSYCYISNFTDFFRNEMLLQFQFDITIKDIHGLYLLSVYM

SEQ ID NO: 33008 - protein, 249 aa, Diabrotica virgifera
  misc_feature: Coding regions on vcDNA: vcDNA=SeqID_12705; Strand=-; Position=1-747
  misc_feature (1)..(249): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33009 - protein, 78 aa, Diabrotica virgifera
  misc_feature: Coding regions on vcDNA: vcDNA=SeqID_12706; Strand=-; Position=96-332
  misc_feature (59)..(65): Xaa can be any naturally occurring amino acid
MAPNSNLSCILGYLVLYPKWSENLKKFDKSIHTDLLTMKLVSFDAYTFSVTVQKLFELXXXXXXXQTEKNQCHLHLPK

SEQ ID NO: 33010 - protein, 32 aa, Diabrotica virgifera
  misc_feature: Coding regions on vcDNA: vcDNA=SeqID_12707; Strand=-; Position=1-96
  misc_feature (3)..(32): Xaa can be any naturally occurring amino acid
HPXXXXXXXXXXXXXXXXXXXXXXXXXXXXXX

SEQ ID NO: 33011 - protein, 84 aa, Diabrotica virgifera
  misc_feature: Coding regions on vcDNA: vcDNA=SeqID_12708; Strand=-; Position=2-253
  misc_feature (5)..(17): Xaa can be any naturally occurring amino acid
  misc_feature (21)..(30): Xaa can be any naturally occurring amino acid
  misc_feature (41)..(49): Xaa can be any naturally occurring amino acid
  misc_feature (51)..(58): Xaa can be any naturally occurring amino acid
  misc_feature (70)..(83): Xaa can be any naturally occurring amino acid
FCFLXXXXXXXXXXXXXVPLXXXXXXXXXXETQPGSPRFKXXXXXXXXXEXXXXXXXXGKVGFNPTSRSXXXXXXXXXXXXXXV

SEQ ID NO: 33012 - protein, 273 aa, Diabrotica virgifera
  misc_feature: Coding regions on vcDNA: vcDNA=SeqID_12709; Strand=-; Position=1-819
  misc_feature (18)..(46): Xaa can be any naturally occurring amino acid
  misc_feature (48)..(273): Xaa can be any naturally occurring amino acid
RGRHLYYRLNSPIKLRCXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33013 - protein, 64 aa, Diabrotica virgifera
  misc_feature: Coding regions on vcDNA: vcDNA=SeqID_12710; Strand=-; Position=0-191
  misc_feature (1)..(52): Xaa can be any naturally occurring amino acid
  misc_feature (57)..(57): Xaa can be any naturally occurring amino acid
  misc_feature (60)..(60): Xaa can be any naturally occurring amino acid
XXXXXXXXXXXXXXXXXXXXXXXXXXXXXXXXXXXXXXXXXXXXXXXXXXXXVSRLXKKXKLLT

SEQ ID NO: 33014 - protein, 119 aa, Diabrotica virgifera; identical to SEQ ID NO: 29283
  misc_feature: Coding regions on vcDNA: vcDNA=SeqID_12711; Strand=+; Position=219-578
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33015 - protein, 58 aa, Diabrotica virgifera
  misc_feature: Coding regions on vcDNA: vcDNA=SeqID_12712; Strand=-; Position=0-173
  misc_feature (3)..(57): Xaa can be any naturally occurring amino acid
KNXXXXXXXXXXXXXXXXXXXXXXXXXXXXXXXXXXXXXXXXXXXXXXXXXXXXXXXG

SEQ ID NO: 33016 - protein, 223 aa, Diabrotica virgifera
  misc_feature: Coding regions on vcDNA: vcDNA=SeqID_12713; Strand=-; Position=2-670
  misc_feature (6)..(12): Xaa can be any naturally occurring amino acid
  misc_feature (14)..(20): Xaa can be any naturally occurring amino acid
  misc_feature (25)..(46): Xaa can be any naturally occurring amino acid
  misc_feature (56)..(68): Xaa can be any naturally occurring amino acid
  misc_feature (71)..(77): Xaa can be any naturally occurring amino acid
  misc_feature (85)..(117): Xaa can be any naturally occurring amino acid
  misc_feature (124)..(145): Xaa can be any naturally occurring amino acid
  misc_feature (155)..(170): Xaa can be any naturally occurring amino acid
  misc_feature (180)..(205): Xaa can be any naturally occurring amino acid
  misc_feature (207)..(222): Xaa can be any naturally occurring amino acid
GVEGGXXXXXXXKXXXXXXXHPPPXXXXXXXXXXXXXXXXXXXXXXVGGGGPARFXXXXXXXXXXXXXKRXXXXXXXEILIGVVXXXXXXXXXXXXXXXXXXXXXXXXXXXXXXXXXKICSGGXXXXXXXXXXXXXXXXXXXXXXGGEGGGGQRXXXXXXXXXXXXXXXXPRPPTTQHPXXXXXXXXXXXXXXXXXXXXXXXXXXDXXXXXXXXXXXXXXXXH

SEQ ID NO: 33017 - protein, 281 aa, Diabrotica virgifera
  misc_feature: Coding regions on vcDNA: vcDNA=SeqID_12714; Strand=+; Position=1-843
  misc_feature: Homolog annotation: Hit_ID=EAL29153.1; Match level="QueryCoverage =97%, HitCoverage=59%, E-value=2e-42, Identity=30%"; Hit description =GA16141-PA [Drosophila pseudoobscura]
  misc_feature: Gene Ontology Annotation: Cellular component=synaptic vesicle; Biological process=calcium ion homeostasis
IVYGYLVTGFFSVMAAMSTSKGMLMGAKFMSGLILNGPYSATTTHITEFHSSKYRGTVHMIRGIFFSVINLFLPVLAWAILPRKINITIFGFEFHAWNVFMLICASMTIISGILYMFLPESPKYLMSMGRNRAALVVMRKVYSKNTGNPQEDFPVKKLVNEAKQNFTSSRVEMATALKSGWEEMKTILHRPHINNMILASFNAFSVVMSLNTLKFWLPGIFQSISDYQNNHNGTSSSMCVMLGEMSKPKNITSSQECSVDLDNFSVYLRTFIVASARVEVF

SEQ ID NO: 33018 - protein, 163 aa, Diabrotica virgifera
  misc_feature: Coding regions on vcDNA: vcDNA=SeqID_12715; Strand=+; Position=356-847
  misc_feature: Homolog annotation: Hit_ID=EAK81987.1; Match level="QueryCoverage =88%, HitCoverage=41%, E-value=3e-20, Identity=35%"; Hit description =predicted protein [Ustilago maydis 521] ref|XP_398818.1| predicted protein [Ustilago maydis 521]
  misc_feature (77)..(90): Xaa can be any naturally occurring amino acid
SIAAKGAAVQNCWGFIDGTARPICRPTELQEEYYSGHKRVHCLKYQSLICPDGIIVSLLGAYSGRRHDAFIFGQSGXXXXXXXXXXXXXXIYVIYGDQAYGIRELLLCPYPGRGITEQQQNFNLSMSVTRQAVEWGFQKIISQFPFLDFKKNQKLLLQEPRPV

SEQ ID NO: 33019 - protein, 204 aa, Diabrotica virgifera
  misc_feature: Coding regions on vcDNA: vcDNA=SeqID_12716; Strand=+; Position=2-616
  misc_feature: Homolog annotation: Hit_ID=XP_311745.1; Match level="QueryCoverage =99%, HitCoverage=23%, E-value=8e-42, Identity=43%"; Hit description =ENSANGP00000014233 [Anopheles gambiae]
LLKKGLFEEAIDLFDIANNQEEVLKLNCSILSRTVHLENEPNSLRSRITEKATNFANRFLREGYKTSPTIVNSFIKLKDLITFFNQYHDKNYPQASKTLHDLQLVPQRMEEVDDRVKTFKNYHQDLCKVFPDIVLAAMNMIFAQYQKLKSNTEYIPRFRDETMEVQLKTLREQAKCLTNFTGMLPYRMPGDTNSRLMQMEILMH

SEQ ID NO: 33020 - protein, 215 aa, Diabrotica virgifera
  misc_feature: Coding regions on vcDNA: vcDNA=SeqID_12717; Strand=+; Position=1-645
  misc_feature (1)..(212): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLA

SEQ ID NO: 33021 - protein, 66 aa, Diabrotica virgifera
  misc_feature: Coding regions on vcDNA: vcDNA=SeqID_12718; Strand=-; Position=3-200
  misc_feature (7)..(28): Xaa can be any naturally occurring amino acid
  misc_feature (35)..(41): Xaa can be any naturally occurring amino acid
  misc_feature (48)..(49): Xaa can be any naturally occurring amino acid
  misc_feature (51)..(66): Xaa can be any naturally occurring amino acid
KLERGWXXXXXXXXXXXXXXXXXXXXXXPQLNKLXXXXXXXVKERWGXXGXXXXXXXXXXXXXXXX

SEQ ID NO: 33022 - protein, 33 aa, Diabrotica virgifera
  misc_feature: Coding regions on vcDNA: vcDNA=SeqID_12719; Strand=-; Position=2-100
  misc_feature (17)..(23): Xaa can be any naturally occurring amino acid
ILHKLIKASYISSLSFXXXXXXXTNEYATLARS

SEQ ID NO: 33023 - protein, 91 aa, Diabrotica virgifera
  misc_feature: Coding regions on vcDNA: vcDNA=SeqID_12720; Strand=-; Position=208-483
  misc_feature (61)..(72): Xaa can be any naturally occurring amino acid
TEIGISAIFRDNLGEDTNWNSYDTGSDLTSTVTDTIFEESYNLISLSRSYSIKIWFDFVSXXXXXXXXXXXXKYSKSTRNVFKPGTRTEMK

SEQ ID NO: 33024 - protein, 88 aa, Diabrotica virgifera
  misc_feature: Coding regions on vcDNA: vcDNA=SeqID_12721; Strand=-; Position=218-484
IHCFCCAVYEISSPTSGLSCGSLNSKLITQQFFFSLLMRDILSIFSIVDIILLWPENINTNNNLFIEEVPEYLELSLHSVSNKGSSKY

SEQ ID NO: 33025 - protein, 72 aa, Diabrotica virgifera
  misc_feature: Coding regions on vcDNA: vcDNA=SeqID_12722; Strand=+; Position=531-749
IANIPKNFHNVVYCFILKSQYYYFIVLTDTFPKPYVYKDYMKLLYVNNLELLFLICNSDIYGPTITNLPAIL

SEQ ID NO: 33026 - protein, 105 aa, Diabrotica virgifera
  misc_feature: Coding regions on vcDNA: vcDNA=SeqID_12723; Strand=+; Position=13-330
  misc_feature (3)..(17): Xaa can be any naturally occurring amino acid
  misc_feature (21)..(33): Xaa can be any naturally occurring amino acid
  misc_feature (36)..(55): Xaa can be any naturally occurring amino acid
  misc_feature (69)..(78): Xaa can be any naturally occurring amino acid
  misc_feature (81)..(92): Xaa can be any naturally occurring amino acid
YWXXXXXXXXXXXXXXXPGDXXXXXXXXXXXXXQFXXXXXXXXXXXXXXXXXXXXNEMVFRFKYIQIFXXXXXXXXXXKIXXXXXXXXXXXXVLRKKLTISIYYS

SEQ ID NO: 33027 - protein, 39 aa, Diabrotica virgifera
  misc_feature: Coding regions on vcDNA: vcDNA=SeqID_12724; Strand=-; Position=0-116
  misc_feature (4)..(24): Xaa can be any naturally occurring amino acid
  misc_feature (26)..(38): Xaa can be any naturally occurring amino acid
KKFXXXXXXXXXXXXXXXXXXXXXPXXXXXXXXXXXXXG

SEQ ID NO: 33028 - protein, 83 aa, Diabrotica virgifera
  misc_feature: Coding regions on vcDNA: vcDNA=SeqID_12725; Strand=-; Position=0-248
  misc_feature (4)..(33): Xaa can be any naturally occurring amino acid
  misc_feature (37)..(37): Xaa can be any naturally occurring amino acid
  misc_feature (39)..(82): Xaa can be any naturally occurring amino acid
KKLXXXXXXXXXXXXXXXXXXXXXXXXXXXXXXWINXVXXXXXXXXXXXXXXXXXXXXXXXXXXXXXXXXXXXXXXXXXXXXS

SEQ ID NO: 33029 - protein, 86 aa, Diabrotica virgifera
  misc_feature: Coding regions on vcDNA: vcDNA=SeqID_12726; Strand=-; Position=266-526
  misc_feature (69)..(75): Xaa can be any naturally occurring amino acid
SILNHLITMEASVSHGITVNILCEMLASHTVAKVLTYLLTCTYTILVILLVYLSTNMGGLCPAVDLEGXXXXXXXSLYHFSVIPSS

SEQ ID NO: 33030 - protein, 262 aa, Diabrotica virgifera
  misc_feature: Coding regions on vcDNA: vcDNA=SeqID_12727; Strand=+; Position=54-842
  misc_feature: Homolog annotation: Hit_ID=XP_318153.1; Match level="QueryCoverage =92%, HitCoverage=58%, E-value=2e-21, Identity=27%"; Hit description =ENSANGP00000020695 [Anopheles gambiae]
  misc_feature: Pfam annotation: Pfam_ID=zf-CCHC; Match level="Score=19.9, E-value =0.00077, Copies=1"; Pfam description=Zinc knuckle
  misc_feature (232)..(232): Xaa can be any naturally occurring amino acid
MENSSAALKLSGGDNWVAWKFQTRVVLKSRGYYDIVIGKSVRPSTTGDDQKKWDAGDSKAQEFIVTRIEQGPMTHILSCETSKDMWTKLKSVYDKESEVSIHLMQQKFFLLEFSSGKNVASFISQLEEIKNKLKQAGEELSDKMIMTKILMALPEEYKHFRSAWESVPSDKQTLDELTSRLLIEEERSKSTQGSTALAMKSDTSREFKGQKKTRLKCHFCGRGGHIAKNCFXQKKERDNNSQKDIVCSQCKRRGHNLQRVLV

SEQ ID NO: 33031 - protein, 236 aa, Diabrotica virgifera
  misc_feature: Coding regions on vcDNA: vcDNA=SeqID_12728; Strand=+; Position=2-707
  misc_feature: Homolog annotation: Hit_ID=AAN71507.1; Match level="QueryCoverage =100%, HitCoverage=37%, E-value=5e-42, Identity=38%"; Hit description= RH03424p [Drosophila melanogaster]
  misc_feature: Gene Ontology Annotation: Molecular function=protein binding; Cellular component=Z disc
  misc_feature: Pfam annotation: Pfam_ID=LIM; Match level="Score=30.7, E-value=4.5e -06, Copies=1"; Pfam description=LIM domain
  misc_feature (224)..(224): Xaa can be any naturally occurring amino acid
AKSAALKNPINPNLVPITIPPGGRAPAHAISSALSSHSYPTSSPLSPKLNTAGTQYQTNYSGPKPFSSVNAPLSPHNTLPRAAPLSPVAPAPSFNSHSYTPSAYSPSSGRFSSVKPAGGLFKGAGSGKQSTGVRIAPRRGRGILNPAAIGGARIPLCGSCNMQVRGPFITALGKIWCPNHFICSTPSCRRRLLDIGFVEERGELCCEYCFEQYLTRPCSICGGXKMTADCLKGIGK

SEQ ID NO: 33032 - protein, 67 aa, Diabrotica virgifera
  misc_feature: Coding regions on vcDNA: vcDNA=SeqID_12729; Strand=+; Position=420-623
  misc_feature (7)..(48): Xaa can be any naturally occurring amino acid
HMMLFIXXXXXXXXXXXXXXXXXXXXXXXXXXXXXXXXXXXXXXXXXXALNEFSPHFFHLIIIIMTF

SEQ ID NO: 33033 - protein, 229 aa, Diabrotica virgifera
  misc_feature: Coding regions on vcDNA: vcDNA=SeqID_12730; Strand=+; Position=1-690
  misc_feature (1)..(15): Xaa can be any naturally occurring amino acid
  misc_feature (17)..(186): Xaa can be any naturally occurring amino acid
  misc_feature (188)..(201): Xaa can be any naturally occurring amino acid
XXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIKVYNWCNSYIINSVRLLKFYVI

SEQ ID NO: 33034 - protein, 97 aa, Diabrotica virgifera
  misc_feature: Coding regions on vcDNA: vcDNA=SeqID_12731; Strand=-; Position=403-696
  misc_feature (57)..(68): Xaa can be any naturally occurring amino acid
YFSGFLQVTGSIIALIKNTLFVKMIIKNSFISFQPCTYIIQDILLLFIRPWFQLTEXXXXXXXXXXXXIRLLKGYKCKNMHFNFCSVSWITYNQYFT

SEQ ID NO: 33035 - protein, 54 aa, Diabrotica virgifera
  misc_feature: Coding regions on vcDNA: vcDNA=SeqID_12732; Strand=-; Position=390-554
VISCESCPCSMYGKHKSSITIHGISSSLGRTYFKIRKFLIISFTTNHMIIKSAS

SEQ ID NO: 33036 - protein, 276 aa, Diabrotica virgifera
  misc_feature: Coding regions on vcDNA: vcDNA=SeqID_12733; Strand=+; Position=52-879
  misc_feature: Homolog annotation: Hit_ID=EAA01309.3; Match level="QueryCoverage =90%, HitCoverage=38%, E-value=1e-43, Identity=38%"; Hit description =ENSANGP00000011618 [Anopheles gambiae str. PEST] ref|XP_551364.1| ENSANGP00000011618 [Anopheles gambiae st
  misc_feature (202)..(208): Xaa can be any naturally occurring amino acid
MDITTKLSGLQEISKAQLSKILNVVSNPKYLIIEPSLIRPLERVCGVTWLKGNGIEKIFKLEPVNPYAGSNVVFYMIYFDTIVFKQVVDQIRSQIENIEQPVKNKFHIIVVPCYNCAFENELEALGVYGTIRIHHFQWMPLHLDTSLLSLEIPNLYSSLFVYKNLTYLPVLSKCLWQLNFVIGKPRFILCLGEYSKAVLAQXXXXXXXRGETDRLESDFGALIIMDRNIDYTSALLTPGTYAALLAEIYNVSAGICEKKEEKLEKFDTKCNPFTRK

SEQ ID NO: 33037 - protein, 96 aa, Diabrotica virgifera
  misc_feature: Coding regions on vcDNA: vcDNA=SeqID_12734; Strand=-; Position=3-290
CSTANPPRTIYTSDRANSRYLYKRKIYVSHNHVCNFVSPILKQIIYSSYSDIDLPQTSSYSISRMNISYPYAILSHCMYVSATFKIKNDYPPSIYA

SEQ ID NO: 33038 - protein, 108 aa, Diabrotica virgifera; identical to SEQ ID NO: 26958
  misc_feature: Coding regions on vcDNA: vcDNA=SeqID_12735; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33039 - protein, 29 aa, Diabrotica virgifera
  misc_feature: Coding regions on vcDNA: vcDNA=SeqID_12736; Strand=-; Position=1-87
  misc_feature (1)..(26): Xaa can be any naturally occurring amino acid
XXXXXXXXXXXXXXXXXXXXXXXXXXVFL

SEQ ID NO: 33040 - protein, 294 aa, Diabrotica virgifera
  misc_feature: Coding regions on vcDNA: vcDNA=SeqID_12737; Strand=+; Position=2-887
  misc_feature: Homolog annotation: Hit_ID=XP_316107.1; Match level="QueryCoverage =84%, HitCoverage=87%, E-value=1e-25, Identity=29%"; Hit description =ENSANGP00000005874 [Anopheles gambiae]
  misc_feature: Gene Ontology Annotation: Molecular function=sulfotransferase activity; Cellular component=nucleus; Biological process =dorsal/ventral axis specification
  misc_feature: Pfam annotation: Pfam_ID=HS2ST; Match level="Score=-20.0, E-value =9.6e-11, Copies=1"; Pfam description=Heparan sulfate 2-O -sulfotransferase (
  misc_feature (239)..(239): Xaa can be any naturally occurring amino acid
  misc_feature (261)..(261): Xaa can be any naturally occurring amino acid
NFCTPLKKYGIVFSKTSSVALSSSKTPKTTEGALSLANSKHVTKSLTQLGRMDEVNRHLLFLNHVPKCGTEILILLLQKLQGYNNYRHVRLKYGNKRLLSNLQQEHLVYEMYDIMKKEAVPVSLDRHVFFINFTQFGRQFPTYINLIRHPVDKIISRSTDKEVRKDYFYKCLVSKRNGCNFKNGQPYELSIPYFCGHDKLCMILNNDWALQRARQYVAKYYPVAGDLEELTATLEVFDXYIPYFFKGEQKLYRKEFLHLQXIGKKRMSPNGNKQLKNSLINEREFYEWNKKNTV

SEQ ID NO: 33041 - protein, 34 aa, Diabrotica virgifera
  misc_feature: Coding regions on vcDNA: vcDNA=SeqID_12738; Strand=-; Position=3-104
  misc_feature (21)..(34): Xaa can be any naturally occurring amino acid
YYISSPLVNSLRLSFRNIPLXXXXXXXXXXXXXX

SEQ ID NO: 33042 - protein, 31 aa, Diabrotica virgifera
  misc_feature: Coding regions on vcDNA: vcDNA=SeqID_12739; Strand=+; Position=1-93
  misc_feature (5)..(30): Xaa can be any naturally occurring amino acid
KTRNXXXXXXXXXXXXXXXXXXXXXXXXXXG

SEQ ID NO: 33043 - protein, 31 aa, Diabrotica virgifera
  misc_feature: Coding regions on vcDNA: vcDNA=SeqID_12740; Strand=-; Position=2-94
  misc_feature (3)..(3): Xaa can be any naturally occurring amino acid
  misc_feature (10)..(10): Xaa can be any naturally occurring amino acid
  misc_feature (12)..(31): Xaa can be any naturally occurring amino acid
SIXSLVFKKXKXXXXXXXXXXXXXXXXXXXX

SEQ ID NO: 33044 - protein, 39 aa, Diabrotica virgifera
  misc_feature: Coding regions on vcDNA: vcDNA=SeqID_12741; Strand=-; Position=1-117
  misc_feature (1)..(11): Xaa can be any naturally occurring amino acid
  misc_feature (15)..(29): Xaa can be any naturally occurring amino acid
  misc_feature (33)..(39): Xaa can be any naturally occurring amino acid
XXXXXXXXXXXPQYXXXXXXXXXXXXXXXLLLXXXXXXX

SEQ ID NO: 33045 - protein, 103 aa, Diabrotica virgifera
  misc_feature: Coding regions on vcDNA: vcDNA=SeqID_12742; Strand=-; Position=2-310
  misc_feature (40)..(49): Xaa can be any naturally occurring amino acid
  misc_feature (60)..(67): Xaa can be any naturally occurring amino acid
  misc_feature (89)..(102): Xaa can be any naturally occurring amino acid
IFTVVRSLGGYWNSVLGFSQAGANIYLNMKIIVYIWSFRXXXXXXXXXXEHNLAHTGLNXXXXXXXXSNRLNNITATPIINFNPTSRSXXXXXXXXXXXXXXV

SEQ ID NO: 33046 - protein, 58 aa, Diabrotica virgifera
  misc_feature: Coding regions on vcDNA: vcDNA=SeqID_12743; Strand=-; Position=0-173
  misc_feature (3)..(54): Xaa can be any naturally occurring amino acid
PPXXXXXXXXXXXXXXXXXXXXXXXXXXXXXXXXXXXXXXXXXXXXXXXXXXXXHPTL

SEQ ID NO: 33047 - protein, 83 aa, Diabrotica virgifera
  misc_feature: Coding regions on vcDNA: vcDNA=SeqID_12744; Strand=+; Position=32-283
  misc_feature: Homolog annotation: Hit_ID=BAA75470.1; Match level="QueryCoverage =100%, HitCoverage=11%, E-value=2e-15, Identity=50%"; Hit description= prophenoloxidase [Tenebrio molitor]
MATTKNLVKLFDRPKELCIMPKGDDKTIFDVPAEYLPDQYKTVGVQLVSKFGEEAVGGKIQVKPISIPYLGDGLDLIKNSNFS

SEQ ID NO: 33048 - protein, 80 aa, Diabrotica virgifera
  misc_feature: Coding regions on vcDNA: vcDNA=SeqID_12745; Strand=-; Position=0-239
  misc_feature (3)..(79): Xaa can be any naturally occurring amino acid
KLXXXXXXXXXXXXXXXXXXXXXXXXXXXXXXXXXXXXXXXXXXXXXXXXXXXXXXXXXXXXXXXXXXXXXXXXXXXXXT

SEQ ID NO: 33049 - protein, 23 aa, Diabrotica virgifera
  misc_feature: Coding regions on vcDNA: vcDNA=SeqID_12746; Strand=-; Position=0-68
  misc_feature (1)..(21): Xaa can be any naturally occurring amino acid
XXXXXXXXXXXXXXXXXXXXXLS

SEQ ID NO: 33050 - protein, 34 aa, Diabrotica virgifera
  misc_feature: Coding regions on vcDNA: vcDNA=SeqID_12747; Strand=-; Position=1-102
  misc_feature (2)..(24): Xaa can be any naturally occurring amino acid
  misc_feature (27)..(34): Xaa can be any naturally occurring amino acid
PXXXXXXXXXXXXXXXXXXXXXXXGVXXXXXXXX

SEQ ID NO: 33051 - protein, 297 aa, Diabrotica virgifera
  misc_feature: Coding regions on vcDNA: vcDNA=SeqID_12748; Strand=+; Position=33-923
  misc_feature: Homolog annotation: Hit_ID=EAL25411.1; Match level="QueryCoverage =95%, HitCoverage=61%, E-value=4e-74, Identity=47%"; Hit description =GA19868-PA [Drosophila pseudoobscura]
  misc_feature: Gene Ontology Annotation: Molecular function=asparagine-tRNA ligase activity; Cellular component=mitochondrion; Biological process=tRNA modification
  misc_feature: Pfam annotation: Pfam_ID=tRNA_anti; Match level="Score=42.8, E-value =9.8e-10, Copies=1"; Pfam description=OB-fold nucleic acid binding domain
  misc_feature (281)..(282): Xaa can be any naturally occurring amino acid
KLKLCRIKNNHYNIRKRFNSSNTINSLLKNVIVGEVMNIKGWIKSLRKQKENYFLDISDGSTSERFQVVVPLSLVSKNITVGSSISTNGVVQTSPNGQTELLANEINIYGDCIVTNGYPFAPRKKYSSEYVRQYLHFRPRTNKFASLLRTRSAAQLYFHTFLTSRGYINVQTPILTSNDCEGAGEIFRVMPESEQLIKSMLKEGGYQEEAFFNTKAFLTVSGQLHLEAAAHGLTKVYNLGPTFRAENSKSRLHLAEFYMLEAEIAFLEELETLLSIIEELXXEVTNLVLDNCEADVH

SEQ ID NO: 33052 - protein, 253 aa, Diabrotica virgifera
  misc_feature: Coding regions on vcDNA: vcDNA=SeqID_12749; Strand=+; Position=22-783
  misc_feature: Homolog annotation: Hit_ID=AAN05630.1; Match level="QueryCoverage =72%, HitCoverage=77%, E-value=2e-27, Identity=34%"; Hit description =diapause-associated transcript-2 [Leptinotarsa decemlineata]
  misc_feature (127)..(133): Xaa can be any naturally occurring amino acid
MNKFLVNFGLFVLAASCVVCAPRGVVEEADLQIAELVKPYIGERRVVSKALQKYLKDSDYQVIKDLTREFDKHKDKCADIEKKMNDTIDDLANCIEDITIGDSTVCATAQRAIEKCAKPVIELVSGXXXXXXXELPALAEGVVLAIWKQACASTVEQVLELFNPCQWKSFSSLEKIESCKAVPTEVESWDHSKQLPTTENICTLLPKIKKCSSDFHGQYCKNPVTLSSFAKFHKAIETETEKICHDPVKNEVA

SEQ ID NO: 33053 - protein, 58 aa, Diabrotica virgifera
  misc_feature: Coding regions on vcDNA: vcDNA=SeqID_12750; Strand=-; Position=218-394
ILINIVFQRSSHIYHRSSSKQIFIIGLLRIIIRQAFSREDLDIFISEYPFFGIEPMRQ

SEQ ID NO: 33054 - protein, 244 aa, Diabrotica virgifera
  misc_feature: Coding regions on vcDNA: vcDNA=SeqID_12751; Strand=+; Position=5-739
  misc_feature: Homolog annotation: Hit_ID=XP_309657.1; Match level="QueryCoverage =77%, HitCoverage=75%, E-value=4e-55, Identity=54%"; Hit description =ENSANGP00000003881 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=98.1, E -value=2.2e-26, Copies=1"; Pfam description=ab-hydrolase associated lipase region
MKTSVFYFIALFCCCSAEFNIFQLAKHAIDVGSSITKDVLDNVLTVNDLPDRITVPEIIKREGYEVESHFVTTPDGYILNLHRIPHGKHSEGKRKSTPVYLQHGPLCSSADWVIFGPKRALAFILADAGYDVWMGNVRGNTYSRNHTYLFPEEAQFWKFSWNEMGMYDIPTMVDYILKATGKPQLYHIGHSQGTTSFYVMTSERPEYNQKIKAHISLAPVAYMHNLGRPLVRALTFDRLAFVNK

SEQ ID NO: 33055 - protein, 222 aa, Diabrotica virgifera
  misc_feature: Coding regions on vcDNA: vcDNA=SeqID_12752; Strand=+; Position=198-863
  misc_feature: Homolog annotation: Hit_ID=NP_861421.1; Match level="QueryCoverage =58%, HitCoverage=44%, E-value=2e-29, Identity=47%"; Hit description =zinc finger protein 233 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=90.9, E-value =3.4e-24, Copies=3"; Pfam description=Zinc finger, C2H2 type
  misc_feature (201)..(208): Xaa can be any naturally occurring amino acid
MEINDDDSYKNELSNIKCKIEIKTDDENYEDTPVWIKNEFKQEVLSEIVDSKIWFDQISTTALVADVKTEEIQEPKVICNELDLNEEHQTSQHGFLQSVVKTESEKSLTTYIRENSYKCETCLKEFSQEGNLKNHLRIHTGEKPFKCDICFKQFSQEGNLKNHLRIHTGKKPFKCDICCKQFSQNGHLKTHLRIHTGEEPXXXXXXXXQFSQNGHLKTAFKD

SEQ ID NO: 33056 - protein, 45 aa, Diabrotica virgifera
  misc_feature: Coding regions on vcDNA: vcDNA=SeqID_12753; Strand=+; Position=378-515
HEPYENILNFVFCAYTGEPRKSSTNYGGQPVRILKSSDYPKDSPN

SEQ ID NO: 33057 - protein, 214 aa, Diabrotica virgifera
  misc_feature: Coding regions on vcDNA: vcDNA=SeqID_12754; Strand=-; Position=1-642
  misc_feature (1)..(23): Xaa can be any naturally occurring amino acid
  misc_feature (26)..(152): Xaa can be any naturally occurring amino acid
  misc_feature (156)..(175): Xaa can be any naturally occurring amino acid
  misc_feature (178)..(191): Xaa can be any naturally occurring amino acid
  misc_feature (194)..(214): Xaa can be any naturally occurring amino acid
XXXXXXXXXXXXXXXXXXXXXXXQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHSIXXXXXXXXXXXXXXXXXXXXKLXXXXXXXXXXXXXXPKXXXXXXXXXXXXXXXXXXXXX

SEQ ID NO: 33058 - protein, 24 aa, Diabrotica virgifera
  misc_feature: Coding regions on vcDNA: vcDNA=SeqID_12755; Strand=-; Position=0-71
  misc_feature (4)..(23): Xaa can be any naturally occurring amino acid
KNWXXXXXXXXXXXXXXXXXXXXP

SEQ ID NO: 33059 - protein, 171 aa, Diabrotica virgifera; identical to SEQ ID NO: 27583
  misc_feature: Coding regions on vcDNA: vcDNA=SeqID_12756; Strand=-; Position=3-518
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 33060 - protein, 24 aa, Diabrotica virgifera
  misc_feature: Coding regions on vcDNA: vcDNA=SeqID_12757; Strand=-; Position=1-72
  misc_feature (1)..(1): Xaa can be any naturally occurring amino acid
  misc_feature (3)..(13): Xaa can be any naturally occurring amino acid
  misc_feature (15)..(16): Xaa can be any naturally occurring amino acid
  misc_feature (21)..(21): Xaa can be any naturally occurring amino acid
XYXXXXXXXXXXXFXXLNFNXILF

SEQ ID NO: 33061 - protein, 31 aa, Diabrotica virgifera
  misc_feature: Coding regions on vcDNA: vcDNA=SeqID_12758; Strand=-; Position=1-93
  misc_feature (2)..(30): Xaa can be any naturally occurring amino acid
IXXXXXXXXXXXXXXXXXXXXXXXXXXXXXN

SEQ ID NO: 33062 - protein, 35 aa, Diabrotica virgifera
  misc_feature: Coding regions on vcDNA: vcDNA=SeqID_12759; Strand=+; Position=2-106
FNGLEDTIIQTNKLLTTNYLTAFQPGTIEKSNLRS

SEQ ID NO: 33063 - protein, 27 aa, Diabrotica virgifera
  misc_feature: Coding regions on vcDNA: vcDNA=SeqID_12760; Strand=-; Position=0-80
  misc_feature (4)..(24): Xaa can be any naturally occurring amino acid
  misc_feature (26)..(26): Xaa can be any naturally occurring amino acid
QKNXXXXXXXXXXXXXXXXXXXXXSXP

SEQ ID NO: 33064 - protein, 77 aa, Diabrotica virgifera
  misc_feature: Coding regions on vcDNA: vcDNA=SeqID_12761; Strand=+; Position=420-653
FGRTKCRAINKPLSNIYWGCVNVITTPTIPCNLPRVNILSDASMRNVGEWKFMCEASRSLGLFYTECFIYFTILIGK

SEQ ID NO: 33065 - protein, 86 aa, Diabrotica virgifera
  misc_feature: Coding regions on vcDNA: vcDNA=SeqID_12762; Strand=-; Position=2-259
  misc_feature (7)..(20): Xaa can be any naturally occurring amino acid
  misc_feature (22)..(33): Xaa can be any naturally occurring amino acid
  misc_feature (43)..(50): Xaa can be any naturally occurring amino acid
  misc_feature (53)..(66): Xaa can be any naturally occurring amino acid
  misc_feature (72)..(85): Xaa can be any naturally occurring amino acid
PLIFLCXXXXXXXXXXXXXXLXXXXXXXXXXXXPTLAHTGLNXXXXXXXXSNXXXXXXXXXXXXXXPTSRSXXXXXXXXXXXXXXV

SEQ ID NO: 33066 - protein, 93 aa, Diabrotica virgifera
  misc_feature: Coding regions on vcDNA: vcDNA=SeqID_12763; Strand=+; Position=47-328
  misc_feature: Homolog annotation: Hit_ID=AAL73401.1; Match level="QueryCoverage =88%, HitCoverage=61%, E-value=7e-41, Identity=95%"; Hit description =ribosomal protein 49 [Apis mellifera] sp|Q8WRF3|RL32_APIME 60S ribosomal protein L32 (Ribosomal protein
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L32e; Match level="Score=99.2, E -value=1.1e-26, Copies=1"; Pfam description=Ribosomal protein L32
MAIRPVYRPQIIKKRTKKFIRHQSDRYGKLKRNWRKPKGIDNRVRRRFKGQYLMPNIGYGSNSKTRHMLPTGFRKVLVHNVKVSILFSLLIIT

SEQ ID NO: 33067 - protein, 79 aa, Diabrotica virgifera
  misc_feature: Coding regions on vcDNA: vcDNA=SeqID_12764; Strand=-; Position=1-237
  misc_feature (13)..(25): Xaa can be any naturally occurring amino acid
  misc_feature (34)..(79): Xaa can be any naturally occurring amino acid
GNFVVSRQKKVGXXXXXXXXXXXXXVKSLFLSPXXXXXXXXXXXXXXXXXXXXXXXXXXXXXXXXXXXXXXXXXXXXXX

SEQ ID NO: 33068 - protein, 177 aa, Diabrotica virgifera
  misc_feature: Coding regions on vcDNA: vcDNA=SeqID_12765; Strand=+; Position=295-823
  misc_feature: Homolog annotation: Hit_ID=AAL16062.1; Match level="QueryCoverage =99%, HitCoverage=63%, E-value=2e-36, Identity=45%"; Hit description =carbonyl reductase [Anguilla japonica]
  misc_feature: Gene Ontology Annotation: Molecular function=carbonyl reductase (NADPH) activity; Cellular component=cytosol; Biological process =biological_process unknown
  misc_feature: Pfam annotation: Pfam_ID=adh_short; Match level="Score=-16.9, E-value= 2.5e-05, Copies=1"; Pfam description=short chain dehydrogenase
  misc_feature (49)..(55): Xaa can be any naturally occurring amino acid
  misc_feature (153)..(153): Xaa can be any naturally occurring amino acid
MSLQKVAVVTGGNKGIGYAIVKGLCERFDGLVYLTARDVERGQAAVAQXXXXXXXAVFHQLDINNQASVDELRDFIKKEHGGLDLLINNAAIGFGRAATESPFVQASKTIEANYFGTLRVCEALFSLLRNNAKVVNLSSALGHLSKIPTENLXQMNFREKDLTISELSKLLEKFVKA

SEQ ID NO: 33069 - protein, 50 aa, Diabrotica virgifera
  misc_feature: Coding regions on vcDNA: vcDNA=SeqID_12766; Strand=+; Position=559-711
LDYLWLLRFKICVKRNNKQKLVNSYTAFLNSFHIPIFLDYFGQGKLILIW

SEQ ID NO: 33070 - protein, 38 aa, Diabrotica virgifera
  misc_feature: Coding regions on vcDNA: vcDNA=SeqID_12767; Strand=+; Position=1-114
  misc_feature (1)..(9): Xaa can be any naturally occurring amino acid
  misc_feature (12)..(25): Xaa can be any naturally occurring amino acid
XXXXXXXXXIYXXXXXXXXXXXXXXKTTTPLYSFLKLL

SEQ ID NO: 33071 - protein, 88 aa, Diabrotica virgifera
  misc_feature: Coding regions on vcDNA: vcDNA=SeqID_12768; Strand=+; Position=310-576
LLYQCVFNKKYLRFFKYILAFVSINSQLLKSIFYFHMERALLAAFCRSFFLNIWIYFCVTPLIRCICTLASVLLDITVISKPSQDENL

SEQ ID NO: 33072 - protein, 253 aa, Diabrotica virgifera
  misc_feature: Coding regions on vcDNA: vcDNA=SeqID_12769; Strand=-; Position=1-759
  misc_feature (3)..(253): Xaa can be any naturally occurring amino acid
FLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33073 - protein, 255 aa, Diabrotica virgifera
  misc_feature: Coding regions on vcDNA: vcDNA=SeqID_12770; Strand=+; Position=16-783
  misc_feature: Homolog annotation: Hit_ID=XP_397168.1; Match level="QueryCoverage =93%, HitCoverage=46%, E-value=3e-74, Identity=57%"; Hit description =similar to ENSANGP00000009873 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=SIR2; Match level="Score=-10.9, E-value=3.3e- 09, Copies=1"; Pfam description=Sir2 family
MDEDISENMSEPEIEEDESRSKRFRLPRKATIEYTKKLCAKEERIATVKKITFILQKIDSDRSITDKKLLNQYKDIVEEIRERWRKREEAKKRLEELEDPEDVIDNKCHILAQAIAQSQYLVAYTGAGISTAAEIPDYRGTNGIWTRLQQGKDIGNYDLSLAEPTYTHMALAELYRKNILKHVVSQNCDGLHLRSGLPRTALSELHGNMSVEVCKQCKPPREYWRYFDVTENTARFSHKTFRRHDTIVHIGEWGT

SEQ ID NO: 33074 - protein, 66 aa, Diabrotica virgifera
  misc_feature: Coding regions on vcDNA: vcDNA=SeqID_12771; Strand=-; Position=448-648
  misc_feature (56)..(66): Xaa can be any naturally occurring amino acid
LFQCWRVSVLHQQSIFFIFHAKQISEFHYLCPYIHIKYTNLLILILIIISKIKSPXXXXXXXXXXX

SEQ ID NO: 33075 - protein, 198 aa, Diabrotica virgifera
  misc_feature: Coding regions on vcDNA: vcDNA=SeqID_12772; Strand=+; Position=102-698
SASEPVSVVCRKMTSVTVVLDKEKKHQYKDYVNFLGNYKNGKKSESDTNSSLNSSVSDLNELNEMPTKSFNEYLKDYNTKKFQPVQPAFIKKEEAPKNVKTEVFIQINNTKNTNNSQIQVTLPKPKLDETDGEQIKISVGELSQKFCNTSVHNNKTQTHILKRSSSITEKTKIFEENHDENKKVITKINKVNHIRKVS

SEQ ID NO: 33076 - protein, 167 aa, Diabrotica virgifera
  misc_feature: Coding regions on vcDNA: vcDNA=SeqID_12773; Strand=-; Position=303-806
  misc_feature (4)..(27): Xaa can be any naturally occurring amino acid
  misc_feature (37)..(63): Xaa can be any naturally occurring amino acid
  misc_feature (77)..(84): Xaa can be any naturally occurring amino acid
  misc_feature (93)..(106): Xaa can be any naturally occurring amino acid
  misc_feature (112)..(136): Xaa can be any naturally occurring amino acid
  misc_feature (144)..(160): Xaa can be any naturally occurring amino acid
GSAXXXXXXXXXXXXXXXXXXXXXXXXLSSGPSIAAXXXXXXXXXXXXXXXXXXXXXXXXXXXGFIFNTNRHVRHNXXXXXXXXSVIKPIYYXXXXXXXXXXXXXXTQFKLXXXXXXXXXXXXXXXXXXXXXXXXXQNVKIVNXXXXXXXXXXXXXXXXXMPRHIYD

SEQ ID NO: 33077 - protein, 28 aa, Diabrotica virgifera
  misc_feature: Coding regions on vcDNA: vcDNA=SeqID_12774; Strand=-; Position=2-85
  misc_feature (1)..(6): Xaa can be any naturally occurring amino acid
  misc_feature (10)..(16): Xaa can be any naturally occurring amino acid
  misc_feature (19)..(28): Xaa can be any naturally occurring amino acid
XXXXXXPTLXXXXXXXKLXXXXXXXXXX

SEQ ID NO: 33078 - protein, 66 aa, Diabrotica virgifera
  misc_feature: Coding regions on vcDNA: vcDNA=SeqID_12775; Strand=-; Position=308-508
FNIRIVLVLHSCTVTLSLTVNFNLYAKLLMSYLDFLLSNHPIHAIELANVKIVIRYKSTPLKSFHK

SEQ ID NO: 33079 - protein, 25 aa, Diabrotica virgifera
  misc_feature: Coding regions on vcDNA: vcDNA=SeqID_12776; Strand=-; Position=1-75
  misc_feature (5)..(25): Xaa can be any naturally occurring amino acid
KKNGXXXXXXXXXXXXXXXXXXXXX

SEQ ID NO: 33080 - protein, 107 aa, Diabrotica virgifera
  misc_feature: Coding regions on vcDNA: vcDNA=SeqID_12777; Strand=+; Position=491-814
ILKIGGPNITKNVPFCRNFRYMYSTFTRGVIRRFQLYGVPLQSQYKKGLVEALKFIDGALTSSFVLKSHNNQNVQLPKERAYPMEKIPINIKIIDIQKITRCLPEYY

SEQ ID NO: 33081 - protein, 84 aa, Diabrotica virgifera
  misc_feature: Coding regions on vcDNA: vcDNA=SeqID_12778; Strand=+; Position=45-299
IMGIEDSEVNKLYIRLPVKRRELDEFVIRDLHPNIIKVFLPRQKSANWCIVHFENSEKLKEALPILKEKKIQEQTHQNQKLQAE

SEQ ID NO: 33082 - protein, 34 aa, Diabrotica virgifera; identical to SEQ ID NO: 27603
  misc_feature: Coding regions on vcDNA: vcDNA=SeqID_12779; Strand=-; Position=80-184

SEQ ID NO: 33083 - protein, 42 aa, Diabrotica virgifera
  misc_feature: Coding regions on vcDNA: vcDNA=SeqID_12780; Strand=-; Position=1-126
  misc_feature (3)..(42): Xaa can be any naturally occurring amino acid
KMXXXXXXXXXXXXXXXXXXXXXXXXXXXXXXXXXXXXXXXX

SEQ ID NO: 33084 - protein, 16 aa, Diabrotica virgifera
  misc_feature: Coding regions on vcDNA: vcDNA=SeqID_12781; Strand=-; Position=14-64
SFFYQDHFKYIYLKWS

SEQ ID NO: 33085 - protein, 47 aa, Diabrotica virgifera; identical to SEQ ID NO: 26759
  misc_feature: Coding regions on vcDNA: vcDNA=SeqID_12782; Strand=+; Position=3-146
  misc_feature (1)..(15): Xaa can be any naturally occurring amino acid
  misc_feature (17)..(24): Xaa can be any naturally occurring amino acid

SEQ ID NO: 33086 - protein, 80 aa, Diabrotica virgifera
  misc_feature: Coding regions on vcDNA: vcDNA=SeqID_12783; Strand=+; Position=69-311
  misc_feature (49)..(58): Xaa can be any naturally occurring amino acid
  misc_feature (62)..(69): Xaa can be any naturally occurring amino acid
KMDRPRNGVYGTRQTRIKVYETSDTPRRNDMQGSMYIYKNIRTNYKTFXXXXXXXXXXIFCXXXXXXXXPNCVLLVKGLH

SEQ ID NO: 33087 - protein, 290 aa, Diabrotica virgifera
  misc_feature: Coding regions on vcDNA: vcDNA=SeqID_12784; Strand=+; Position=52-920
  misc_feature: Homolog annotation: Hit_ID=XP_394265.1; Match level="QueryCoverage =72%, HitCoverage=22%, E-value=8e-27, Identity=32%"; Hit description =similar to ENSANGP00000001667 [Apis mellifera]
  misc_feature: Gene Ontology Annotation: Molecular function=kainate selective glutamate receptor activity; Cellular component=integral to plasma membrane; Biological process=synaptic transmission
  misc_feature: Pfam annotation: Pfam_ID=ANF_receptor; Match level="Score=-26.1, E -value=0.023, Copies=1"; Pfam description=Receptor family ligand binding region
  misc_feature (234)..(234): Xaa can be any naturally occurring amino acid
  misc_feature (241)..(241): Xaa can be any naturally occurring amino acid
MVFVTANFKKWSVVCALLCILNFADGLTVGVLLGDYPSQEQRLLNSTISRKFNKGEISFSANVQHVSEIDSFGASETLCNVLKADLGVAAIFGPRYTPATAILESICLEFEIPYISTSWRPTSIKNSGFFLNFFPETDYYSKALAEIIQSFGWKIFVVVYENDDTLLKFKDVLKFQKYNENDKRNRIYFEKLGTGPIFTNVFEKIQKTASTNIILDCKTELIIPVLNQAQEANXMLMCITXYFLTNLDADTLDYSDLNTTANITTIRLFNDNDEFLKDSARKKGLAELFT

SEQ ID NO: 33088 - protein, 237 aa, Diabrotica virgifera
  misc_feature: Coding regions on vcDNA: vcDNA=SeqID_12785; Strand=-; Position=1-711
  misc_feature (1)..(197): Xaa can be any naturally occurring amino acid
  misc_feature (201)..(237): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFHXXXXXXXXXXXXXXXXXXXXXXXXXXXXXXXXXXXXX

SEQ ID NO: 33089 - protein, 100 aa, Diabrotica virgifera
  misc_feature: Coding regions on vcDNA: vcDNA=SeqID_12786; Strand=-; Position=56-358
ILTFIILTLIIQSNSHHLNHFIIHNHIPISYIHLLLILQPYILIHLSHLLPSISFFIIFISYNSTLFLIFFTQLTTYLFHFPFFLPIFFYHFYSFILLLI

SEQ ID NO: 33090 - protein, 123 aa, Diabrotica virgifera
  misc_feature: Coding regions on vcDNA: vcDNA=SeqID_12787; Strand=-; Position=235-606
IFYIDNISTIVKFNDIITFCQWISDPLFPLNLMTDISIQSSNIKVDYCNLYHTCIKLTLNGKITYYFMLTLHNHVKSYTLVSSRSEDGYILISMQLILTGRKREFVLLCIPGSYTHFGISRRI

SEQ ID NO: 33091 - protein, 165 aa, Diabrotica virgifera
  misc_feature: Coding regions on vcDNA: vcDNA=SeqID_12788; Strand=+; Position=50-547
  misc_feature: Homolog annotation: Hit_ID=XP_312872.1; Match level="QueryCoverage =47%, HitCoverage=35%, E-value=6e-26, Identity=75%"; Hit description =ENSANGP00000014750 [Anopheles gambiae]
  misc_feature: Gene Ontology Annotation: Molecular function=protein binding
  misc_feature: Pfam annotation: Pfam_ID=HLH; Match level="Score=22.0, E-value =0.00082, Copies=1"; Pfam description=Helix-loop-helix DNA-binding domain
  misc_feature (17)..(51): Xaa can be any naturally occurring amino acid
VILPNNNISWINTEGDXXXXXXXXXXXXXXXXXXXXXXXXXXXXXXXXXXXDHIKDSFSSLRDSVPALNGEKVASRAQILKKAAEYILFMRKKNSSHQQDIEDLKRQNNLLEAQIRTLEKAKTTGDIKDDVFIETESDTSDFEGSIQQRRPKKMKVVSYHSINKE

SEQ ID NO: 33092 - protein, 61 aa, Diabrotica virgifera
  misc_feature: Coding regions on vcDNA: vcDNA=SeqID_12789; Strand=-; Position=183-368
YSVSSSMNSLDRTILVKIKTWLYHEYHASPARVLRAIHWPILSFSLLAILHSQVNQFIMTN

SEQ ID NO: 33093 - protein, 56 aa, Diabrotica virgifera
  misc_feature: Coding regions on vcDNA: vcDNA=SeqID_12790; Strand=+; Position=3-173
  misc_feature: Homolog annotation: Hit_ID=XP_309489.1; Match level="QueryCoverage =100%, HitCoverage=15%, E-value=2e-20, Identity=80%"; Hit description= ENSANGP00000021982 [Anopheles gambiae]
DIERIATTVVGSTENMKDANEQIRQAIQRNAGLRVYILFFLLVMSFSLLFLDWYND

SEQ ID NO: 33094 - protein, 45 aa, Diabrotica virgifera; identical to SEQ ID NO: 28932
  misc_feature: Coding regions on vcDNA: vcDNA=SeqID_12791; Strand=-; Position=1-135
  misc_feature (1)..(45): Xaa can be any naturally occurring amino acid

SEQ ID NO: 33095 - protein, 245 aa, Diabrotica virgifera
  misc_feature: Coding regions on vcDNA: vcDNA=SeqID_12792; Strand=+; Position=85-822
  misc_feature: Homolog annotation: Hit_ID=AAH54900.1; Match level="QueryCoverage =69%, HitCoverage=22%, E-value=1e-11, Identity=29%"; Hit description =LOC402835 protein [Danio rerio]
  misc_feature: Pfam annotation: Pfam_ID=THAP; Match level="Score=65.0, E-value=2e -16, Copies=1"; Pfam description=THAP domain
MAARKGGISCVVRGCQTRSGEQISLFSIPRDRSRAELWLKAAIREDLLSKDVNELHKNYRMCEKHFQPHFISKGGNVRKNLFIQAHPTIFPYNQDVQSADEPLRKIIRLETQIEDKTEIDIMQPVANKTDASHSMHSIPDTLMEESVETDVDVNTEVSTRPHTPAHTVSTQTPPKLSSSSPRKVKLKCKSDNQMCDKLLNKPLAQIVKAQALLKSKPPKSRRYSDEYKQFCINTNIFWVLEHMLL

SEQ ID NO: 33096 - protein, 124 aa, Diabrotica virgifera
  misc_feature: Coding regions on vcDNA: vcDNA=SeqID_12793; Strand=-; Position=382-756
  misc_feature (8)..(27): Xaa can be any naturally occurring amino acid
  misc_feature (42)..(56): Xaa can be any naturally occurring amino acid
  misc_feature (61)..(69): Xaa can be any naturally occurring amino acid
  misc_feature (82)..(112): Xaa can be any naturally occurring amino acid
WIIQAFTXXXXXXXXXXXXXXXXXXXXHSNYSVGREIYIFNXXXXXXXXXXXXXXXNSCNXXXXXXXXXKFFMLIVSSLLIXXXXXXXXXXXXXXXXXXXXXXXXXXXXXXXKTCNPNIYLQIR

SEQ ID NO: 33097 - protein, 51 aa, Diabrotica virgifera
  misc_feature: Coding regions on vcDNA: vcDNA=SeqID_12794; Strand=-; Position=424-579
NIYCKDFYVFFIVNICISNLIATFNTFSSGPISDICLNVLKLKIRKGRFCF

SEQ ID NO: 33098 - protein, 219 aa, Diabrotica virgifera
  misc_feature: Coding regions on vcDNA: vcDNA=SeqID_12795; Strand=-; Position=139-798
  misc_feature: Homolog annotation: Hit_ID=XP_392951.1; Match level="QueryCoverage =99%, HitCoverage=30%, E-value=3e-69, Identity=58%"; Hit description =similar to CG9712-PA [Apis mellifera]
  misc_feature: Gene Ontology Annotation: Molecular function=transcription co -repressor activity; Biological process=ubiquitin cycle
  misc_feature: Pfam annotation: Pfam_ID=Tsg101; Match level="Score=58.6, E-value =1.4e-16, Copies=1"; Pfam description=Tumour susceptibility gene 101 protei
YPLRHQPSGGFGGYPPYPPTSNNSFQGYPPYPSSQPQYPFNFPPGPQAGTGTIKEEHIRESLMTALEEKLLRRMKEQFQQNQAELETLKRTQEELKQGKLKLDGILSRLEKEKNDLDKNITMLQDKEQELTKAIERISNQESIDVDDAVTTTAPLYKQLLNAFAEEAALEDTIYYMGEALRCGVIDLEVFLRQVRTLSRKQFMLRALMQRCRQKAGLSV

SEQ ID NO: 33099 - protein, 73 aa, Diabrotica virgifera
  misc_feature: Coding regions on vcDNA: vcDNA=SeqID_12796; Strand=+; Position=26-247
KANGEPPYVRRKNQIVSRIQLVTCKKSVNIAMTYITAVDSERRIITPQSYRTLIFDFKLSISRICVLKNKYDN

SEQ ID NO: 33100 - protein, 258 aa, Diabrotica virgifera
  misc_feature: Coding regions on vcDNA: vcDNA=SeqID_12797; Strand=+; Position=3-779
  misc_feature (70)..(76): Xaa can be any naturally occurring amino acid
  misc_feature (85)..(92): Xaa can be any naturally occurring amino acid
  misc_feature (227)..(233): Xaa can be any naturally occurring amino acid
SIGRSLGTNGSPRLPKLRLRLVFSDLCTVIVIPEMDKLDKHKLISCVFMREPIWNKENKFHTHSLVLSKXXXXXXXECGTTVIIXXXXXXXXREQFLRKIEDTPINHFGDRFEEEHLSWQYFESLLFLKDQRIVRRGKRNFPTEDEAEVENSTWLLEGRDDEGDQRIVKRSKEDFSTQGDETSTLLSEGRDDEGEAPNPDEFFFAETTSDVLREVSPAHTSSFASFXXXXXXXTEIDEDEAFFNSTLPHLKTLTPKQS

SEQ ID NO: 33101 - protein, 127 aa, Diabrotica virgifera
  misc_feature: Coding regions on vcDNA: vcDNA=SeqID_12798; Strand=+; Position=221-703
  misc_feature: Homolog annotation: Hit_ID=XP_525925.1; Match level="QueryCoverage =90%, HitCoverage=91%, E-value=9e-39, Identity=72%"; Hit description =PREDICTED: similar to rRNA intron-encoded homing endonuclease [Pan troglodytes]
  misc_feature (18)..(18): Xaa can be any naturally occurring amino acid
  misc_feature (36)..(36): Xaa can be any naturally occurring amino acid
  misc_feature (41)..(41): Xaa can be any naturally occurring amino acid
  misc_feature (90)..(90): Xaa can be any naturally occurring amino acid
LARAVQLNPAAVLLTECXVGRYVYFEQIRVLKAGQXRLNTXAWNNGIGPRFYFVEAKAFAKNAFIDQERKLEVRRRSDTALVLTINDASXRFADVPPMTRRAASGKPKLLGSGGSMVAKLKLKGIDG

SEQ ID NO: 33102 - protein, 125 aa, Diabrotica virgifera
  misc_feature: Coding regions on vcDNA: vcDNA=SeqID_12799; Strand=+; Position=333-710
  misc_feature (10)..(16): Xaa can be any naturally occurring amino acid
EASSKSEAHXXXXXXXCTSSRHVEATTNYRSLYKREGSKYSILRSPMPCAIEFTSTKCPPSRRPVTKNLPRRAVHHSGRRNRFNAKLKKPRTSSTGISRTTSYNLLQQEEDLVGRSFISFLFYSP

SEQ ID NO: 33103 - protein, 348 aa, Diabrotica virgifera
  misc_feature: Coding regions on vcDNA: vcDNA=SeqID_12800; Strand=+; Position=1-1044
  misc_feature (1)..(305): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRIKLPLGIKGGIFFGEVQDRKKKDGGPPTGWVFKGFFNMGGG

SEQ ID NO: 33104 - protein, 227 aa, Diabrotica virgifera
  misc_feature: Coding regions on vcDNA: vcDNA=SeqID_12801; Strand=+; Position=156-957
  misc_feature: Homolog annotation: Hit_ID=XP_393194.1; Match level="QueryCoverage =83%, HitCoverage=48%, E-value=2e-31, Identity=42%"; Hit description =similar to ENSANGP00000010643 [Apis mellifera]
  misc_feature (115)..(115): Xaa can be any naturally occurring amino acid
  misc_feature (154)..(154): Xaa can be any naturally occurring amino acid
  misc_feature (205)..(205): Xaa can be any naturally occurring amino acid
MSLYDDYDVKTTATEKVQGWSSGIKLLQSQLQLKKATVTQPKRDQLRKSVSLAPVIDLKSKRDDDELKSLAKPKSDPWPPILSSAGDDLNIVNEYNPSWPNEFEKKVKELREHSXETKKRKSRFGDPEESMSPPSIVNSTPQMSQPQIASSFLXGAAIAPPPSLQEPSDPVPIIPTKPQPASSYGGSVAAKIMARYGFKEGTRSXKRNKGMARGLKGKKTSQKRRED

SEQ ID NO: 33105 - protein, 167 aa, Diabrotica virgifera
  misc_feature: Coding regions on vcDNA: vcDNA=SeqID_12802; Strand=+; Position=3-503
  misc_feature (2)..(48): Xaa can be any naturally occurring amino acid
  misc_feature (60)..(69): Xaa can be any naturally occurring amino acid
SXXXXXXXXXXXXXXXXXXXXXXXXXXXXXXXXXXXXXXXXXXXXXXXESYNIIRYRYSXXXXXXXXXXYKNWGDSKLTCSLNRIHLPTYLRFIRKNILFMIRTIHIYMDMFRLPIILISSYPPTNKIPLRSPVDMKLTDKHSPIAIRQNPCFYTASFMIRYRLSIT

SEQ ID NO: 33106 - protein, 79 aa, Diabrotica virgifera
  misc_feature: Coding regions on vcDNA: vcDNA=SeqID_12803; Strand=+; Position=8-247
  misc_feature (7)..(7): Xaa can be any naturally occurring amino acid
GPPHTPXNGDPPFQPERTEREDKRTQKVPGKKNTRKARNQLGFWTKAIMRSLIPQCTHYKFSKIYCYIYWSEYDIDSKP

SEQ ID NO: 33107 - protein, 80 aa, Diabrotica virgifera
  misc_feature: Coding regions on vcDNA: vcDNA=SeqID_12804; Strand=-; Position=100-342
TYKSDTYFRFLRTYLFPFNKSIDMTMNIISFHVHYFQSLSFSFFYAFVVLSCLLILITFLFITCTSASTVLSFADMIIYM

SEQ ID NO: 33108 - protein, 31 aa, Diabrotica virgifera
  misc_feature: Coding regions on vcDNA: vcDNA=SeqID_12805; Strand=-; Position=0-92
  misc_feature (8)..(25): Xaa can be any naturally occurring amino acid
YIDPPPPXXXXXXXXXXXXXXXXXXPNSLSL

SEQ ID NO: 33109 - protein, 107 aa, Diabrotica virgifera
  misc_feature: Coding regions on vcDNA: vcDNA=SeqID_12806; Strand=-; Position=339-662
  misc_feature (57)..(68): Xaa can be any naturally occurring amino acid
  misc_feature (72)..(78): Xaa can be any naturally occurring amino acid
  misc_feature (82)..(92): Xaa can be any naturally occurring amino acid
  misc_feature (98)..(105): Xaa can be any naturally occurring amino acid
FNSTRHVGHKHVNKYVWGIPVFIYIYLYSTYNKVMLFFITIYRLEYGKIILPHHLYXXXXXXXXXXXXQHIXXXXXXXSLFXXXXXXXXXXXSLKLIXXXXXXXXYI

SEQ ID NO: 33110 - protein, 81 aa, Diabrotica virgifera
  misc_feature: Coding regions on vcDNA: vcDNA=SeqID_12807; Strand=-; Position=2-244
  misc_feature (12)..(81): Xaa can be any naturally occurring amino acid
RLILKRITSHHXXXXXXXXXXXXXXXXXXXXXXXXXXXXXXXXXXXXXXXXXXXXXXXXXXXXXXXXXXXXXXXXXXXXXX

SEQ ID NO: 33111 - protein, 100 aa, Diabrotica virgifera; identical to SEQ ID NO: 30473
  misc_feature: Coding regions on vcDNA: vcDNA=SeqID_12808; Strand=-; Position=0-299
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(99): Xaa can be any naturally occurring amino acid

SEQ ID NO: 33112 - protein, 22 aa, Diabrotica virgifera
  misc_feature: Coding regions on vcDNA: vcDNA=SeqID_12809; Strand=-; Position=1-66
  misc_feature (1)..(22): Xaa can be any naturally occurring amino acid
XXXXXXXXXXXXXXXXXXXXXX

SEQ ID NO: 33113 - protein, 186 aa, Diabrotica virgifera
  misc_feature: Coding regions on vcDNA: vcDNA=SeqID_12810; Strand=+; Position=60-620
  misc_feature: Homolog annotation: Hit_ID=NP_610270.1; Match level="QueryCoverage =96%, HitCoverage=100%, E-value=8e-61, Identity=62%"; Hit description= CG1707-PA [Drosophila melanogaster] gb|AAF59267.1| CG1707-PA [Drosophila melanogaster]
  misc_feature: Gene Ontology Annotation: Molecular function=lactoylglutathione lyase activity; Cellular component=cellular_component unknown; Biological process=carbohydrate metabolism
  misc_feature: Pfam annotation: Pfam_ID=Glyoxalase; Match level="Score=107.3, E -value=3.8e-29, Copies=1"; Pfam description=Glyoxalase/Bleomycin resistance protei
  misc_feature (107)..(115): Xaa can be any naturally occurring amino acid
MGDITNPPISNEDILKLCKPATEETKDFIMQQTMYRIKNPKISIPFYTEVLGMQLLTKLDFPSMKFSLYFMGYEDPKDLAGGLSSQERVTWTFGRKATIELTHNWGXXXXXXXXXHNGNQDPRGFGHIGVMVPDVYKACERFEKLNVNFVKRPDDGKMKGLAFITDPDGYWIEIFNNKSVGDTVSS

SEQ ID NO: 33114 - protein, 115 aa, Diabrotica virgifera
  misc_feature: Coding regions on vcDNA: vcDNA=SeqID_12811; Strand=-; Position=25-372
PKHRVSKLRFHSIYSRTFPNRHEIITRHPVSGGFFGTRNLNSPPKTMHHREGATYAPQRSFNRFNFVYYPLYILFESKLPFSQYSHLKKVYYIHLGKLNRFRDKGILNLRGNIIF

SEQ ID NO: 33115 - protein, 28 aa, Diabrotica virgifera
  misc_feature: Coding regions on vcDNA: vcDNA=SeqID_12812; Strand=-; Position=1-84
VVMPSFCKTSILASSLSFHNHHFDKLLP

SEQ ID NO: 33116 - protein, 215 aa, Diabrotica virgifera
  misc_feature: Coding regions on vcDNA: vcDNA=SeqID_12813; Strand=+; Position=198-841
  misc_feature: Homolog annotation: Hit_ID=XP_318704.1; Match level="QueryCoverage =90%, HitCoverage=85%, E-value=8e-62, Identity=57%"; Hit description =ENSANGP00000010251 [Anopheles gambiae]
  misc_feature: Gene Ontology Annotation: Molecular function=ATP binding; Cellular component=cellular_component unknown; Biological process=biological _process unknown
  misc_feature: Pfam annotation: Pfam_ID=ADK; Match level="Score=187.0, E-value=3.9e -53, Copies=1"; Pfam description=Adenylate kinase
  misc_feature (181)..(181): Xaa can be any naturally occurring amino acid
MTSKIFKSVILGAPGSGKGTISSRILNAFNLGYLSSGDQLRQHIQKKSAIGLEAEKCINNGKLVGDDIMIKFILSELHGLSSNTWLLDGFPRTLSQAKAFWEVEKLDLAINLVVPPEVIVSRVTGRWVHLPSGRVYNDTFNKPKVPGKDDITGEPLTKRGDDTPEIVKKRLELYDALTRPXNRFYTEKGILRDFAGHLLMNVSKVIVLTRVLEQH

SEQ ID NO: 33117 - protein, 54 aa, Diabrotica virgifera
  misc_feature: Coding regions on vcDNA: vcDNA=SeqID_12814; Strand=-; Position=1-162
  misc_feature (3)..(50): Xaa can be any naturally occurring amino acid
KNXXXXXXXXXXXXXXXXXXXXXXXXXXXXXXXXXXXXXXXXXXXXXXXXSIGV

SEQ ID NO: 33118 - protein, 78 aa, Diabrotica virgifera
  misc_feature: Coding regions on vcDNA: vcDNA=SeqID_12815; Strand=-; Position=4-240
  misc_feature (5)..(11): Xaa can be any naturally occurring amino acid
  misc_feature (17)..(24): Xaa can be any naturally occurring amino acid
  misc_feature (34)..(60): Xaa can be any naturally occurring amino acid
  misc_feature (71)..(76): Xaa can be any naturally occurring amino acid
NLFYXXXXXXXLSLLNXXXXXXXXLINNSLSSIXXXXXXXXXXXXXXXXXXXXXXXXXXXSLFLKKDLPFXXXXXXDP

SEQ ID NO: 33119 - protein, 71 aa, Diabrotica virgifera
  misc_feature: Coding regions on vcDNA: vcDNA=SeqID_12816; Strand=-; Position=3-218
  misc_feature (18)..(24): Xaa can be any naturally occurring amino acid
  misc_feature (42)..(50): Xaa can be any naturally occurring amino acid
  misc_feature (59)..(59): Xaa can be any naturally occurring amino acid
SLLLININISIFFHFNIXXXXXXXIIFPYPLQINLPTHFITXXXXXXXXXPYHPILFFXHLRIIFTYNPGR

SEQ ID NO: 33120 - protein, 240 aa, Diabrotica virgifera
  misc_feature: Coding regions on vcDNA: vcDNA=SeqID_12817; Strand=+; Position=203-921
  misc_feature: Homolog annotation: Hit_ID=XP_392834.1; Match level="QueryCoverage =92%, HitCoverage=28%, E-value=1e-74, Identity=61%"; Hit description =similar to CG9104-PA [Apis mellifera]
  misc_feature: Gene Ontology Annotation: Cellular component=endoplasmic reticulum
  misc_feature: Pfam annotation: Pfam_ID=NPR2; Match level="Score=100.1, E-value=5.8e- 27, Copies=1"; Pfam description=Nitrogen permease regulator 2
  misc_feature (157)..(157): Xaa can be any naturally occurring amino acid
  misc_feature (210)..(210): Xaa can be any naturally occurring amino acid
  misc_feature (218)..(218): Xaa can be any naturally occurring amino acid
  misc_feature (228)..(228): Xaa can be any naturally occurring amino acid
MNVKEFVKNRIEFPRKEGPIRCIFFCEFHPTAGPIISCQVPENYISKELFDSISVYIITKAELQRSVITVTLQDYKILGFPVRIDDKDKYVRNAFHFNLCFVCDSDARTVQYESVVQKFSDYLVAREMESNFLSQGKVIIKLTPILTHVKEELNTKXECALTEGATTTHLKVCRIRLDPSPVMDHQVPIFIRELPEQQWDLTTQQVPIIXDGFNHVAXIATLSDVENXLVKACVQNLVIM

SEQ ID NO: 33121 - protein, 123 aa, Diabrotica virgifera
  misc_feature: Coding regions on vcDNA: vcDNA=SeqID_12818; Strand=+; Position=150-522
  misc_feature: Homolog annotation: Hit_ID=NP_650026.1; Match level="QueryCoverage =86%, HitCoverage=49%, E-value=2e-13, Identity=40%"; Hit description =CG4511-PA [Drosophila melanogaster] gb|AAF54565.1| CG4511-PA [Drosophila melanogaster]
  misc_feature (55)..(55): Xaa can be any naturally occurring amino acid
  misc_feature (71)..(71): Xaa can be any naturally occurring amino acid
MDDDQNKLLKLTLVILSIGDASPNHVDNLDTNDLKELRIYILKELKNLKKQKTTXIRLDPVKYKELIYETXLIYLIKNSESAIIHFYKDSTLSCKIVHNHLKILASYHIEHQLYYITCSTIAP

SEQ ID NO: 33122 - protein, 61 aa, Diabrotica virgifera
  misc_feature: Coding regions on vcDNA: vcDNA=SeqID_12819; Strand=-; Position=15-200
  misc_feature (26)..(51): Xaa can be any naturally occurring amino acid
EKITVKIFYYLIVLLHLNFHNIQIIXXXXXXXXXXXXXXXXXXXXXXXXXXKTNKNRSRKY

SEQ ID NO: 33123 - protein, 312 aa, Diabrotica virgifera
  misc_feature: Coding regions on vcDNA: vcDNA=SeqID_12820; Strand=+; Position=1-936
  misc_feature (3)..(311): Xaa can be any naturally occurring amino acid
HFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 33124 - protein, 305 aa, Diabrotica virgifera
  misc_feature: Coding regions on vcDNA: vcDNA=SeqID_12821; Strand=-; Position=0-914
  misc_feature (2)..(21): Xaa can be any naturally occurring amino acid
  misc_feature (35)..(301): Xaa can be any naturally occurring amino acid
TXXXXXXXXXXXXXXXXXXXXSIGSLVCKKCKLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSKG

SEQ ID NO: 33125 - protein, 33 aa, Diabrotica virgifera
  misc_feature: Coding regions on vcDNA: vcDNA=SeqID_12822; Strand=+; Position=2-103
  misc_feature (1)..(6): Xaa can be any naturally occurring amino acid
  misc_feature (9)..(9): Xaa can be any naturally occurring amino acid
  misc_feature (13)..(22): Xaa can be any naturally occurring amino acid
XXXXXXLIXLQTXXXXXXXXXXNSFLVFNLLYH

SEQ ID NO: 33126 - protein, 75 aa, Diabrotica virgifera
  misc_feature: Coding regions on vcDNA: vcDNA=SeqID_12823; Strand=-; Position=228-455
SPLLFSDEPIRDHRHTSSGVDTCIVVRCVAGVIHSTCHPNTRLQTQTTGLYNNNPHTHEQAFRSLSTRTKKTINK

SEQ ID NO: 33127 - protein, 70 aa, Diabrotica virgifera
  misc_feature: Coding regions on vcDNA: vcDNA=SeqID_12824; Strand=+; Position=340-549
LLRYVSVVKRLVYSLGRKSFRSPNKLLLLFSITCVALHFWTYGFRCNVYATEVDSPSVEQNIVAKYSIYD

SEQ ID NO: 33128 - protein, 85 aa, Diabrotica virgifera
  misc_feature: Coding regions on vcDNA: vcDNA=SeqID_12825; Strand=-; Position=10-267
GYIYCRNSEIQLVFQTLEIQRKVCHFFTIKLIRIFVFQSIFWFRSCFQLAHNKDIILDLSSAIHKAQNINSTFMNIRYSLTIVNT

SEQ ID NO: 33129 - protein, 105 aa, Diabrotica virgifera
  misc_feature: Coding regions on vcDNA: vcDNA=SeqID_12826; Strand=-; Position=68-385
  misc_feature (31)..(40): Xaa can be any naturally occurring amino acid
  misc_feature (71)..(81): Xaa can be any naturally occurring amino acid
  misc_feature (89)..(103): Xaa can be any naturally occurring amino acid
NKVLVDCFIQPFIPVINKKYKDYASLALSKXXXXXXXXXXRRAFIFNAQRHVVNKQVKNIFPNSFIILIYXXXXXXXXXXXVSSLLYLXXXXXXXXXXXXXXXSL

SEQ ID NO: 33130 - protein, 60 aa, Diabrotica virgifera
  misc_feature: Coding regions on vcDNA: vcDNA=SeqID_12827; Strand=-; Position=1-180
  misc_feature (9)..(24): Xaa can be any naturally occurring amino acid
  misc_feature (26)..(34): Xaa can be any naturally occurring amino acid
  misc_feature (36)..(50): Xaa can be any naturally occurring amino acid
  misc_feature (52)..(60): Xaa can be any naturally occurring amino acid
KNLDRKIYXXXXXXXXXXXXXXXXAXXXXXXXXXIXXXXXXXXXXXXXXXLXXXXXXXXX

SEQ ID NO: 33131 - protein, 78 aa, Diabrotica virgifera
  misc_feature: Coding regions on vcDNA: vcDNA=SeqID_12828; Strand=+; Position=476-712
  misc_feature (71)..(77): Xaa can be any naturally occurring amino acid
PGSAAVPINPSYRGSTVHLNLNHLSRQNNMRRDQRYKIKYLFIVEHNFTKGQQALVYLLCCLEATIIQNSXXXXXXXA

SEQ ID NO: 33132 - protein, 70 aa, Diabrotica virgifera
  misc_feature: Coding regions on vcDNA: vcDNA=SeqID_12829; Strand=+; Position=285-497
ISYFYTRTIPNSAVFQHMTDSDHPNSRKDFSIIGHASSPKELSIKEALSIFLLKPPLNTQQDMACLKLLT

SEQ ID NO: 33133 - protein, 288 aa, Diabrotica virgifera
  misc_feature: Coding regions on vcDNA: vcDNA=SeqID_12830; Strand=-; Position=1-864
  misc_feature (6)..(286): Xaa can be any naturally occurring amino acid
FYKLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEK

SEQ ID NO: 33134 - protein, 75 aa, Diabrotica virgifera
  misc_feature: Coding regions on vcDNA: vcDNA=SeqID_12831; Strand=-; Position=151-378
SSLRLPCPTYYFSSTSYSAAPYTVHDVHHQPLFLKHPQRLRISDEVLTLLRASFRSNHIRPCPAAFTARDARDQL

SEQ ID NO: 33135 - protein, 245 aa, Diabrotica virgifera
  misc_feature: Coding regions on vcDNA: vcDNA=SeqID_12832; Strand=+; Position=19-756
  misc_feature: Homolog annotation: Hit_ID=NP_649639.1; Match level="QueryCoverage =80%, HitCoverage=66%, E-value=7e-39, Identity=43%"; Hit description =CG1169-PA [Drosophila melanogaster] gb|AAF51889.2| CG1169-PA [Drosophila melanogaster]
  misc_feature: Pfam annotation: Pfam_ID=DUF1676; Match level="Score=33.5, E-value =6.2e-07, Copies=1"; Pfam description=Protein of unknown function (DUF1676)
MNNINYSIVLLSTLVIFARCDQSAVDVIQDIYSSCLKDFSVSCVQPKSLQWLDNVSGSSFIKITDDLAIQRKYDAETETTKGLQKDVLDQFEDFLQSHNIVARAPAILKPNGPLGQYIPRSFQPADLTVPLAATGRSSKLVKRIIFPFLLGLKFKTAVLVPFALALIALKTWKALTLGLLSLVLSGAIAIFSKLMGPKTQAYEVVHVPQHLDHHVLPAPAVPVAQPVYLARSLNAQELAYSAHRQ

SEQ ID NO: 33136 - protein, 90 aa, Diabrotica virgifera
  misc_feature: Coding regions on vcDNA: vcDNA=SeqID_12833; Strand=-; Position=0-269
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(88): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXRG

SEQ ID NO: 33137 - protein, 208 aa, Diabrotica virgifera
  misc_feature: Coding regions on vcDNA: vcDNA=SeqID_12834; Strand=+; Position=115-741
  misc_feature (176)..(181): Xaa can be any naturally occurring amino acid
SCKVVWKEDLVPYGTLKMVTLMPCNYLNAQNRCTMIDKMCEPKVKRSREDGDSPTEKERLICDSASSPQSGRSSSTCGSPTPITAATTVIHPAPTDPLSSSSPPASLPTANFTPAWSLLDTQGVKTEIRSPGLAESDCVASTQDSASFFITSIDLCNLYDKDYHQTYSAAHSYYNXXXXXXEIVGRHNSVHQLCMRRYTITPRIRTLD

SEQ ID NO: 33138 - protein, 73 aa, Diabrotica virgifera
  misc_feature: Coding regions on vcDNA: vcDNA=SeqID_12835; Strand=+; Position=218-439
  misc_feature (7)..(13): Xaa can be any naturally occurring amino acid
  misc_feature (27)..(40): Xaa can be any naturally occurring amino acid
  misc_feature (67)..(73): Xaa can be any naturally occurring amino acid
LYIYPYXXXXXXXQLFLRKSLIIELFXXXXXXXXXXXXXXVLEKMILFMLIYYHSICVIELIIRKSXXXXXXX

SEQ ID NO: 33139 - protein, 248 aa, Diabrotica virgifera
  misc_feature: Coding regions on vcDNA: vcDNA=SeqID_12836; Strand=+; Position=129-872
  misc_feature: Homolog annotation: Hit_ID=NP_569882.1; Match level="QueryCoverage =69%, HitCoverage=30%, E-value=8e-35, Identity=43%"; Hit description =CG3655-PA [Drosophila melanogaster] gb|AAF45582.1| CG3655-PA [Drosophila melanogaster]
MACPYLYRTRFYIAYVAKSFLVCIMTIIIFFFVRHILYSRGILLKIKMSKHHAESRIKAFSSVLETDIDAYSDEKALSDEQLKLVIEKILPSLPKIKKDWKSDAKRGYNQTCAKFVLPLNIEYRNSYWQSQKTSNGTFLLYNAYLDTRSENTLGPTVRIVGMIDIHKINSTTYCHLWFNGTNNPVIVKTFEHRSIWWFGKPQKGYFIPYLISCVWPKKFSKRIPESIFLGEERECDNATNRFKSLYDN

SEQ ID NO: 33140 - protein, 73 aa, Diabrotica virgifera
  misc_feature: Coding regions on vcDNA: vcDNA=SeqID_12837; Strand=+; Position=487-708
KHKDRLFNKSIKPFTTKWFLQERTESVTIYGPMFAKQADFHEHLKIKEPFKLIHLKMEVETKKRCDGSDLNSN

SEQ ID NO: 33141 - protein, 88 aa, Diabrotica virgifera
  misc_feature: Coding regions on vcDNA: vcDNA=SeqID_12838; Strand=-; Position=287-553
ERRQQKFFLWQWQKLSELLTIKTCNNMQKPPYQPFYSHLFLRLRILKGFNINSLIDLVETYKIIFTKLSRIRNKRVTGKKKGEIQLEA

SEQ ID NO: 33142 - protein, 141 aa, Diabrotica virgifera
  misc_feature: Coding regions on vcDNA: vcDNA=SeqID_12839; Strand=-; Position=1-423
  misc_feature (119)..(119): Xaa can be any naturally occurring amino acid
LESSLQIWTVILSSPHLHASHPKHNNNISSSIPSLAPPGHPHLRKYVTSSSPPPPYPLSDNTSIMMPSIYRDHCDVRHIHGQFQQPDGHIHGENHTQPWCVGSIRIYMLFCVVAVSSMXIASGVGKGVTIPSTTVNGRCGR

SEQ ID NO: 33143 - protein, 93 aa, Diabrotica virgifera; identical to SEQ ID NO: 27329
  misc_feature: Coding regions on vcDNA: vcDNA=SeqID_12840; Strand=+; Position=488-769
  misc_feature (25)..(55): Xaa can be any naturally occurring amino acid

SEQ ID NO: 33144 - protein, 107 aa, Diabrotica virgifera
  misc_feature: Coding regions on vcDNA: vcDNA=SeqID_12841; Strand=+; Position=416-736
  misc_feature: Homolog annotation: Hit_ID=CAG00490.1; Match level="QueryCoverage =99%, HitCoverage=19%, E-value=4e-18, Identity=48%"; Hit description =unnamed protein product [Tetraodon nigroviridis]
  misc_feature: Gene Ontology Annotation: Molecular function=molecular_function unknown; Cellular component=cellular_component unknown; Biological process=biological_process unknown
  misc_feature (66)..(66): Xaa can be any naturally occurring amino acid
  misc_feature (99)..(99): Xaa can be any naturally occurring amino acid
DNTLAKNTDYILKDKAFDPIKDSNKYTLMPYKKKSHNFALKLYYEVTKSIRERLKSDSDDFTLCLXNPDKDKKPLPMITGHQQLNNDVKFSPNVRKLAXASFDKSIE

SEQ ID NO: 33145 - protein, 43 aa, Diabrotica virgifera
  misc_feature: Coding regions on vcDNA: vcDNA=SeqID_12842; Strand=-; Position=1-129
  misc_feature (19)..(25): Xaa can be any naturally occurring amino acid
FSYHYYCINKNKEKTLTFXXXXXXXLTYILIYIIINDNIGRVE

SEQ ID NO: 33146 - protein, 285 aa, Diabrotica virgifera
  misc_feature: Coding regions on vcDNA: vcDNA=SeqID_12843; Strand=-; Position=1-855
  misc_feature (7)..(30): Xaa can be any naturally occurring amino acid
  misc_feature (33)..(43): Xaa can be any naturally occurring amino acid
  misc_feature (47)..(47): Xaa can be any naturally occurring amino acid
  misc_feature (53)..(60): Xaa can be any naturally occurring amino acid
  misc_feature (63)..(76): Xaa can be any naturally occurring amino acid
  misc_feature (82)..(95): Xaa can be any naturally occurring amino acid
  misc_feature (97)..(285): Xaa can be any naturally occurring amino acid
RKYFGWXXXXXXXXXXXXXXXXXXXXXXXXPFXXXXXXXXXXXTNLXHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33147 - protein, 136 aa, Diabrotica virgifera
  misc_feature: Coding regions on vcDNA: vcDNA=SeqID_12844; Strand=-; Position=116-526
FKFLYSLIDYSIFYIIIEFITHIVIKYLGDNITRNLFYIPNNIFNVVTLFTSTSWTRYNFYFFIKKTCVEVLKCNSQNVPVCGYVSTQVQNSGSFCRRRCQIGVPVVITIEYNIKYLYIIVSAGRLCTYAIGWSIT

SEQ ID NO: 33148 - protein, 116 aa, Diabrotica virgifera
  misc_feature: Coding regions on vcDNA: vcDNA=SeqID_12845; Strand=-; Position=2-349
  misc_feature (8)..(19): Xaa can be any naturally occurring amino acid
  misc_feature (25)..(34): Xaa can be any naturally occurring amino acid
  misc_feature (37)..(44): Xaa can be any naturally occurring amino acid
  misc_feature (77)..(85): Xaa can be any naturally occurring amino acid
  misc_feature (91)..(97): Xaa can be any naturally occurring amino acid
  misc_feature (99)..(110): Xaa can be any naturally occurring amino acid
IKAVVVSXXXXXXXXXXXXMIMLPXXXXXXXXXXGKXXXXXXXXLIQKGMGLMSRRKECRRIPLLYVYILHQYTSGXXXXXXXXXNLNNLXXXXXXXNXXXXXXXXXXXXEYRTRG

SEQ ID NO: 33149 - protein, 188 aa, Diabrotica virgifera
  misc_feature: Coding regions on vcDNA: vcDNA=SeqID_12846; Strand=+; Position=3-570
  misc_feature: Homolog annotation: Hit_ID=AAH61203.1; Match level="QueryCoverage =98%, HitCoverage=90%, E-value=1e-36, Identity=38%"; Hit description =Unknown (protein for MGC:74346) [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=91.2, E-value =2.6e-24, Copies=4"; Pfam description=Zinc finger, C2H2 type
  misc_feature (28)..(28): Xaa can be any naturally occurring amino acid
FSRPEKPHKCEICFKQFSTAQCLKYHLXTHSGEMPFKCGICYKQFSQKGHLDSHHLIVHTVEKPYKCEICFKQFQSTNHLKRHLRVHTGEKPYKCKICSKQFSESNSLKRHLRFTQDADLTRHLRIHIEDNKQFSQYGNLKSHMKVHTGEKPFSAAVSLRKHLRIKQFARLDNMKNHMNTHRRKKLQV

SEQ ID NO: 33150 - protein, 265 aa, Diabrotica virgifera
  misc_feature: Coding regions on vcDNA: vcDNA=SeqID_12847; Strand=-; Position=1-795
  misc_feature (1)..(263): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEE

SEQ ID NO: 33151 - protein, 57 aa, Diabrotica virgifera
  misc_feature: Coding regions on vcDNA: vcDNA=SeqID_12848; Strand=-; Position=411-584
TCFSIPTALKGELNQALLLSVHVNDSVTLLDLSLAACQSFKTRSLPYCKVRSLRVVS

SEQ ID NO: 33152 - protein, 34 aa, Diabrotica virgifera
  misc_feature: Coding regions on vcDNA: vcDNA=SeqID_12849; Strand=-; Position=2-103
  misc_feature (4)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (30)..(31): Xaa can be any naturally occurring amino acid
YNNXXXXXXXXXXXXXXXXXXXXKXNXSFXXLKI

SEQ ID NO: 33153 - protein, 29 aa, Diabrotica virgifera
  misc_feature: Coding regions on vcDNA: vcDNA=SeqID_12850; Strand=-; Position=1-87
  misc_feature (10)..(16): Xaa can be any naturally occurring amino acid
  misc_feature (21)..(29): Xaa can be any naturally occurring amino acid
DRYCVLPPDXXXXXXXAFEGXXXXXXXXX

SEQ ID NO: 33154 - protein, 324 aa, Diabrotica virgifera
  misc_feature: Coding regions on vcDNA: vcDNA=SeqID_12851; Strand=-; Position=1-972
  misc_feature (1)..(320): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGREM

SEQ ID NO: 33155 - protein, 69 aa, Diabrotica virgifera
  misc_feature: Coding regions on vcDNA: vcDNA=SeqID_12852; Strand=+; Position=114-320
  misc_feature (25)..(31): Xaa can be any naturally occurring amino acid
  misc_feature (57)..(65): Xaa can be any naturally occurring amino acid
FLFEEFKSIIKIANLDVGIKVYNWXXXXXXXSLVQLFKFLLDPELKPGRSPGWVSYXXXXXXXXXTKGT

SEQ ID NO: 33156 - protein, 300 aa, Diabrotica virgifera
  misc_feature: Coding regions on vcDNA: vcDNA=SeqID_12853; Strand=+; Position=2-904
  misc_feature (5)..(276): Xaa can be any naturally occurring amino acid
  misc_feature (281)..(281): Xaa can be any naturally occurring amino acid
LHCVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIITLXIQRNFIESQSIIRLRPRCD

SEQ ID NO: 33157 - protein, 288 aa, Diabrotica virgifera
  misc_feature: Coding regions on vcDNA: vcDNA=SeqID_12854; Strand=+; Position=110-974
  misc_feature: Homolog annotation: Hit_ID=NP_649789.1; Match level="QueryCoverage =99%, HitCoverage=70%, E-value=7e-92, Identity=58%"; Hit description =CG9613-PA [Drosophila melanogaster] gb|AAF54222.1| CG9613-PA [Drosophila melanogaster]
  misc_feature: Gene Ontology Annotation: Molecular function=carrier activity; Cellular component=mitochondrion; Biological process=electron transport
  misc_feature: Pfam annotation: Pfam_ID=UbiA; Match level="Score=97.2, E-value=4.2e -26, Copies=1"; Pfam description=UbiA prenyltransferase family
  misc_feature (225)..(225): Xaa can be any naturally occurring amino acid
  misc_feature (242)..(242): Xaa can be any naturally occurring amino acid
  misc_feature (255)..(256): Xaa can be any naturally occurring amino acid
MLSRIVIRNFDKSHLLRRKQLCSVTIFNSSFTNPIEDEAPPKPTLVAKLVSNSPKSIQPYLKLVRFDRPIGTFLLFWPCSWSIASAAAPGALPDPYMLALFATGALVMRGAGCTINDMWDKDIDGKVERTKERPLVNGDISMKQALVFLSGQLSVGLAILLQLNWPSVFLGASSLALVISYPLMKRITYWPQLVLGFTFNWGALLGYSAIHGYVDLPVCLPLYMXGVCWTIIYDTIYAHQDXTDDLRVGIKSTAXXFDEDTKLWLSGFASTMIGSLVISGGMNSQTWP

SEQ ID NO: 33158 - protein, 297 aa, Diabrotica virgifera
  misc_feature: Coding regions on vcDNA: vcDNA=SeqID_12855; Strand=-; Position=1-891
  misc_feature (3)..(293): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDARK

SEQ ID NO: 33159 - protein, 62 aa, Diabrotica virgifera
  misc_feature: Coding regions on vcDNA: vcDNA=SeqID_12856; Strand=-; Position=240-428
  misc_feature (7)..(15): Xaa can be any naturally occurring amino acid
  misc_feature (18)..(37): Xaa can be any naturally occurring amino acid
YLFKHSXXXXXXXXXHPXXXXXXXXXXXXXXXXXXXXINLKFHLPKLYSYKYIITPHSHIII

SEQ ID NO: 33160 - protein, 52 aa, Diabrotica virgifera
  misc_feature: Coding regions on vcDNA: vcDNA=SeqID_12857; Strand=+; Position=1-156
  misc_feature (11)..(24): Xaa can be any naturally occurring amino acid
RDLDPAKEDNXXXXXXXXXXXXXXEKHCFFFIYKDFFLPVQMLYFSDTKETP

SEQ ID NO: 33161 - protein, 177 aa, Diabrotica virgifera
  misc_feature: Coding regions on vcDNA: vcDNA=SeqID_12858; Strand=+; Position=79-609
  misc_feature: Homolog annotation: Hit_ID=XP_318916.1; Match level="QueryCoverage =98%, HitCoverage=54%, E-value=2e-58, Identity=60%"; Hit description =ENSANGP00000015053 [Anopheles gambiae]
  misc_feature: Gene Ontology Annotation: Molecular function=cyclosporin A binding; Cellular component=spliceosome complex; Biological process=mRNA splicing
  misc_feature: Pfam annotation: Pfam_ID=RRM_1; Match level="Score=95.4, E-value=1.4e- 25, Copies=1"; Pfam description=RNA recognition motif. (a.k.a. RRM, RB
  misc_feature (121)..(127): Xaa can be any naturally occurring amino acid
MSSNNKRTVYVGGLAEEVDEQVLNAAFIPFGDIIDVQIPLDYESEKHRGFAFIEFESAEDAGAAIDNMNDSELFGRTIRVNLAKPQRIKEGSTRPVWSEDTWLQQHAGETIGKKLGTGEKXXXXXXXSEATSNESKKVKNPQVYFDIKIGKSEIGRITMMLRDDVAPKRVEKFHRGC

SEQ ID NO: 33162 - protein, 68 aa, Diabrotica virgifera
  misc_feature: Coding regions on vcDNA: vcDNA=SeqID_12859; Strand=-; Position=1-204
  misc_feature (33)..(33): Xaa can be any naturally occurring amino acid
  misc_feature (39)..(46): Xaa can be any naturally occurring amino acid
  misc_feature (48)..(48): Xaa can be any naturally occurring amino acid
  misc_feature (56)..(62): Xaa can be any naturally occurring amino acid
TFNYNKFFIKFILHNTFFSLILFLLSLGVPFSXSLPLYXXXXXXXXSXLSLKAAHXXXXXXXGLGVKP

SEQ ID NO: 33163 - protein, 295 aa, Diabrotica virgifera
  misc_feature: Coding regions on vcDNA: vcDNA=SeqID_12860; Strand=+; Position=20-904
  misc_feature: Homolog annotation: Hit_ID=XP_320667.1; Match level="QueryCoverage =89%, HitCoverage=63%, E-value=1e-112, Identity=75%"; Hit description= ENSANGP00000008782 [Anopheles gambiae]
  misc_feature: Gene Ontology Annotation: Molecular function=peptidase activity; Cellular component=nucleus; Biological process=negative regulation of cell proliferation
  misc_feature: Pfam annotation: Pfam_ID=Peptidase_C12; Match level="Score=313.8, E -value=2.7e-91, Copies=1"; Pfam description=Ubiquitin carboxyl -terminal hydrolase,
  misc_feature (83)..(89): Xaa can be any naturally occurring amino acid
MPVDIKELTEGWLELESDPGLFTLLLEDFGVKGVQVEEIYDLNKPLDSPVYGFIFLFRWVEERRSRRKVVEQNETFVKDEDIXXXXXXXQQMVPNSCATHALISILLNCPTIHLGETLTRLKAHTQGMSPDNKGWAIGNTPELACAHNSHAMPQAKRRLEKGSGVSTGRFTGEAFHFVSFVPIGGRLFELDGLKPFPIDHGPCNDMEWTDKFRSVITDRLGITADEYNEIRFNLMAVVPDRRLAIQHKLKMLRTNKQIVLDALQHLVKIKDKGGGTKLENQGEHVKISYLTVLKS

SEQ ID NO: 33164 - protein, 87 aa, Diabrotica virgifera
  misc_feature: Coding regions on vcDNA: vcDNA=SeqID_12861; Strand=-; Position=309-572
  misc_feature (33)..(39): Xaa can be any naturally occurring amino acid
EICLKNASKIQFKVFIFTNYRNFKYLLLLWTSXXXXXXXHSLSSCFNYKGLQYKQINEMIKTNTIKKLDKKIKALKQNLAELQNTVK

SEQ ID NO: 33165 - protein, 214 aa, Diabrotica virgifera
  misc_feature: Coding regions on vcDNA: vcDNA=SeqID_12862; Strand=-; Position=10-654
  misc_feature (48)..(53): Xaa can be any naturally occurring amino acid
  misc_feature (63)..(96): Xaa can be any naturally occurring amino acid
  misc_feature (101)..(117): Xaa can be any naturally occurring amino acid
  misc_feature (120)..(153): Xaa can be any naturally occurring amino acid
  misc_feature (158)..(180): Xaa can be any naturally occurring amino acid
  misc_feature (182)..(192): Xaa can be any naturally occurring amino acid
  misc_feature (199)..(213): Xaa can be any naturally occurring amino acid
DCFLSPVQIPRPFQFIRGPAGPYFLFQKAQFFINRWKKWFRIPLINLXXXXXXSTFLFLFYPXXXXXXXXXXXXXXXXXXXXXXXXXXXXXXXXXXGNFLXXXXXXXXXXXXXXXXXPSXXXXXXXXXXXXXXXXXXXXXXXXXXXXXXXXXXGLPFXXXXXXXXXXXXXXXXXXXXXXXWXXXXXXXXXXXPDSPGSXXXXXXXXXXXXXXXS

SEQ ID NO: 33166 - protein, 68 aa, Diabrotica virgifera
  misc_feature: Coding regions on vcDNA: vcDNA=SeqID_12863; Strand=-; Position=1-204
  misc_feature (3)..(9): Xaa can be any naturally occurring amino acid
  misc_feature (11)..(68): Xaa can be any naturally occurring amino acid
KKXXXXXXXPXXXXXXXXXXXXXXXXXXXXXXXXXXXXXXXXXXXXXXXXXXXXXXXXXXXXXXXXXX

SEQ ID NO: 33167 - protein, 38 aa, Diabrotica virgifera
  misc_feature: Coding regions on vcDNA: vcDNA=SeqID_12864; Strand=-; Position=0-113
  misc_feature (2)..(35): Xaa can be any naturally occurring amino acid
PXXXXXXXXXXXXXXXXXXXXXXXXXXXXXXXXXXLFT

SEQ ID NO: 33168 - protein, 61 aa, Diabrotica virgifera
  misc_feature: Coding regions on vcDNA: vcDNA=SeqID_12865; Strand=-; Position=1-183
  misc_feature (5)..(25): Xaa can be any naturally occurring amino acid
  misc_feature (27)..(61): Xaa can be any naturally occurring amino acid
SKKMXXXXXXXXXXXXXXXXXXXXXGXXXXXXXXXXXXXXXXXXXXXXXXXXXXXXXXXXX

SEQ ID NO: 33169 - protein, 105 aa, Diabrotica virgifera
  misc_feature: Coding regions on vcDNA: vcDNA=SeqID_12866; Strand=-; Position=1-315
  misc_feature (60)..(65): Xaa can be any naturally occurring amino acid
  misc_feature (69)..(78): Xaa can be any naturally occurring amino acid
  misc_feature (84)..(92): Xaa can be any naturally occurring amino acid
TNKLSTTNYLTAFQPGTIEKSNLRSKNIKNIKIPKVLKIAYLTSPGTRFLTLDYYIMLFXXXXXXVSTXXXXXXXXXXKIRAVXXXXXXXXXQIFTNKHNITTMR

SEQ ID NO: 33170 - protein, 62 aa, Diabrotica virgifera
  misc_feature: Coding regions on vcDNA: vcDNA=SeqID_12867; Strand=-; Position=72-260
RNRIALEKNYIRNFVVNKGDLLFELRQIENNYNSITLKIDPPHSTGTKNIYLVTIDAVNVPR

SEQ ID NO: 33171 - protein, 260 aa, Diabrotica virgifera
  misc_feature: Coding regions on vcDNA: vcDNA=SeqID_12868; Strand=+; Position=105-884
  misc_feature: Homolog annotation: Hit_ID=XP_321935.1; Match level="QueryCoverage =99%, HitCoverage=77%, E-value=3e-71, Identity=49%"; Hit description =ENSANGP00000013956 [Anopheles gambiae]
  misc_feature (201)..(201): Xaa can be any naturally occurring amino acid
  misc_feature (207)..(207): Xaa can be any naturally occurring amino acid
MEILTFIIKKLLQASYSFYTWPSAPVLAWFIWENREEFCGKKVVELGAGTALPGIVAAKCGADVILTESATLPKSLSHTRRSCQVNNLVVNQHIKVIGLTWGLFLGNLDLLGPLDYIIGSDCFFEPATFEDILVTVAYLLDININAKFFCTYQERSSDWSIEHLLSKWDLECIVHNINNLGNSIGLNIHDLIGDHSIHLLXIFRKSXVMATNGVRQLYRLYVSNIPWTVGSKELRPYFSKFGHLQQATVVFDRKTGMAKN

SEQ ID NO: 33172 - protein, 81 aa, Diabrotica virgifera
  misc_feature: Coding regions on vcDNA: vcDNA=SeqID_12869; Strand=+; Position=402-644
  misc_feature: Homolog annotation: Hit_ID=XP_392465.1; Match level="QueryCoverage =100%, HitCoverage=11%, E-value=3e-11, Identity=46%"; Hit description= similar to Bmsqd-2 [Apis mellifera]
  misc_feature: Gene Ontology Annotation: Cellular component=nuclear speck
  misc_feature: Pfam annotation: Pfam_ID=RRM_1; Match level="Score=12.9, E-value =0.0029, Copies=1"; Pfam description=RNA recognition motif. (a.k.a. RRM, RB
  misc_feature (36)..(41): Xaa can be any naturally occurring amino acid
ARIGKIFVCRITSELSDDDIWKYFSQIVEINDIEMXXXXXXNQRNGFGFVPFEAKQIAKVQHLPPIQSIEDQEVDVWIDTP

SEQ ID NO: 33173 - protein, 66 aa, Diabrotica virgifera
  misc_feature: Coding regions on vcDNA: vcDNA=SeqID_12870; Strand=+; Position=4-201
  misc_feature (5)..(14): Xaa can be any naturally occurring amino acid
  misc_feature (21)..(31): Xaa can be any naturally occurring amino acid
  misc_feature (36)..(44): Xaa can be any naturally occurring amino acid
  misc_feature (56)..(64): Xaa can be any naturally occurring amino acid
QRNFXXXXXXXXXXCNLDVGXXXXXXXXXXXLSLFXXXXXXXXXFKPVEARFGFYXXXXXXXXXKG

SEQ ID NO: 33174 - protein, 42 aa, Diabrotica virgifera
  misc_feature: Coding regions on vcDNA: vcDNA=SeqID_12871; Strand=-; Position=1-126
  misc_feature (32)..(40): Xaa can be any naturally occurring amino acid
IYNLSIIRLSSLLQLHNFHFYSDKKCIINQNXXXXXXXXXCL

SEQ ID NO: 33175 - protein, 97 aa, Diabrotica virgifera
  misc_feature: Coding regions on vcDNA: vcDNA=SeqID_12872; Strand=-; Position=365-658
LFYPPPFGSFHYTFLFLFLFLMFSISTLHFRRISELLALYHNVLPSIFLRDFISVVSSILFGLSVSGRVSGAYEIIGLITVLCKFYLLATCGFALFI

SEQ ID NO: 33176 - protein, 164 aa, Diabrotica virgifera
  misc_feature: Coding regions on vcDNA: vcDNA=SeqID_12873; Strand=-; Position=1-492
  misc_feature: Homolog annotation: Hit_ID=AAF87760.1; Match level="QueryCoverage =97%, HitCoverage=36%, E-value=3e-61, Identity=76%"; Hit description =cytochrome oxidase subunit I [Diabrotica virgifera zeae]
  misc_feature (47)..(47): Xaa can be any naturally occurring amino acid
  misc_feature (54)..(70): Xaa can be any naturally occurring amino acid
  misc_feature (101)..(101): Xaa can be any naturally occurring amino acid
  misc_feature (117)..(124): Xaa can be any naturally occurring amino acid
  misc_feature (145)..(145): Xaa can be any naturally occurring amino acid
VGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPGRVM

SEQ ID NO: 33177 - protein, 40 aa, Diabrotica virgifera
  misc_feature: Coding regions on vcDNA: vcDNA=SeqID_12874; Strand=-; Position=1-120
  misc_feature (1)..(20): Xaa can be any naturally occurring amino acid
  misc_feature (22)..(40): Xaa can be any naturally occurring amino acid
XXXXXXXXXXXXXXXXXXXXAXXXXXXXXXXXXXXXXXXX

SEQ ID NO: 33178 - protein, 90 aa, Diabrotica virgifera
  misc_feature: Coding regions on vcDNA: vcDNA=SeqID_12875; Strand=-; Position=14-286
RLFMILSQGGVARVGFILISQERLIPTVMGVKTMDITNTQTVHGNLNLFPKCDREKRCEQVLHPFLIGGVYLPRDLPTSKQSPNIRKVAT

SEQ ID NO: 33179 - protein, 115 aa, Diabrotica virgifera
  misc_feature: Coding regions on vcDNA: vcDNA=SeqID_12876; Strand=-; Position=599-946
  misc_feature (51)..(57): Xaa can be any naturally occurring amino acid
SENIFYLQQIGKNTDDVANIYKYVNSFQDAKQYKNESMYRLNIFLTMYNKXXXXXXXYEKVLKYVKFTFKFVLDIREMSQAFTKGNLMALLVALRTLEDQDQAEKGAEISAMNVF

SEQ ID NO: 33180 - protein, 37 aa, Diabrotica virgifera
  misc_feature: Coding regions on vcDNA: vcDNA=SeqID_12877; Strand=-; Position=61-174
KLRIPDPRGYDDVYFFDRNNRFYLNCNCLSLNTRSLC

SEQ ID NO: 33181 - protein, 79 aa, Diabrotica virgifera
  misc_feature: Coding regions on vcDNA: vcDNA=SeqID_12878; Strand=+; Position=1-237
  misc_feature (6)..(13): Xaa can be any naturally occurring amino acid
  misc_feature (18)..(26): Xaa can be any naturally occurring amino acid
  misc_feature (29)..(79): Xaa can be any naturally occurring amino acid
MKGWIXXXXXXXXYQEFXXXXXXXXXFYXXXXXXXXXXXXXXXXXXXXXXXXXXXXXXXXXXXXXXXXXXXXXXXXXXX

SEQ ID NO: 33182 - protein, 39 aa, Diabrotica virgifera
  misc_feature: Coding regions on vcDNA: vcDNA=SeqID_12879; Strand=-; Position=44-163
LVSVTLLRIRSGYPLEGKRDTVPSCVTSPLLPMTFGRAP

SEQ ID NO: 33183 - protein, 164 aa, Diabrotica virgifera
  misc_feature: Coding regions on vcDNA: vcDNA=SeqID_12880; Strand=+; Position=40-534
  misc_feature: Homolog annotation: Hit_ID=NP_610818.1; Match level="QueryCoverage =89%, HitCoverage=78%, E-value=7e-46, Identity=56%"; Hit description =CG12373-PA [Drosophila melanogaster] gb|AAF58460.1| CG12373-PA [Drosophila melanogaster]
  misc_feature: Pfam annotation: Pfam_ID=Ribosomal_L18p; Match level="Score=-36.2, E -value=0.014, Copies=1"; Pfam description=Ribosomal L18p/L5e family
MRYSTIVPKNEISPIMTNRNPRNLERLRIGYKPDGYHLDAPGKRYWHKLLINVSGKYIRASIQHFQNGEIISASTSEWSIKKQLYRTIDTCAYTNLGRVLAQRCLQAGLIEISCFIKPNSPDDKIALFLKALEEGGISLTEQPQYKASMPWDLDRPEKPWEVTE

SEQ ID NO: 33184 - protein, 33 aa, Diabrotica virgifera
  misc_feature: Coding regions on vcDNA: vcDNA=SeqID_12881; Strand=-; Position=1-99
  misc_feature (2)..(19): Xaa can be any naturally occurring amino acid
  misc_feature (22)..(33): Xaa can be any naturally occurring amino acid
IXXXXXXXXXXXXXXXXXXLYXXXXXXXXXXXX

SEQ ID NO: 33185 - protein, 51 aa, Diabrotica virgifera
  misc_feature: Coding regions on vcDNA: vcDNA=SeqID_12882; Strand=+; Position=2-154
  misc_feature (2)..(15): Xaa can be any naturally occurring amino acid
NXXXXXXXXXXXXXXRPRCGIKSYKLPSSYIFLALFDFKNFSRSGFFFRPG

SEQ ID NO: 33186 - protein, 24 aa, Diabrotica virgifera
  misc_feature: Coding regions on vcDNA: vcDNA=SeqID_12883; Strand=-; Position=1-72
  misc_feature (1)..(23): Xaa can be any naturally occurring amino acid
XXXXXXXXXXXXXXXXXXXXXXXL

SEQ ID NO: 33187 - protein, 298 aa, Diabrotica virgifera
  misc_feature: Coding regions on vcDNA: vcDNA=SeqID_12884; Strand=+; Position=2-895
  misc_feature: Homolog annotation: Hit_ID=EAA07880.2; Match level="QueryCoverage =98%, HitCoverage=30%, E-value=1e-62, Identity=43%"; Hit description =ENSANGP00000018229 [Anopheles gambiae str. PEST] ref|XP_563059.1| ENSANGP00000018229 [Anopheles gambiae st
  misc_feature: Gene Ontology Annotation: Molecular function=chaperone activity; Cellular component=Golgi trans face; Biological process=ommochrome biosynthesis
  misc_feature (170)..(176): Xaa can be any naturally occurring amino acid
PTRPILWLLGEHSQKVPQVAPDVLRKMAKTFPDEDDIVKLQVMNLAIKLYITNPEQTSLLCQYVCNLAKYDQNYDIRDKARLFKQFVPNQDGKIKTQALKIFLAQKPAPDLNVQLTGHEELQLGSLSHYIKQRANGYEDLPPFPANPPTGDVRNVEPLSGEEDKVHKSTXXXXXXXFNSGSGMWGSWESEASSGGNSSDYGSSTSSSSESDDMNEEDTSEEESSEEETSKKGSESEESQSSSEESSSADEAPAKQNQSLNSTNNTTTESVANSKKSNLDPLLDLDDIDNPAPVMTPSL

SEQ ID NO: 33188 - protein, 127 aa, Diabrotica virgifera
  misc_feature: Coding regions on vcDNA: vcDNA=SeqID_12885; Strand=-; Position=43-426
  misc_feature (4)..(10): Xaa can be any naturally occurring amino acid
  misc_feature (20)..(26): Xaa can be any naturally occurring amino acid
  misc_feature (28)..(90): Xaa can be any naturally occurring amino acid
  misc_feature (92)..(105): Xaa can be any naturally occurring amino acid
  misc_feature (109)..(122): Xaa can be any naturally occurring amino acid
LITXXXXXXXLIGNSYLTIXXXXXXXQXXXXXXXXXXXXXXXXXXXXXXXXXXXXXXXXXXXXXXXXXXXXXXXXXXXXXXXXXXXXXXXKXXXXXXXXXXXXXXIRKXXXXXXXXXXXXXXLTIRN

SEQ ID NO: 33189 - protein, 61 aa, Diabrotica virgifera
  misc_feature: Coding regions on vcDNA: vcDNA=SeqID_12886; Strand=+; Position=2-187
QAKHGVVWCCVFPRLCPSCKPLVSNISCCGKLNLSVVFNVCCDKNCVYQSDCLSSRNLLVS

SEQ ID NO: 33190 - protein, 277 aa, Diabrotica virgifera
  misc_feature: Coding regions on vcDNA: vcDNA=SeqID_12887; Strand=+; Position=1-831
  misc_feature (28)..(46): Xaa can be any naturally occurring amino acid
  misc_feature (53)..(71): Xaa can be any naturally occurring amino acid
  misc_feature (78)..(277): Xaa can be any naturally occurring amino acid
KYDRALVTDTLLLLWENILFVWKKNLLXXXXXXXXXXXXXXXXXXXISKRSYXXXXXXXXXXXXXXXXXXXYSFLDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33191 - protein, 52 aa, Diabrotica virgifera
  misc_feature: Coding regions on vcDNA: vcDNA=SeqID_12888; Strand=-; Position=0-155
RCTTRNSNLSILLDYGITSSDLFYHLILIQMKIKTTVRRYLKRLTTKNGRVG

SEQ ID NO: 33192 - protein, 323 aa, Diabrotica virgifera
  misc_feature: Coding regions on vcDNA: vcDNA=SeqID_12889; Strand=+; Position=16-985
  misc_feature: Homolog annotation: Hit_ID=AAT38512.1; Match level="QueryCoverage =99%, HitCoverage=63%, E-value=1e-68, Identity=44%"; Hit description =pheromone-degrading enzyme [Phyllopertha diversa]
  misc_feature: Gene Ontology Annotation: Molecular function=monooxygenase activity; Biological process=leukotriene metabolism
  misc_feature: Pfam annotation: Pfam_ID=p450; Match level="Score=-97.7, E-value=8.7e- 07, Copies=1"; Pfam description=Cytochrome P450
  misc_feature (191)..(191): Xaa can be any naturally occurring amino acid
  misc_feature (261)..(261): Xaa can be any naturally occurring amino acid
  misc_feature (277)..(277): Xaa can be any naturally occurring amino acid
  misc_feature (301)..(301): Xaa can be any naturally occurring amino acid
  misc_feature (306)..(306): Xaa can be any naturally occurring amino acid
MFVLLFCAAIVSGILWLIYSHRNFVNRRKKYLQNVPGPKPNPIFGNMLEFAGPSYKILDTMKKFLTNHGPICHIYLGPLSDAVLVSDEKFIEFILSSSKIIDKASQYDYLHSWLGTGLLTSTGQKWKQRRRTITPAFHFSILDNFVDVFNDVGEIFVQKLEEHVGEENFNIYPMVSLCTLDIICQAAMGSXVNAQTDGNSEYVRNVKEMCRILTDRNFSPLDPSLYPFTINYYKELKAIKVLHDHTDSVVNRKIEELKKSXGENQNYVDDDGVKRKXAFWDLLLKSTINGKPLSKSDIPRXKVTHXMFEGHDTTSSAISFALL

SEQ ID NO: 33193 - protein, 86 aa, Diabrotica virgifera
  misc_feature: Coding regions on vcDNA: vcDNA=SeqID_12890; Strand=-; Position=190-450
QMLSLLSVLRRSKNFTSNVAIRMPPSVPINHYLGVPKTNKIEPRSYSIIPCTQYSGEVLACFKHSNLFKVNVPAHLDTQSRAPRRD

SEQ ID NO: 33194 - protein, 294 aa, Diabrotica virgifera
  misc_feature: Coding regions on vcDNA: vcDNA=SeqID_12891; Strand=-; Position=1-882
  misc_feature (8)..(18): Xaa can be any naturally occurring amino acid
  misc_feature (25)..(37): Xaa can be any naturally occurring amino acid
  misc_feature (39)..(293): Xaa can be any naturally occurring amino acid
KKSNRLYXXXXXXXXXXXSNIEVAXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQ

SEQ ID NO: 33195 - protein, 34 aa, Diabrotica virgifera
  misc_feature: Coding regions on vcDNA: vcDNA=SeqID_12892; Strand=-; Position=2-103
  misc_feature (12)..(20): Xaa can be any naturally occurring amino acid
  misc_feature (22)..(34): Xaa can be any naturally occurring amino acid
LYRVCSSFKIMXXXXXXXXXLXXXXXXXXXXXXX

SEQ ID NO: 33196 - protein, 109 aa, Diabrotica virgifera
  misc_feature: Coding regions on vcDNA: vcDNA=SeqID_12893; Strand=+; Position=183-512
  misc_feature (13)..(37): Xaa can be any naturally occurring amino acid
  misc_feature (39)..(61): Xaa can be any naturally occurring amino acid
  misc_feature (67)..(73): Xaa can be any naturally occurring amino acid
  misc_feature (76)..(94): Xaa can be any naturally occurring amino acid
  misc_feature (99)..(106): Xaa can be any naturally occurring amino acid
NYAVIPKVIYSYXXXXXXXXXXXXXXXXXXXXXXXXXPXXXXXXXXXXXXXXXXXXXXXXXYRVFSXXXXXXXFLXXXXXXXXXXXXXXXXXXXPSFQXXXXXXXXMLP

SEQ ID NO: 33197 - protein, 45 aa, Diabrotica virgifera
  misc_feature: Coding regions on vcDNA: vcDNA=SeqID_12894; Strand=-; Position=2-136
  misc_feature (10)..(10): Xaa can be any naturally occurring amino acid
  misc_feature (26)..(27): Xaa can be any naturally occurring amino acid
  misc_feature (33)..(33): Xaa can be any naturally occurring amino acid
  misc_feature (37)..(38): Xaa can be any naturally occurring amino acid
SLSPSSWSLXFSSPSFLLSLSFLSSXXFPLKAXSFSXXIIPGPCS

SEQ ID NO: 33198 - protein, 290 aa, Diabrotica virgifera
  misc_feature: Coding regions on vcDNA: vcDNA=SeqID_12895; Strand=+; Position=48-917
  misc_feature: Homolog annotation: Hit_ID=XP_310798.1; Match level="QueryCoverage =93%, HitCoverage=84%, E-value=8e-33, Identity=40%"; Hit description =ENSANGP00000014853 [Anopheles gambiae]
  misc_feature: Gene Ontology Annotation: Molecular function=RNA binding; Cellular component=extracellular space; Biological process=locomotory behavior
  misc_feature: Pfam annotation: Pfam_ID=SSXT; Match level="Score=108.2, E-value=2e -29, Copies=1"; Pfam description=SSXT protein (N-terminal region)
MSATFAPQRGPKPPPDSKSLQKLLDENGHLIQVIQEHQSKGKSQEAIQMQSQLHRNLVYLATIADSAQNVTALLPMIQSTGPAPPQQPNHNPPPNDQQHNMNNFNHQQQPAALNYRQQPGPPQRPGGPPAPHPYQQRGYPQGQYQNQYPPQGPNYPPQPPYGAPPNQPPGYPPNAPQGNYGQPPTTAAPHTNYPQQPGYGTPPPATGGASQPSPAPAPYQPPATPAQNQPAQYGAPPNGGHYPAGNPPQNYPPQGYPNPQGYAPPSTNQPNPPQPQNILLVILRHLFRRP

SEQ ID NO: 33199 - protein, 218 aa, Diabrotica virgifera
  misc_feature: Coding regions on vcDNA: vcDNA=SeqID_12896; Strand=-; Position=1-654
  misc_feature (5)..(12): Xaa can be any naturally occurring amino acid
  misc_feature (14)..(27): Xaa can be any naturally occurring amino acid
  misc_feature (34)..(46): Xaa can be any naturally occurring amino acid
  misc_feature (48)..(218): Xaa can be any naturally occurring amino acid
RFKLXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33200 - protein, 144 aa, Diabrotica virgifera
  misc_feature: Coding regions on vcDNA: vcDNA=SeqID_12897; Strand=+; Position=173-606
  misc_feature: Homolog annotation: Hit_ID=XP_314867.1; Match level="QueryCoverage =43%, HitCoverage=8%, E-value=1e-09, Identity=47%"; Hit description =ENSANGP00000005174 [Anopheles gambiae]
  misc_feature (127)..(127): Xaa can be any naturally occurring amino acid
ILLVLLLPFPCIRLLFSFQNPSLYFADCWCNRTTPVVITLFSISFFCILLTYTIISILVGLLCCRCIFVVVSLCARKVKSLIKATMCKVVCKVEVQGQQSQVFEMHVGLQQGDALACLLFNITLERXVRDARIDNRSQILVHIC

SEQ ID NO: 33201 - protein, 145 aa, Diabrotica virgifera
  misc_feature: Coding regions on vcDNA: vcDNA=SeqID_12898; Strand=+; Position=18-455
  misc_feature: Homolog annotation: Hit_ID=AAN05630.1; Match level="QueryCoverage =94%, HitCoverage=59%, E-value=9e-12, Identity=28%"; Hit description =diapause-associated transcript-2 [Leptinotarsa decemlineata]
  misc_feature (14)..(16): Xaa can be any naturally occurring amino acid
  misc_feature (20)..(20): Xaa can be any naturally occurring amino acid
  misc_feature (23)..(23): Xaa can be any naturally occurring amino acid
  misc_feature (28)..(28): Xaa can be any naturally occurring amino acid
  misc_feature (31)..(33): Xaa can be any naturally occurring amino acid
  misc_feature (67)..(67): Xaa can be any naturally occurring amino acid
  misc_feature (82)..(82): Xaa can be any naturally occurring amino acid
  misc_feature (109)..(109): Xaa can be any naturally occurring amino acid
FKGPGKEKAFKKEXXXEEKXREXGEERXKKXXXSRDVDMMKMDEERKGKCDELEEKVDEVCEKIEKXLMMLNLDEKICGELXKKKLVKCSKIDIDVIDFCLLEECKEIXVMLEKMFDDVVKKDWSFKVEEVLELMKGCVVEKDFV

SEQ ID NO: 33202 - protein, 18 aa, Diabrotica virgifera
  misc_feature: Coding regions on vcDNA: vcDNA=SeqID_12899; Strand=-; Position=1-54
  misc_feature (4)..(18): Xaa can be any naturally occurring amino acid
FINXXXXXXXXXXXXXXX

SEQ ID NO: 33203 - protein, 107 aa, Diabrotica virgifera
  misc_feature: Coding regions on vcDNA: vcDNA=SeqID_12900; Strand=+; Position=124-444
EFSMSHRFSYPSLMGPNLDAKPSELPNPPNSDVALSEYDDGYNNGGLDVCSNEFAEVANRELINRELVNLKNAVVNIDNSKYVIIVAVTQINVIGDGRIGRNKNDKP

SEQ ID NO: 33204 - protein, 47 aa, Diabrotica virgifera
  misc_feature: Coding regions on vcDNA: vcDNA=SeqID_12901; Strand=-; Position=0-140
  misc_feature (1)..(46): Xaa can be any naturally occurring amino acid
XXXXXXXXXXXXXXXXXXXXXXXXXXXXXXXXXXXXXXXXXXXXXXR

SEQ ID NO: 33205 - protein, 25 aa, Diabrotica virgifera
  misc_feature: Coding regions on vcDNA: vcDNA=SeqID_12902; Strand=-; Position=1-75
  misc_feature (6)..(6): Xaa can be any naturally occurring amino acid
  misc_feature (10)..(22): Xaa can be any naturally occurring amino acid
NLYINXFNTXXXXXXXXXXXXXFLV

SEQ ID NO: 33206 - protein, 69 aa, Diabrotica virgifera
  misc_feature: Coding regions on vcDNA: vcDNA=SeqID_12903; Strand=-; Position=250-459
IRVSRAMCQYNSDPFIANYAEIQLLSSTDHIIIMDNGRSLRGPIVGCLPGIDTWMRMMGNEIMYVSCHR

SEQ ID NO: 33207 - protein, 314 aa, Diabrotica virgifera
  misc_feature: Coding regions on vcDNA: vcDNA=SeqID_12904; Strand=+; Position=19-962
  misc_feature: Homolog annotation: Hit_ID=BAD86655.1; Match level="QueryCoverage =93%, HitCoverage=20%, E-value=2e-29, Identity=28%"; Hit description =reverse transcriptase [Bombyx mori]
  misc_feature: Pfam annotation: Pfam_ID=zf-CCHC; Match level="Score=13.8, E-value =0.0071, Copies=1"; Pfam description=Zinc knuckle
  misc_feature (120)..(126): Xaa can be any naturally occurring amino acid
  misc_feature (271)..(271): Xaa can be any naturally occurring amino acid
  misc_feature (289)..(289): Xaa can be any naturally occurring amino acid
  misc_feature (294)..(294): Xaa can be any naturally occurring amino acid
MHGRSNINVNSSVNQMSKCKICGNKHKNSCKYKDYICNICKKIGHLARVCLAHKNSVNFIDSEAEEDIYTLDSIESRIVDLCHVQVKVDNPFKIQVKIEGKIYEMIIDSGAGISAITKEXXXXXXXHFRLTSDDLLLKSYEGSVSSPEGYFIIDMGYKSKKIPVKLYVVQKGSANILGRDWIKAFNIRLEMMNQIVSNSKILDLINSFSNVFTSKLGNFNHKEISIKVVENAKPVFCKHRAVPLAYAKEVELELDRLEKEGVIELIDNSDXGTPLVFVQKSMGKYEYGXDYKTXINKHLKDVKYPLPKIDEIME

SEQ ID NO: 33208 - protein, 108 aa, Diabrotica virgifera; identical to SEQ ID NO: 27732
  misc_feature: Coding regions on vcDNA: vcDNA=SeqID_12905; Strand=+; Position=229-555
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33209 - protein, 70 aa, Diabrotica virgifera
  misc_feature: Coding regions on vcDNA: vcDNA=SeqID_12906; Strand=+; Position=1-210
  misc_feature (1)..(28): Xaa can be any naturally occurring amino acid
  misc_feature (30)..(53): Xaa can be any naturally occurring amino acid
  misc_feature (55)..(66): Xaa can be any naturally occurring amino acid
XXXXXXXXXXXXXXXXXXXXXXXXXXXXVXXXXXXXXXXXXXXXXXXXXXXXXPXXXXXXXXXXXXFNLI

SEQ ID NO: 33210 - protein, 81 aa, Diabrotica virgifera
  misc_feature: Coding regions on vcDNA: vcDNA=SeqID_12907; Strand=-; Position=1-243
  misc_feature (16)..(23): Xaa can be any naturally occurring amino acid
  misc_feature (37)..(81): Xaa can be any naturally occurring amino acid
YSHKLKCTQITLLTSXXXXXXXXYIDLSNYQYIVNQXXXXXXXXXXXXXXXXXXXXXXXXXXXXXXXXXXXXXXXXXXXXX

SEQ ID NO: 33211 - protein, 61 aa, Diabrotica virgifera
  misc_feature: Coding regions on vcDNA: vcDNA=SeqID_12908; Strand=-; Position=267-452
  misc_feature (27)..(33): Xaa can be any naturally occurring amino acid
LANFYILSTIIFLLTSRLNNIIMFVLXXXXXXXWWLLIDIVSEIFSLTGNVSNFHYFFMVM

SEQ ID NO: 33212 - protein, 65 aa, Diabrotica virgifera
  misc_feature: Coding regions on vcDNA: vcDNA=SeqID_12909; Strand=+; Position=552-746
  misc_feature (40)..(46): Xaa can be any naturally occurring amino acid
KVELVVYTRGECLKILSENIIPLHKLVFFYKRVKNAIMQXXXXXXXPFEPPFSNCAICTININVN

SEQ ID NO: 33213 - protein, 121 aa, Diabrotica virgifera
  misc_feature: Coding regions on vcDNA: vcDNA=SeqID_12910; Strand=+; Position=3-365
  misc_feature (1)..(20): Xaa can be any naturally occurring amino acid
  misc_feature (28)..(41): Xaa can be any naturally occurring amino acid
  misc_feature (43)..(88): Xaa can be any naturally occurring amino acid
  misc_feature (90)..(99): Xaa can be any naturally occurring amino acid
XXXXXXXXXXXXXXXXXXXXLPLFNHQXXXXXXXXXXXXXXEXXXXXXXXXXXXXXXXXXXXXXXXXXXXXXXXXXXXXXXXXXXXXXPXXXXXXXXXXLRETPGIFFWGGPTPKKKIGPP

SEQ ID NO: 33214 - protein, 97 aa, Diabrotica virgifera
  misc_feature: Coding regions on vcDNA: vcDNA=SeqID_12911; Strand=+; Position=356-649
IIHNSSAQRGKSSNKKDSLILLNKRVNELKMYKHSQFLCNTKMQQLHNTMVKSESAGRVYTGFGVCFPSSVVPYPLSDSSTDHTLGLSELQRKKCRG

SEQ ID NO: 33215 - protein, 139 aa, Diabrotica virgifera
  misc_feature: Coding regions on vcDNA: vcDNA=SeqID_12912; Strand=+; Position=3-422
  misc_feature (3)..(12): Xaa can be any naturally occurring amino acid
  misc_feature (17)..(30): Xaa can be any naturally occurring amino acid
ESXXXXXXXXXXKRLIXXXXXXXXXXXXXXLVDISISSQSVWNSVNYKEYLDLGMSNESSNDNAPLSSYALIFMIVCINSFFQKPIADYFTNFLTTEQLVTQTKSIITECFLNDINICTTTFVGPASNVIMGEELRTNI

SEQ ID NO: 33216 - protein, 22 aa, Diabrotica virgifera
  misc_feature: Coding regions on vcDNA: vcDNA=SeqID_12913; Strand=-; Position=0-65
  misc_feature (4)..(21): Xaa can be any naturally occurring amino acid
INNXXXXXXXXXXXXXXXXXXR

SEQ ID NO: 33217 - protein, 264 aa, Diabrotica virgifera
  misc_feature: Coding regions on vcDNA: vcDNA=SeqID_12914; Strand=-; Position=2-793
  misc_feature (14)..(34): Xaa can be any naturally occurring amino acid
  misc_feature (40)..(49): Xaa can be any naturally occurring amino acid
  misc_feature (59)..(66): Xaa can be any naturally occurring amino acid
  misc_feature (69)..(76): Xaa can be any naturally occurring amino acid
  misc_feature (88)..(100): Xaa can be any naturally occurring amino acid
  misc_feature (103)..(264): Xaa can be any naturally occurring amino acid
PQPKTPGSLLEGAXXXXXXXXXXXXXXXXXXXXXLVPLVXXXXXXXXXXNQPGSHRFKXXXXXXXXSTXXXXXXXXPIITLIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33218 - protein, 211 aa, Diabrotica virgifera
  misc_feature: Coding regions on vcDNA: vcDNA=SeqID_12915; Strand=-; Position=2-634
  misc_feature (2)..(4): Xaa can be any naturally occurring amino acid
  misc_feature (6)..(18): Xaa can be any naturally occurring amino acid
  misc_feature (21)..(31): Xaa can be any naturally occurring amino acid
  misc_feature (41)..(48): Xaa can be any naturally occurring amino acid
  misc_feature (51)..(64): Xaa can be any naturally occurring amino acid
  misc_feature (70)..(83): Xaa can be any naturally occurring amino acid
  misc_feature (85)..(211): Xaa can be any naturally occurring amino acid
VXXXGXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33219 - protein, 35 aa, Diabrotica virgifera
  misc_feature: Coding regions on vcDNA: vcDNA=SeqID_12916; Strand=-; Position=0-104
  misc_feature (3)..(3): Xaa can be any naturally occurring amino acid
  misc_feature (9)..(18): Xaa can be any naturally occurring amino acid
  misc_feature (22)..(33): Xaa can be any naturally occurring amino acid
NNXILKNLXXXXXXXXXXLSSXXXXXXXXXXXXNS

SEQ ID NO: 33220 - protein, 214 aa, Diabrotica virgifera
  misc_feature: Coding regions on vcDNA: vcDNA=SeqID_12917; Strand=+; Position=242-883
  misc_feature: Homolog annotation: Hit_ID=XP_397464.1; Match level="QueryCoverage =88%, HitCoverage=56%, E-value=9e-69, Identity=63%"; Hit description =similar to Sorting nexin 4 [Apis mellifera]
  misc_feature: Gene Ontology Annotation: Molecular function=lipid binding; Cellular component=membrane; Biological process=endocytosis
  misc_feature: Pfam annotation: Pfam_ID=PX; Match level="Score=108.5, E-value=1.7e -29, Copies=1"; Pfam description=PX domain
  misc_feature (179)..(179): Xaa can be any naturally occurring amino acid
  misc_feature (204)..(204): Xaa can be any naturally occurring amino acid
  misc_feature (212)..(213): Xaa can be any naturally occurring amino acid
MSDTEDKQENTEPKPSGTLLNHLEISVSESEKRVTGSLNLRDHYTVYLIEIKVTDPEFQKKVGKLTTVWRRYTEFEQLHDYLEVTYPYLVIPPLPEKRVLYGWQKISNDTFDPNFVDRRRAGLENFLLRIAAHPLLTWDKHFLEFLQHEEDWRESYKANGYLQLVENKLKSLSVSVRLXKPDPEFESMKEYGSTLASNLKHLLXARSRVAEXXY

SEQ ID NO: 33221 - protein, 301 aa, Diabrotica virgifera
  misc_feature: Coding regions on vcDNA: vcDNA=SeqID_12918; Strand=+; Position=1-903
  misc_feature: Homolog annotation: Hit_ID=XP_393865.1; Match level="QueryCoverage =99%, HitCoverage=79%, E-value=1e-139, Identity=75%"; Hit description= similar to ENSANGP00000021308 [Apis mellifera]
  misc_feature: Gene Ontology Annotation: Molecular function=methionyl aminopeptidase activity; Cellular component=cytosolic ribosome (sensu Eukarya); Biological process=proteolysis and peptidolysis
  misc_feature: Pfam annotation: Pfam_ID=Peptidase_M24; Match level="Score=156.3, E -value=6.7e-44, Copies=1"; Pfam description=metallopeptidase family M24
ASLGQCETPGCLNPAKLQCPTCIKLGIPGSIFCSQECFKSNWKTHKIIHSLAKGENVDGKKEDSYNPWPSYSYTGKLRPFPQSAKRTVPPQIQRPDYADHPQGYPLSEQAVKGSGLIKVLDDEEIEGVKVASRLGREVIDEAARVCDVGVTTDEIDRIVHEACIERDCYPSPLNYYEFPASCCTSVNEVICHGIPDSRPLVDGDLCNVDVTVYHRGFHGDLNETFFVGNVSEKHKNLVKVTHECLMKAIDIVKPGEKYREIGNIIQKHAQSHGYQVGRSYCGHGIHRLFHTAPNVPHYAKN

SEQ ID NO: 33222 - protein, 168 aa, Diabrotica virgifera
  misc_feature: Coding regions on vcDNA: vcDNA=SeqID_12919; Strand=+; Position=117-765
  misc_feature: Homolog annotation: Hit_ID=AAF87759.1; Match level="QueryCoverage =91%, HitCoverage=47%, E-value=9e-60, Identity=64%"; Hit description =cytochrome oxidase subunit I [Diabrotica virgifera virgifera]
  misc_feature: Pfam annotation: Pfam_ID=COX1; Match level="Score=-170.5, E-value =1.9e-05, Copies=1"; Pfam description=Cytochrome C and Quinol oxidase polyp
  misc_feature (26)..(26): Xaa can be any naturally occurring amino acid
  misc_feature (53)..(53): Xaa can be any naturally occurring amino acid
  misc_feature (107)..(107): Xaa can be any naturally occurring amino acid
  misc_feature (115)..(115): Xaa can be any naturally occurring amino acid
  misc_feature (143)..(143): Xaa can be any naturally occurring amino acid
MNSLPASSSNIAHGGPSVDLAIFRLXGAINFITTVINIRPIGITFDRIPLFVXAVVITAILLLLSLPVLAGAITILLTDRNLNTSFFDPAGIIYAIIAIGLLGFIVXAHHIFTVXGMDVDTRAYFTSATIIIAVPTGIKVFRXLATYHGTTITYSPVTSELQLEVYRG

SEQ ID NO: 33223 - protein, 65 aa, Diabrotica virgifera
  misc_feature: Coding regions on vcDNA: vcDNA=SeqID_12920; Strand=-; Position=3-200
  misc_feature (23)..(31): Xaa can be any naturally occurring amino acid
  misc_feature (34)..(65): Xaa can be any naturally occurring amino acid
VCSTFKILHDLSLNRCEPGWFLXXXXXXXXXRKXXXXXXXXXXXXXXXXXXXXXXXXXXXXXXXX

SEQ ID NO: 33224 - protein, 128 aa, Diabrotica virgifera
  misc_feature: Coding regions on vcDNA: vcDNA=SeqID_12921; Strand=+; Position=182-568
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(104): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXLCYLSTVKIPRPFKLISGQARLYI

SEQ ID NO: 33225 - protein, 208 aa, Diabrotica virgifera
  misc_feature: Coding regions on vcDNA: vcDNA=SeqID_12922; Strand=+; Position=25-651
  misc_feature: Homolog annotation: Hit_ID=XP_535162.1; Match level="QueryCoverage =82%, HitCoverage=87%, E-value=1e-13, Identity=27%"; Hit description =PREDICTED: similar to COMM domain containing 3 [Canis familiaris]
  misc_feature: Pfam annotation: Pfam_ID=HCaRG; Match level="Score=53.4, E-value=6.6e- 13, Copies=1"; Pfam description=HCaRG protein
RVVGGYKNFQDKRASIALAKNSTVINDEIFKKQLENCFQFLTERKEIHATNNLYNSKPDIIKEFYASLLTVTTDFIRQNVNREDITFFLHDECGLSSERTNLYISMLEEKKCQLQIALLNIGSALPHVTDIKWKIDYIVKSSEVESAEGPLFRICLIGEQFDMEKDSKVLKPIHFTCNSVELLDLIYKFKDALRHCNSVTEGFLMFTM

SEQ ID NO: 33226 - protein, 197 aa, Diabrotica virgifera
  misc_feature: Coding regions on vcDNA: vcDNA=SeqID_12923; Strand=+; Position=3-596
  misc_feature (56)..(61): Xaa can be any naturally occurring amino acid
  misc_feature (83)..(88): Xaa can be any naturally occurring amino acid
LRVRVFKLIIFVALVAYVHAGIYGESLGSLPIESPVISAYSSPLSVRSVLSSQLLXXXXXXTSPLYSRSLPTFSYGASVPVIXXXXXXTVSPLPVASLPSLVSAPVLTRGYAPSASLISAPVLRSVPSLPLLPAPVLSRSLSVSPLLPTVISRRVSVTPLLPAPVISRSVSVSPLVSAPVLSSYAASAPLLSAPVSW

SEQ ID NO: 33227 - protein, 50 aa, Diabrotica virgifera
  misc_feature: Coding regions on vcDNA: vcDNA=SeqID_12924; Strand=-; Position=1-150
  misc_feature (4)..(18): Xaa can be any naturally occurring amino acid
  misc_feature (20)..(47): Xaa can be any naturally occurring amino acid
INNXXXXXXXXXXXXXXXGXXXXXXXXXXXXXXXXXXXXXXXXXXXXQPF

SEQ ID NO: 33228 - protein, 66 aa, Diabrotica virgifera; identical to SEQ ID NO: 28562
  misc_feature: Coding regions on vcDNA: vcDNA=SeqID_12925; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33229 - protein, 210 aa, Diabrotica virgifera
  misc_feature: Coding regions on vcDNA: vcDNA=SeqID_12926; Strand=+; Position=132-763
  misc_feature: Homolog annotation: Hit_ID=CAE47500.1; Match level="QueryCoverage =86%, HitCoverage=55%, E-value=3e-40, Identity=44%"; Hit description =cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=-69.6, E -value=3.3e-06, Copies=1"; Pfam description=Papain family cysteine protease
  misc_feature (194)..(194): Xaa can be any naturally occurring amino acid
  misc_feature (198)..(198): Xaa can be any naturally occurring amino acid
MKTVLIAAVICCWFYNKALCGVQDDWNNFKTKYNKTYKNEVEENEKFTVFKDNLEEIRRHNSRYEDGLETYKKGITVFADLSKRQFDKKYQLSRPGVTSIIYPKTWKTRQVDRNLTTVYVDWRKVGAVTPVKNQGICGACWIFSAVGILESYHFRKTGKLISLSEQNVVDCISKYSCSGGIPQDALTYIQKNGXRLRXVEYPYEDKHMGL

SEQ ID NO: 33230 - protein, 66 aa, Diabrotica virgifera
  misc_feature: Coding regions on vcDNA: vcDNA=SeqID_12927; Strand=-; Position=1-198
  misc_feature (5)..(13): Xaa can be any naturally occurring amino acid
  misc_feature (24)..(31): Xaa can be any naturally occurring amino acid
  misc_feature (52)..(64): Xaa can be any naturally occurring amino acid
GPFVXXXXXXXXXETNLASHRLNXXXXXXXXRTDLIIYCYPIITLIQHRGRXXXXXXXXXXXXXLL

SEQ ID NO: 33231 - protein, 19 aa, Diabrotica virgifera
  misc_feature: Coding regions on vcDNA: vcDNA=SeqID_12928; Strand=-; Position=2-58
  misc_feature (6)..(19): Xaa can be any naturally occurring amino acid
LNYTIXXXXXXXXXXXXXX

SEQ ID NO: 33232 - protein, 288 aa, Diabrotica virgifera
  misc_feature: Coding regions on vcDNA: vcDNA=SeqID_12929; Strand=+; Position=3-866
  misc_feature: Homolog annotation: Hit_ID=XP_393106.1; Match level="QueryCoverage =97%, HitCoverage=38%, E-value=4e-56, Identity=38%"; Hit description =similar to ENSANGP00000015126 [Apis mellifera]
DIYILRTLTKHMSPPDVAEKTITKEASENINDSSIFASLEELIYYEEKNVIDLLTVTLQAAPEMLGHDGVRKSKNSGVKKISPKAREKVLEYYEQILWGEVGNFLEHVVLWWSASPLSARPPHSSQHLREWIVQFIPTADVSPVVLSALASLADALGVHVASTSWDQNFRLALVSSKAIYNPETGKLYANVLQDLVVLCNQCETTPDWFVGAPLDELPLVEQIPVLHRLDHSIHTTRLWSINECKKLVNAWNVSAFFTVIHDNIVDCLSQLHNLRLADHAGEIEKKNL

SEQ ID NO: 33233 - protein, 206 aa, Diabrotica virgifera
  misc_feature: Coding regions on vcDNA: vcDNA=SeqID_12930; Strand=+; Position=223-842
  misc_feature: Homolog annotation: Hit_ID=XP_308646.1; Match level="QueryCoverage =88%, HitCoverage=40%, E-value=2e-62, Identity=59%"; Hit description =ENSANGP00000011247 [Anopheles gambiae]
  misc_feature: Pfam annotation: Pfam_ID=Acyltransferase; Match level="Score=-6.6, E -value=0.052, Copies=1"; Pfam description=Acyltransferase
  misc_feature (167)..(167): Xaa can be any naturally occurring amino acid
  misc_feature (185)..(185): Xaa can be any naturally occurring amino acid
MDLTKLNILKRSRIIHLCMAITFFTSGVIVNFMQCILYLSLRPFNKWLYRKINWYLSYTIYSQLVCLGDWWSQTEIIIYVDKTVFDKYFGKEHAYLVMNHTYEIDWLIGWMICERIHVLRNCKAYAKKVIQYIPVLGWAWKCSEFVFLERNFDQDRKVIYKPITEFXPKHPDPIWLLLFPKGLAXCEFAAKIFTTIKNLCSPKKGS

SEQ ID NO: 33234 - protein, 64 aa, Diabrotica virgifera
  misc_feature: Coding regions on vcDNA: vcDNA=SeqID_12931; Strand=-; Position=222-416
TLSPTKILASTTHPCKCLILYNVNIFNLYYIGNTANVSSFLHNIRNNAKRYSSPYKKIPLYMYI

SEQ ID NO: 33235 - protein, 86 aa, Diabrotica virgifera
  misc_feature: Coding regions on vcDNA: vcDNA=SeqID_12932; Strand=+; Position=315-575
TEVRRKSNLIKKNLPRRVTKKVFVKKIAVKKKNNKRNSGMILKTTTLMSIVCIIMNCTVYLNQNKYGFRVRYAIHGAMHNVRCGKK

SEQ ID NO: 33236 - protein, 277 aa, Diabrotica virgifera
  misc_feature: Coding regions on vcDNA: vcDNA=SeqID_12933; Strand=+; Position=149-978
  misc_feature: Homolog annotation: Hit_ID=XP_313795.1; Match level="QueryCoverage =89%, HitCoverage=74%, E-value=1e-53, Identity=44%"; Hit description =ENSANGP00000011733 [Anopheles gambiae] gb|EAA09115.1| ENSANGP00000011733 [Anopheles gambiae
  misc_feature: Gene Ontology Annotation: Molecular function=sulfotransferase activity; Cellular component=cytosol; Biological process=biological _process unknown
  misc_feature: Pfam annotation: Pfam_ID=Sulfotransfer_1; Match level="Score=173.5, E- value=4.6e-49, Copies=1"; Pfam description=Sulfotransferase domain
  misc_feature (227)..(227): Xaa can be any naturally occurring amino acid
  misc_feature (269)..(269): Xaa can be any naturally occurring amino acid
MPMVKRDYSNEELEKWLDRDFTSVFRSGYVNVKGVTMPRRFEELQSDIFNWNVSERDVWICSFPKTGTTWTQEMVWMIMNNLDIIKGQENLGIRSPFLEVTALFDYRKFQKENTDFQPPPFIEDSLKFVREKSQKGPLCLKTHLPWVLIPQEIQNNTKQPKIIYVTRNPKDTCISYYNHSRLMEGYRGSFEEFCQLFLAGKLTFAPYWNHVLPFWEKRNQPNILFLXYEKMIQDLPSIIKEVADFLETPLTPEQITTLSDHLSFESMRXNPAVNYQM

SEQ ID NO: 33237 - protein, 69 aa, Diabrotica virgifera
  misc_feature: Coding regions on vcDNA: vcDNA=SeqID_12934; Strand=+; Position=3-209
  misc_feature (1)..(57): Xaa can be any naturally occurring amino acid
XXXXXXXXXXXXXXXXXXXXXXXXXXXXXXXXXXXXXXXXXXXXXXXXXXXXXXXXXKKSCLHLINKEF

SEQ ID NO: 33238 - protein, 144 aa, Diabrotica virgifera
  misc_feature: Coding regions on vcDNA: vcDNA=SeqID_12935; Strand=+; Position=167-596
  misc_feature: Homolog annotation: Hit_ID=AAH72308.1; Match level="QueryCoverage =97%, HitCoverage=45%, E-value=8e-45, Identity=63%"; Hit description =MGC82600 protein [Xenopus laevis]
  misc_feature: Gene Ontology Annotation: Molecular function=dicarboxylic acid transporter activity; Cellular component=mitochondrion; Biological process=gametogenesis
  misc_feature: Pfam annotation: Pfam_ID=Mito_carr; Match level="Score=85.7, E-value =1.2e-22, Copies=1"; Pfam description=Mitochondrial carrier protein
  misc_feature (134)..(134): Xaa can be any naturally occurring amino acid
MSEQKTIPNVLKFVFGASAGMGATCFVQPLDLVKNRMQLSGVGGKPKEYRSTLHAIQVIVQKEGVFSLYNDLSAGLLRQLTYTGTRLGVYTYLLDNFKSADGTPPGFVGKMLMGMVAGGCGAFGGTPAEVSLIXRMTADGRLPL

SEQ ID NO: 33239 - protein, 71 aa, Diabrotica virgifera
  misc_feature: Coding regions on vcDNA: vcDNA=SeqID_12936; Strand=-; Position=3-215
  misc_feature (23)..(31): Xaa can be any naturally occurring amino acid
  misc_feature (34)..(69): Xaa can be any naturally occurring amino acid
VCSTFKIFHDLSLNRGEPGWFLXXXXXXXXXRKXXXXXXXXXXXXXXXXXXXXXXXXXXXXXXXXXXXXLA

SEQ ID NO: 33240 - protein, 26 aa, Diabrotica virgifera
  misc_feature: Coding regions on vcDNA: vcDNA=SeqID_12937; Strand=-; Position=0-77
  misc_feature (1)..(25): Xaa can be any naturally occurring amino acid
XXXXXXXXXXXXXXXXXXXXXXXXXV

SEQ ID NO: 33241 - protein, 173 aa, Diabrotica virgifera
  misc_feature: Coding regions on vcDNA: vcDNA=SeqID_12938; Strand=+; Position=3-524
  misc_feature (4)..(151): Xaa can be any naturally occurring amino acid
SASXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLDVPLCVHLIIQFYYAAELLL

SEQ ID NO: 33242 - protein, 93 aa, Diabrotica virgifera; identical to SEQ ID NO: 27329
  misc_feature: Coding regions on vcDNA: vcDNA=SeqID_12939; Strand=+; Position=516-797
  misc_feature (25)..(55): Xaa can be any naturally occurring amino acid

SEQ ID NO: 33243 - protein, 24 aa, Diabrotica virgifera
  misc_feature: Coding regions on vcDNA: vcDNA=SeqID_12940; Strand=-; Position=1-72
  misc_feature (4)..(10): Xaa can be any naturally occurring amino acid
  misc_feature (14)..(24): Xaa can be any naturally occurring amino acid
VNNXXXXXXXLVFXXXXXXXXXXX

SEQ ID NO: 33244 - protein, 132 aa, Diabrotica virgifera
  misc_feature: Coding regions on vcDNA: vcDNA=SeqID_12941; Strand=-; Position=530-928
  misc_feature (122)..(130): Xaa can be any naturally occurring amino acid
FLFIILYRFSCFFAFSVICFHSFLFCIFSLQPVISILDISSRSGSSHLIFGVPLGLFSSGVQFGICLISASDSLCRMWPIHFILMCHNESQYIFILSLDLLFRDSSELVYILVNKIGSCNMXXXXXXXXXRN

SEQ ID NO: 33245 - protein, 66 aa, Diabrotica virgifera
  misc_feature: Coding regions on vcDNA: vcDNA=SeqID_12942; Strand=-; Position=0-197
  misc_feature (6)..(25): Xaa can be any naturally occurring amino acid
  misc_feature (28)..(55): Xaa can be any naturally occurring amino acid
  misc_feature (59)..(59): Xaa can be any naturally occurring amino acid
  misc_feature (61)..(61): Xaa can be any naturally occurring amino acid
KKNGDXXXXXXXXXXXXXXXXXXXXITXXXXXXXXXXXXXXXXXXXXXXXXXXXXSRLXKXFKLLT

SEQ ID NO: 33246 - protein, 262 aa, Diabrotica virgifera
  misc_feature: Coding regions on vcDNA: vcDNA=SeqID_12943; Strand=+; Position=43-831
  misc_feature: Homolog annotation: Hit_ID=XP_316497.1; Match level="QueryCoverage =94%, HitCoverage=95%, E-value=1e-109, Identity=74%"; Hit description= ENSANGP00000014099 [Anopheles gambiae]
  misc_feature: Gene Ontology Annotation: Molecular function=iron-sulfur electron transfer carrier; Cellular component=membrane fraction; Biological process=mitochondrial electron transport, NADH to ubiquinone
  misc_feature: Pfam annotation: Pfam_ID=Complex1_30kDa; Match level="Score=166.1, E -value=7.8e-47, Copies=1"; Pfam description=Respiratory-chain NADH dehydrogenase,
  misc_feature (234)..(234): Xaa can be any naturally occurring amino acid
MYLRPLLSQLARNKPLQTSLVQHASRTLSTEVDSKTETRPTVRKPNLVARSSLTDFGKYVAECLPKYVERVQITAGDELEVLIVPEGILPVLQFLKDHHNSQFSNLADIAGMDVPSRPYRFEIIYNILSLRFNSRIRVKTYTDELTPVESCNDIYKAANWYEREIWDMYGVFFSNHPDLRRILTDYGFEGHPFRKDFPLSGYVEVRYDDEKKRVVVEPLELAQEFRKFELSAPXEQFPNFRNANPARKKVIYLRIRNKIVFN

SEQ ID NO: 33247 - protein, 334 aa, Diabrotica virgifera
  misc_feature: Coding regions on vcDNA: vcDNA=SeqID_12944; Strand=-; Position=0-1001
  misc_feature (2)..(329): Xaa can be any naturally occurring amino acid
KXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLKWT

SEQ ID NO: 33248 - protein, 23 aa, Diabrotica virgifera
  misc_feature: Coding regions on vcDNA: vcDNA=SeqID_12945; Strand=-; Position=0-68
LIYYVRNSITLKIKYNSQELPNS

SEQ ID NO: 33249 - protein, 43 aa, Diabrotica virgifera
  misc_feature: Coding regions on vcDNA: vcDNA=SeqID_12946; Strand=+; Position=67-195
RLNLGEPAKFIKVGSNFKNFSRDRSFNPGGGPRVGSFYLFFFI

SEQ ID NO: 33250 - protein, 47 aa, Diabrotica virgifera; identical to SEQ ID NO: 26759
  misc_feature: Coding regions on vcDNA: vcDNA=SeqID_12947; Strand=+; Position=3-146
  misc_feature (1)..(15): Xaa can be any naturally occurring amino acid
  misc_feature (17)..(24): Xaa can be any naturally occurring amino acid

SEQ ID NO: 33251 - protein, 110 aa, Diabrotica virgifera
  misc_feature: Coding regions on vcDNA: vcDNA=SeqID_12948; Strand=+; Position=192-524
MQKIQWHCIAQRRIQNIGNAYKGYTKKRMEDIIDEHQVDFRQRRSTTEQIFLLIEILEEGESKNNKSKKKARTRKIFGGKNGERRWDQKDKLRSESYMGSPTYWAPEPNA

SEQ ID NO: 33252 - protein, 330 aa, Diabrotica virgifera
  misc_feature: Coding regions on vcDNA: vcDNA=SeqID_12949; Strand=-; Position=1-990
  misc_feature (3)..(282): Xaa can be any naturally occurring amino acid
  misc_feature (285)..(326): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTXXXXXXXXXXXXXXXXXXXXXXXXXXXXXXXXXXXXXXXXXXDLGG

SEQ ID NO: 33253 - protein, 257 aa, Diabrotica virgifera
  misc_feature: Coding regions on vcDNA: vcDNA=SeqID_12950; Strand=+; Position=135-906
  misc_feature: Homolog annotation: Hit_ID=EAL25137.1; Match level="QueryCoverage =92%, HitCoverage=44%, E-value=1e-86, Identity=67%"; Hit description =GA19679-PA [Drosophila pseudoobscura]
  misc_feature: Gene Ontology Annotation: Molecular function=molecular_function unknown
  misc_feature: Pfam annotation: Pfam_ID=UPF0004; Match level="Score=111.1, E-value =2.7e-30, Copies=1"; Pfam description=Uncharacterized protein family UPF000
  misc_feature (192)..(192): Xaa can be any naturally occurring amino acid
  misc_feature (205)..(206): Xaa can be any naturally occurring amino acid
  misc_feature (229)..(229): Xaa can be any naturally occurring amino acid
  misc_feature (234)..(234): Xaa can be any naturally occurring amino acid
MELPTDSYYSSQACNEIINDIEDLISAQDITPKERYSSRKNVKVQAKRKNKIEVLPLIPVGENIPGTQNIYIGTWGCAHNSSDSEYMAGQLAAYGYKLTENKSEADLILLNSCTVKSPAEDHFRNEIESAKKQGKHLVLAGCVPQGAPKSSFIQGLSIIGVQQIDRVVEVVEETLKGNTVKLLGTKKENGKXRMGGASLLLPKVXXNPLIEIIAINTGCLNQCTYCKTXHARGXDLGSYPPEEIVARAKQFFEEGGS

SEQ ID NO: 33254 - protein, 182 aa, Diabrotica virgifera
  misc_feature: Coding regions on vcDNA: vcDNA=SeqID_12951; Strand=+; Position=2-550
  misc_feature (1)..(141): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFVIIIIDYLRDNSVILLQRSNPSLRLRPRCWMKDSSSLSI

SEQ ID NO: 33255 - protein, 38 aa, Diabrotica virgifera
  misc_feature: Coding regions on vcDNA: vcDNA=SeqID_12952; Strand=-; Position=3-116
  misc_feature (2)..(3): Xaa can be any naturally occurring amino acid
  misc_feature (8)..(26): Xaa can be any naturally occurring amino acid
  misc_feature (29)..(37): Xaa can be any naturally occurring amino acid
KXXKLFTXXXXXXXXXXXXXXXXXXXLHXXXXXXXXXD

SEQ ID NO: 33256 - protein, 30 aa, Diabrotica virgifera
  misc_feature: Coding regions on vcDNA: vcDNA=SeqID_12953; Strand=-; Position=1-90
  misc_feature (5)..(5): Xaa can be any naturally occurring amino acid
  misc_feature (8)..(8): Xaa can be any naturally occurring amino acid
  misc_feature (12)..(30): Xaa can be any naturally occurring amino acid
VSRLXKKXKLLXXXXXXXXXXXXXXXXXXX

SEQ ID NO: 33257 - protein, 75 aa, Diabrotica virgifera
  misc_feature: Coding regions on vcDNA: vcDNA=SeqID_12954; Strand=-; Position=1-225
  misc_feature (16)..(60): Xaa can be any naturally occurring amino acid
  misc_feature (63)..(75): Xaa can be any naturally occurring amino acid
KTTGGFIPFCVNFNSXXXXXXXXXXXXXXXXXXXXXXXXXXXXXXXXXXXXXXXXXXXXXKKXXXXXXXXXXXXX

SEQ ID NO: 33258 - protein, 47 aa, Diabrotica virgifera
  misc_feature: Coding regions on vcDNA: vcDNA=SeqID_12955; Strand=-; Position=319-462
ITIIYYLSLSRVSKIFSCYGKFRFLYIDFLFLIPGASDTHNYIPQKV

SEQ ID NO: 33259 - protein, 262 aa, Diabrotica virgifera
  misc_feature: Coding regions on vcDNA: vcDNA=SeqID_12956; Strand=+; Position=8-796
  misc_feature: Homolog annotation: Hit_ID=XP_317088.1; Match level="QueryCoverage =92%, HitCoverage=16%, E-value=1e-50, Identity=40%"; Hit description =ENSANGP00000019522 [Anopheles gambiae]
  misc_feature: Gene Ontology Annotation: Molecular function=endopeptidase inhibitor activity; Cellular component=cellular_component unknown; Biological process=intracellular protein transport
  misc_feature: Pfam annotation: Pfam_ID=A2M_comp; Match level="Score=70.2, E-value =5.8e-18, Copies=1"; Pfam description=A-macroglobulin complement component
  misc_feature (43)..(49): Xaa can be any naturally occurring amino acid
GPESVLIDARTLSNFKKSINFTIPKNAVEGSEKVEVSAVGTFXXXXXXXLDNVIRLPTDCGEQNLVHLMSNLVILQYLRVSNQLTPTIQNEAVKNLETSYQQQLTFKRKDGSFSPFEWRDSKGSVWVTAYTVLALSQAKNFIFIDERVIENSTNWLTDVQGKNGSFYETGNIIHTELQNNSGNSLALTAFVVMALRESSLRNDPTIENVINKGLDYLARNIDESESIYTIALCSYVLQITGHTSRQSAFHLIGLQSTNQRKT

SEQ ID NO: 33260 - protein, 69 aa, Diabrotica virgifera
  misc_feature: Coding regions on vcDNA: vcDNA=SeqID_12957; Strand=-; Position=1-207
  misc_feature (4)..(15): Xaa can be any naturally occurring amino acid
  misc_feature (27)..(33): Xaa can be any naturally occurring amino acid
  misc_feature (36)..(42): Xaa can be any naturally occurring amino acid
  misc_feature (60)..(67): Xaa can be any naturally occurring amino acid
VPFXXXXXXXXXXXXKPTRLPTGLNSXXXXXXXSNXXXXXXXSTIINFIQHRGRNLYNRXXXXXXXXLL

SEQ ID NO: 33261 - protein, 22 aa, Diabrotica virgifera
  misc_feature: Coding regions on vcDNA: vcDNA=SeqID_12958; Strand=-; Position=1-66
  misc_feature (2)..(22): Xaa can be any naturally occurring amino acid
KXXXXXXXXXXXXXXXXXXXXX

SEQ ID NO: 33262 - protein, 353 aa, Diabrotica virgifera
  misc_feature: Coding regions on vcDNA: vcDNA=SeqID_12959; Strand=-; Position=1-1059
  misc_feature (5)..(352): Xaa can be any naturally occurring amino acid
SPLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 33263 - protein, 108 aa, Diabrotica virgifera; identical to SEQ ID NO: 27732
  misc_feature: Coding regions on vcDNA: vcDNA=SeqID_12960; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33264 - protein, 83 aa, Diabrotica virgifera
  misc_feature: Coding regions on vcDNA: vcDNA=SeqID_12961; Strand=+; Position=2-253
  misc_feature (29)..(39): Xaa can be any naturally occurring amino acid
FPGSGLVEEVKRHFLYSVDPKDDRFKEMXXXXXXXXXXXLKEERRKQKEAKLMDKLIKKRDPGNEKESEDKEESNKNKNLKEE

SEQ ID NO: 33265 - protein, 87 aa, Diabrotica virgifera
  misc_feature: Coding regions on vcDNA: vcDNA=SeqID_12962; Strand=-; Position=454-717
GFSSSFESTIVDRADLTFLMSTKRNCLLIMSIFLLVKKKIYNCLWDVLRNIGFFLLDKLSDDCWNRSLNFCVWFRKIGVWGDRERVT

SEQ ID NO: 33266 - protein, 42 aa, Diabrotica virgifera
  misc_feature: Coding regions on vcDNA: vcDNA=SeqID_12963; Strand=-; Position=2-127
  misc_feature (2)..(20): Xaa can be any naturally occurring amino acid
  misc_feature (22)..(39): Xaa can be any naturally occurring amino acid
IXXXXXXXXXXXXXXXXXXXAXXXXXXXXXXXXXXXXXXVNN

SEQ ID NO: 33267 - protein, 73 aa, Diabrotica virgifera
  misc_feature: Coding regions on vcDNA: vcDNA=SeqID_12964; Strand=-; Position=205-426
FAAIHHHLQHLFFAILFPSLLYGAFHITTTIPYSSIINSTSLSLTTTTSFSLANSRQKNSLLFFPPIHLQNKL

SEQ ID NO: 33268 - protein, 158 aa, Diabrotica virgifera
  misc_feature: Coding regions on vcDNA: vcDNA=SeqID_12965; Strand=-; Position=1-474
  misc_feature (4)..(67): Xaa can be any naturally occurring amino acid
  misc_feature (69)..(151): Xaa can be any naturally occurring amino acid
ERGXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXKDCFVLL

SEQ ID NO: 33269 - protein, 241 aa, Diabrotica virgifera
  misc_feature: Coding regions on vcDNA: vcDNA=SeqID_12966; Strand=+; Position=27-753
  misc_feature: Homolog annotation: Hit_ID=XP_395956.1; Match level="QueryCoverage =100%, HitCoverage=100%, E-value=1e-64, Identity=49%"; Hit description=similar to cytoskeleton-associated protein 1 [Apis mellifera]
  misc_feature: Gene Ontology Annotation: Molecular function=microtubule binding; Cellular component=intermediate filament; Biological process =nonselective vesicle transport
  misc_feature: Pfam annotation: Pfam_ID=CAP_GLY; Match level="Score=121.3, E-value =2.3e-33, Copies=1"; Pfam description=CAP-Gly domain
  misc_feature (62)..(72): Xaa can be any naturally occurring amino acid
  misc_feature (144)..(152): Xaa can be any naturally occurring amino acid
  misc_feature (227)..(227): Xaa can be any naturally occurring amino acid
MADFKVVTSDFVNLQISTSKDDLSFNEKRFPKDITISDLKVKLELITGGSCNTMQLQAFNKXXXXXXXXXXXTALLGSYPLEDGMRLHVIDNFLMRNELDFGNVPKFELSQDEYDKKGDTVRSFLMKNKMGKYNQENIQKKEQXXXXXXXXXESIKIGSRCKVSVQNASDKLGTVMYTGQVEGLSGYWIGVKYDEPLGKNDGSLKGKRYFQCPEKYGAFVKPHSITXGDFPEEDYDLNEEI

SEQ ID NO: 33270 - protein, 165 aa, Diabrotica virgifera
  misc_feature: Coding regions on vcDNA: vcDNA=SeqID_12967; Strand=+; Position=1-495
  misc_feature (1)..(142): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYYFYFSENFNSNIKLDYSERVM

SEQ ID NO: 33271 - protein, 227 aa, Diabrotica virgifera
  misc_feature: Coding regions on vcDNA: vcDNA=SeqID_12968; Strand=+; Position=116-799
  misc_feature: Homolog annotation: Hit_ID=XP_541574.1; Match level="QueryCoverage =98%, HitCoverage=77%, E-value=4e-57, Identity=41%"; Hit description =PREDICTED: similar to ZNF228 protein [Canis familiaris]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=134.8, E-value =2.1e-37, Copies=6"; Pfam description=Zinc finger, C2H2 type
EYILGEKAYECEVCCKQFSLKQFLNNHLRIHTGEKPYFAQAGNLTDHLRGHTGEKFKQFRQRGNLKVHLRVHTKETKLFSHESYLKIHSRLHTGQKFSQTTNLKSHMMTHTGEKPHKCEVCFKEFTQANNLITHLRVHTRELPYKCEVCFKNFSNQSYLKVHMRVHSGEKPHTCDICSKQFSQTAHLKAHLRTHTGQKPHNCDICFKQFAQRGQLKTHSRYKCEICF

SEQ ID NO: 33272 - protein, 22 aa, Diabrotica virgifera
  misc_feature: Coding regions on vcDNA: vcDNA=SeqID_12969; Strand=-; Position=1-66
  misc_feature (14)..(14): Xaa can be any naturally occurring amino acid
IPTSRFPIFIIDLXSPNKFTLL

SEQ ID NO: 33273 - protein, 54 aa, Diabrotica virgifera
  misc_feature: Coding regions on vcDNA: vcDNA=SeqID_12970; Strand=-; Position=255-419
PLHKEFSSYIILLHKHTPNQTPTNPHHTKTSPVPYHLTLSGTTSTTIACHPSPR

SEQ ID NO: 33274 - protein, 80 aa, Diabrotica virgifera
  misc_feature: Coding regions on vcDNA: vcDNA=SeqID_12971; Strand=-; Position=320-562
  misc_feature (10)..(16): Xaa can be any naturally occurring amino acid
VIESMCITIXXXXXXXDLLINSIIVQTNHPPTYYSCYPLFLSVNTLTLLGHTIRVHSKYTDLWLVMISHSKIRNINNHFR

SEQ ID NO: 33275 - protein, 115 aa, Diabrotica virgifera
  misc_feature: Coding regions on vcDNA: vcDNA=SeqID_12972; Strand=-; Position=190-537
PFSYRCNMKPKPSYISVRLERATSTLTEQLENSLVFHQRMYIAVTYVHALGSSSSVLLWAYSAANKIAAIWLQTSLLPAIHIQCAFAMPLELAITQASSGLALAFWEFFTFPTII

SEQ ID NO: 33276 - protein, 89 aa, Diabrotica virgifera
  misc_feature: Coding regions on vcDNA: vcDNA=SeqID_12973; Strand=-; Position=187-456
LLRHVMISHTKNYNNNITFQMHLHGQYYMPARALEVHPVTSLRSTHLAHNNIKCNVGVYRKLIYVIRGITIPAHSHTYQYLAVSKTHSC

SEQ ID NO: 33277 - protein, 37 aa, Diabrotica virgifera
  misc_feature: Coding regions on vcDNA: vcDNA=SeqID_12974; Strand=-; Position=1-111
  misc_feature (1)..(14): Xaa can be any naturally occurring amino acid
  misc_feature (16)..(37): Xaa can be any naturally occurring amino acid
XXXXXXXXXXXXXXSXXXXXXXXXXXXXXXXXXXXXX

SEQ ID NO: 33278 - protein, 22 aa, Diabrotica virgifera
  misc_feature: Coding regions on vcDNA: vcDNA=SeqID_12975; Strand=+; Position=33-98
VARWRVAISCYGLSEAKTDCFE

SEQ ID NO: 33279 - protein, 310 aa, Diabrotica virgifera
  misc_feature: Coding regions on vcDNA: vcDNA=SeqID_12976; Strand=-; Position=0-929
  misc_feature (1)..(308): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXET

SEQ ID NO: 33280 - protein, 68 aa, Diabrotica virgifera
  misc_feature: Coding regions on vcDNA: vcDNA=SeqID_12977; Strand=+; Position=405-611
YNIYGLPSKADQPKKKMNLVIFFSDYFVMILTSNRIVRYLITCLILSNQIKIILRIIYCRKLPIEFFK

SEQ ID NO: 33281 - protein, 131 aa, Diabrotica virgifera
  misc_feature: Coding regions on vcDNA: vcDNA=SeqID_12978; Strand=+; Position=213-608
  misc_feature (6)..(12): Xaa can be any naturally occurring amino acid
  misc_feature (62)..(68): Xaa can be any naturally occurring amino acid
HILQVXXXXXXXFTKNLNYVWYYGLSSMAGSAGLDIIRVINIYYFVRNTNSIFSIADKCMGXXXXXXXLHKGTVACYKIVRSSLVRIHSESTTYLFARWNYGFVKFEKKRKEQECNNPFLDANKTSIQPMD

SEQ ID NO: 33282 - protein, 77 aa, Diabrotica virgifera
  misc_feature: Coding regions on vcDNA: vcDNA=SeqID_12979; Strand=-; Position=0-230
  misc_feature (4)..(76): Xaa can be any naturally occurring amino acid
QKKXXXXXXXXXXXXXXXXXXXXXXXXXXXXXXXXXXXXXXXXXXXXXXXXXXXXXXXXXXXXXXXXXXXXXXXXXP

SEQ ID NO: 33283 - protein, 35 aa, Diabrotica virgifera
  misc_feature: Coding regions on vcDNA: vcDNA=SeqID_12980; Strand=-; Position=0-104
  misc_feature (2)..(34): Xaa can be any naturally occurring amino acid
FXXXXXXXXXXXXXXXXXXXXXXXXXXXXXXXXXP

SEQ ID NO: 33284 - protein, 59 aa, Diabrotica virgifera
  misc_feature: Coding regions on vcDNA: vcDNA=SeqID_12981; Strand=-; Position=311-489
  misc_feature (22)..(22): Xaa can be any naturally occurring amino acid
TYIRHVVTYGMETTMINKKDSXLKFERKIMRMILGHNVTREGERRMKTNAEIKEELKEE

SEQ ID NO: 33285 - protein, 66 aa, Diabrotica virgifera; identical to SEQ ID NO: 26808
  misc_feature: Coding regions on vcDNA: vcDNA=SeqID_12982; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33286 - protein, 82 aa, Diabrotica virgifera
  misc_feature: Coding regions on vcDNA: vcDNA=SeqID_12983; Strand=-; Position=1-246
  misc_feature (1)..(13): Xaa can be any naturally occurring amino acid
  misc_feature (15)..(82): Xaa can be any naturally occurring amino acid
XXXXXXXXXXXXXTXXXXXXXXXXXXXXXXXXXXXXXXXXXXXXXXXXXXXXXXXXXXXXXXXXXXXXXXXXXXXXXXXXXX

SEQ ID NO: 33287 - protein, 74 aa, Diabrotica virgifera
  misc_feature: Coding regions on vcDNA: vcDNA=SeqID_12984; Strand=+; Position=2-223
  misc_feature (1)..(19): Xaa can be any naturally occurring amino acid
  misc_feature (24)..(46): Xaa can be any naturally occurring amino acid
  misc_feature (53)..(71): Xaa can be any naturally occurring amino acid
XXXXXXXXXXXXXXXXXXXHFFTXXXXXXXXXXXXXXXXXXXXXXXTNYLLAXXXXXXXXXXXXXXXXXXXNFF

SEQ ID NO: 33288 - protein, 37 aa, Diabrotica virgifera
  misc_feature: Coding regions on vcDNA: vcDNA=SeqID_12985; Strand=+; Position=4-114
  misc_feature (9)..(9): Xaa can be any naturally occurring amino acid
  misc_feature (26)..(33): Xaa can be any naturally occurring amino acid
QRNFIGEFXSIIKIATSMLDLSYNGXXXXXXXXVDFK

SEQ ID NO: 33289 - protein, 224 aa, Diabrotica virgifera
  misc_feature: Coding regions on vcDNA: vcDNA=SeqID_12986; Strand=+; Position=239-967
  misc_feature: Homolog annotation: Hit_ID=XP_321112.1; Match level="QueryCoverage =90%, HitCoverage=52%, E-value=3e-68, Identity=63%"; Hit description =ENSANGP00000019082 [Anopheles gambiae]
  misc_feature: Gene Ontology Annotation: Molecular function=acyl-CoA dehydrogenase activity; Cellular component=mitochondrion; Biological process =energy pathways
  misc_feature: Pfam annotation: Pfam_ID=Acyl-CoA_dh_N; Match level="Score=113.1, E -value=7.1e-31, Copies=1"; Pfam description=Acyl-CoA dehydrogenase, N- terminal dom
  misc_feature (60)..(66): Xaa can be any naturally occurring amino acid
  misc_feature (133)..(133): Xaa can be any naturally occurring amino acid
  misc_feature (148)..(148): Xaa can be any naturally occurring amino acid
  misc_feature (153)..(153): Xaa can be any naturally occurring amino acid
  misc_feature (164)..(164): Xaa can be any naturally occurring amino acid
  misc_feature (192)..(192): Xaa can be any naturally occurring amino acid
  misc_feature (205)..(205): Xaa can be any naturally occurring amino acid
  misc_feature (210)..(210): Xaa can be any naturally occurring amino acid
MALLNKTLKHLVHYQMKRGIASLSALPETHQMLQKTCRDFAEGELKPIAAKIDREHLYPXXXXXXXGELGLMAVAVPEELNGTGLDYLAYAIGMEEISRGCASAGVIMSVNNSLYTGPIQQWGSCFALSEPGXGSDAGAASTTARIRXVINLXLNGTKSWITNXYESEAAVILATTDKGLNIRGISAIIVPXPTNGLELGKKEDXLGNKXFFTCNLYFDILSVQ

SEQ ID NO: 33290 - protein, 86 aa, Diabrotica virgifera
  misc_feature: Coding regions on vcDNA: vcDNA=SeqID_12987; Strand=-; Position=380-640
  misc_feature (64)..(70): Xaa can be any naturally occurring amino acid
DPDYRVKNNQTKSSTTIKIIPLRITVLFSSGCWLVCKSQTLFHYAKVTSQYLQVQQQYIRFIHXXXXXXXIEKFSFLLEQKYFRTQ

SEQ ID NO: 33291 - protein, 124 aa, Diabrotica virgifera
  misc_feature: Coding regions on vcDNA: vcDNA=SeqID_12988; Strand=+; Position=2-373
  misc_feature: Homolog annotation: Hit_ID=XP_318845.1; Match level="QueryCoverage =94%, HitCoverage=64%, E-value=4e-14, Identity=41%"; Hit description =ENSANGP00000014460 [Anopheles gambiae]
  misc_feature (30)..(41): Xaa can be any naturally occurring amino acid
VKVPVRVEVPVPVKVGVPQPYTVEVPKPVXXXXXXXXXXXXHVPVPSPVVVKEQVPVPSPVVVKEQVPVPSPVVVNEHVPVQQPIYVREQVNVPQPYLLKEHVPVESPVSFRQHNVHHQNYVSI

SEQ ID NO: 33292 - protein, 158 aa, Diabrotica virgifera
  misc_feature: Coding regions on vcDNA: vcDNA=SeqID_12989; Strand=+; Position=76-558
  misc_feature: Homolog annotation: Hit_ID=XP_522646.1; Match level="QueryCoverage =93%, HitCoverage=40%, E-value=9e-27, Identity=42%"; Hit description =PREDICTED: similar to eukaryotic translation initiation factor 4A, isoform 1 [Pan troglodytes]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=DEAD; Match level="Score=-32.9, E-value =0.012, Copies=1"; Pfam description=DEAD/DEAH box helicase
  misc_feature (29)..(29): Xaa can be any naturally occurring amino acid
  misc_feature (44)..(44): Xaa can be any naturally occurring amino acid
  misc_feature (66)..(66): Xaa can be any naturally occurring amino acid
  misc_feature (92)..(92): Xaa can be any naturally occurring amino acid
  misc_feature (99)..(99): Xaa can be any naturally occurring amino acid
  misc_feature (142)..(142): Xaa can be any naturally occurring amino acid
HRHCRECLALILAPTLVSAQQIQKVLLTXRFHVAQCHACIGGTXTRINNNTSKLKILVVVETPWNXYEMITWRVLRPSLIKMSDLDEADETXSRGFKDXYNDVLLMMNTDEQAIFLSVTMINDVINVIMSFMRSSDWMLEKXKNLHFECIVQFFVIFK

SEQ ID NO: 33293 - protein, 74 aa, Diabrotica virgifera
  misc_feature: Coding regions on vcDNA: vcDNA=SeqID_12990; Strand=-; Position=100-324
VLMTHLQLLRTCCFKTYLKVTTIINFFVSVLTTIKLIYYTFVYLYIEQLFIIDRSFQHPIRARITTNTILSVCA

SEQ ID NO: 33294 - protein, 112 aa, Diabrotica virgifera
  misc_feature: Coding regions on vcDNA: vcDNA=SeqID_12991; Strand=-; Position=3-338
  misc_feature (57)..(65): Xaa can be any naturally occurring amino acid
LCYDRTFIRPLVICSFETWIMTKINEAQLKISVNKGYPNYDTKYTILYTIILIVFVXXXXXXXXXHLRSAVKLKWLFEQQKLNTRSQTGVCTTTNIHRHCLYQPHFKYAEIQ

SEQ ID NO: 33295 - protein, 89 aa, Diabrotica virgifera
  misc_feature: Coding regions on vcDNA: vcDNA=SeqID_12992; Strand=+; Position=237-506
FSLVLWVFLTRTSYPASEIIYFPDIVNQKYIILLISFQIFCRLYSVELFLYTCSTYFCHFFGEVDLTTSSFYSFNNLVLYMSSQVVRQF

SEQ ID NO: 33296 - protein, 178 aa, Diabrotica virgifera
  misc_feature: Coding regions on vcDNA: vcDNA=SeqID_12993; Strand=-; Position=2-535
  misc_feature (30)..(38): Xaa can be any naturally occurring amino acid
  misc_feature (40)..(59): Xaa can be any naturally occurring amino acid
  misc_feature (61)..(82): Xaa can be any naturally occurring amino acid
  misc_feature (89)..(94): Xaa can be any naturally occurring amino acid
  misc_feature (97)..(112): Xaa can be any naturally occurring amino acid
  misc_feature (122)..(122): Xaa can be any naturally occurring amino acid
  misc_feature (136)..(178): Xaa can be any naturally occurring amino acid
KNPLTPKRGAPSLFFGLEFPQKNSAVSPGXXXXXXXXXWXXXXXXXXXXXXXXXXXXXXPXXXXXXXXXXXXXXXXXXXXXXPLWGFSXXXXXXLFXXXXXXXXXXXXXXXXSTLHCSFNKXIMIMLLSTSKYRAXXXXXXXXXXXXXXXXXXXXXXXXXXXXXXXXXXXXXXXXXXX

SEQ ID NO: 33297 - protein, 263 aa, Diabrotica virgifera
  misc_feature: Coding regions on vcDNA: vcDNA=SeqID_12994; Strand=+; Position=105-893
  misc_feature: Homolog annotation: Hit_ID=NP_572495.1; Match level="QueryCoverage =99%, HitCoverage=26%, E-value=1e-34, Identity=35%"; Hit description =CG12109-PB [Drosophila melanogaster] gb|AAF46399.1| CG12109-PB [Drosophila melanogaster]
  misc_feature (224)..(224): Xaa can be any naturally occurring amino acid
  misc_feature (242)..(242): Xaa can be any naturally occurring amino acid
GTEAKRKGNEKDGKGQRIGTKTKGKRRKGTKAKGKGGERRTKAERTLQEKAAAAFVNFFVAKKTDDAQDDKKSQEEKRPQTSNFLQFEVKSDMKLPLPRREFLSNEEKEKLVCYLDSQDSEASYLKDLSSGKLIGKSLKTWPYEESLDDEIILVDLGETICEDKSGLQRHKAKFLYFHDNRRPAYYGTWRKKSKFVKPRKPLAEDKNILNYEEDSDDDCEEEEXGESLNGSEDEAEKENDDXQDDYEVDNEFLVPHGHLSDDE

SEQ ID NO: 33298 - protein, 314 aa, Diabrotica virgifera
  misc_feature: Coding regions on vcDNA: vcDNA=SeqID_12995; Strand=-; Position=1-942
  misc_feature (2)..(310): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPGK

SEQ ID NO: 33299 - protein, 72 aa, Diabrotica virgifera
  misc_feature: Coding regions on vcDNA: vcDNA=SeqID_12996; Strand=-; Position=79-297
  misc_feature (6)..(32): Xaa can be any naturally occurring amino acid
PEMGFXXXXXXXXXXXXXXXXXXXXXXXXXXXNPFQSRLSINQLMMMLLNYGHNTLAIHITLVGSGAFKINP

SEQ ID NO: 33300 - protein, 80 aa, Diabrotica virgifera
  misc_feature: Coding regions on vcDNA: vcDNA=SeqID_12997; Strand=-; Position=1-240
  misc_feature (7)..(34): Xaa can be any naturally occurring amino acid
  misc_feature (37)..(51): Xaa can be any naturally occurring amino acid
  misc_feature (56)..(79): Xaa can be any naturally occurring amino acid
SKKIGFXXXXXXXXXXXXXXXXXXXXXXXXXXXXELXXXXXXXXXXXXXXXRLVKXXXXXXXXXXXXXXXXXXXXXXXXL

SEQ ID NO: 33301 - protein, 290 aa, Diabrotica virgifera
  misc_feature: Coding regions on vcDNA: vcDNA=SeqID_12998; Strand=-; Position=0-869
  misc_feature (3)..(13): Xaa can be any naturally occurring amino acid
  misc_feature (21)..(21): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(283): Xaa can be any naturally occurring amino acid
  misc_feature (286)..(286): Xaa can be any naturally occurring amino acid
PFXXXXXXXXXXXNQPGSHRXKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTXRRDR

SEQ ID NO: 33302 - protein, 132 aa, Diabrotica virgifera
  misc_feature: Coding regions on vcDNA: vcDNA=SeqID_12999; Strand=+; Position=40-438
  misc_feature (29)..(35): Xaa can be any naturally occurring amino acid
RPHRINNCPAFGKVCNFCKLPNHFATVCXXXXXXXKKVNEINTVTKSPKVTSSCNDLFVDNVLEVNAGENNFTNITSSCNDLFIGNVLEVNAGENNFTNIAWFADLNINKHKITFKIDSGAMANVLPMSRYF

SEQ ID NO: 33303 - protein, 52 aa, Diabrotica virgifera
  misc_feature: Coding regions on vcDNA: vcDNA=SeqID_13000; Strand=-; Position=2-157
  misc_feature (9)..(16): Xaa can be any naturally occurring amino acid
  misc_feature (19)..(26): Xaa can be any naturally occurring amino acid
  misc_feature (31)..(31): Xaa can be any naturally occurring amino acid
  misc_feature (38)..(51): Xaa can be any naturally occurring amino acid
PTWLTPVKXXXXXXXXSNXXXXXXXXPIINXNPTSRSXXXXXXXXXXXXXXV

SEQ ID NO: 33304 - protein, 252 aa, Diabrotica virgifera
  misc_feature: Coding regions on vcDNA: vcDNA=SeqID_13001; Strand=-; Position=0-755
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(246): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRGWG

SEQ ID NO: 33305 - protein, 97 aa, Diabrotica virgifera
  misc_feature: Coding regions on vcDNA: vcDNA=SeqID_13002; Strand=-; Position=413-706
  misc_feature (8)..(30): Xaa can be any naturally occurring amino acid
  misc_feature (44)..(50): Xaa can be any naturally occurring amino acid
HGENPTAXXXXXXXXXXXXXXXXXXXXXXXRKKNVAEFLYSANXXXXXXXVVNDNTIIITNFIIIAIYILVKNSLKIRIITYKNQQYLISSYGKFQP

SEQ ID NO: 33306 - protein, 184 aa, Diabrotica virgifera
  misc_feature: Coding regions on vcDNA: vcDNA=SeqID_13003; Strand=+; Position=55-606
  misc_feature: Homolog annotation: Hit_ID=XP_313959.1; Match level="QueryCoverage =95%, HitCoverage=73%, E-value=2e-45, Identity=53%"; Hit description =ENSANGP00000010041 [Anopheles gambiae]
  misc_feature: Gene Ontology Annotation: Molecular function=ribulose-phosphate 3 -epimerase activity; Cellular component=cytosol; Biological process =pentose-phosphate shunt
  misc_feature: Pfam annotation: Pfam_ID=Ribul_P_3_epim; Match level="Score=12.2, E -value=1.6e-12, Copies=1"; Pfam description=Ribulose-phosphate 3 epimerase family
  misc_feature (11)..(12): Xaa can be any naturally occurring amino acid
  misc_feature (15)..(16): Xaa can be any naturally occurring amino acid
  misc_feature (18)..(18): Xaa can be any naturally occurring amino acid
  misc_feature (20)..(20): Xaa can be any naturally occurring amino acid
  misc_feature (25)..(26): Xaa can be any naturally occurring amino acid
  misc_feature (31)..(31): Xaa can be any naturally occurring amino acid
  misc_feature (33)..(33): Xaa can be any naturally occurring amino acid
  misc_feature (37)..(37): Xaa can be any naturally occurring amino acid
  misc_feature (42)..(42): Xaa can be any naturally occurring amino acid
  misc_feature (47)..(47): Xaa can be any naturally occurring amino acid
  misc_feature (53)..(54): Xaa can be any naturally occurring amino acid
  misc_feature (66)..(66): Xaa can be any naturally occurring amino acid
  misc_feature (71)..(71): Xaa can be any naturally occurring amino acid
  misc_feature (77)..(77): Xaa can be any naturally occurring amino acid
  misc_feature (87)..(87): Xaa can be any naturally occurring amino acid
  misc_feature (95)..(95): Xaa can be any naturally occurring amino acid
  misc_feature (98)..(98): Xaa can be any naturally occurring amino acid
  misc_feature (132)..(133): Xaa can be any naturally occurring amino acid
  misc_feature (163)..(163): Xaa can be any naturally occurring amino acid
MENKLKWKIGXXILXXDXIXLYVEXXKLLDXGXEYLXLDVMXGKFVXNIIFGXXVVKCLRKKIRNXLFERXMMVENXEKWIEFMVEXNVNLYIFXIEXVINDVIKVCRKVKEEGMKVGLVLKVGKGIEDVRXXIEYVDMILVMNVENGFGGERVMSDMIEKVXWLRNNYLLLDIEVDGRVELII

SEQ ID NO: 33307 - protein, 57 aa, Diabrotica virgifera
  misc_feature: Coding regions on vcDNA: vcDNA=SeqID_13004; Strand=-; Position=1-171
  misc_feature (5)..(26): Xaa can be any naturally occurring amino acid
  misc_feature (30)..(57): Xaa can be any naturally occurring amino acid
SKKNXXXXXXXXXXXXXXXXXXXXXXPPMXXXXXXXXXXXXXXXXXXXXXXXXXXXX

SEQ ID NO: 33308 - protein, 210 aa, Diabrotica virgifera
  misc_feature: Coding regions on vcDNA: vcDNA=SeqID_13005; Strand=+; Position=1-635
  misc_feature: Homolog annotation: Hit_ID=CAC51711.1; Match level="QueryCoverage =97%, HitCoverage=64%, E-value=3e-51, Identity=53%"; Hit description =NADH dehydrogenase subunit 1 [Tribolium castaneum] ref|NP _203167.1|ND1_15766 NADH dehydrogenase subunit 1
  misc_feature: Pfam annotation: Pfam_ID=NADHdh; Match level="Score=29.2, E-value =1.1e-14, Copies=1"; Pfam description=NADH dehydrogenase
  misc_feature (20)..(20): Xaa can be any naturally occurring amino acid
  misc_feature (66)..(66): Xaa can be any naturally occurring amino acid
  misc_feature (69)..(78): Xaa can be any naturally occurring amino acid
  misc_feature (90)..(90): Xaa can be any naturally occurring amino acid
  misc_feature (110)..(110): Xaa can be any naturally occurring amino acid
  misc_feature (125)..(125): Xaa can be any naturally occurring amino acid
  misc_feature (154)..(154): Xaa can be any naturally occurring amino acid
  misc_feature (174)..(174): Xaa can be any naturally occurring amino acid
  misc_feature (182)..(182): Xaa can be any naturally occurring amino acid
  misc_feature (189)..(189): Xaa can be any naturally occurring amino acid
  misc_feature (197)..(197): Xaa can be any naturally occurring amino acid
LYASAIIISNLILPVCVLVXFAFLTLLERKVSGYIQIRHGPNKDGFLRIIQPFSDAIKLFTKELVXPLXXXXXXXXXXPILNSFLALLLXMCIPFVTINVTFNLSLLCCXSRSSLRDNTNILAWXSSTANYALLGRLRPIAQTISYEIRLTTIXLSFLLSIIALNILNSMIYEXNIFDVFIXLSMMTMXIGSGLAHXNRTPFDFAEGESD

SEQ ID NO: 33309 - protein, 304 aa, Diabrotica virgifera
  misc_feature: Coding regions on vcDNA: vcDNA=SeqID_13006; Strand=-; Position=4-918
  misc_feature (3)..(13): Xaa can be any naturally occurring amino acid
  misc_feature (15)..(15): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
  misc_feature (67)..(302): Xaa can be any naturally occurring amino acid
SFXXXXXXXXXXXNXPGSHRFKXXXXXXXXSNXXXXXXXXPIINXNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGR

SEQ ID NO: 33310 - protein, 306 aa, Diabrotica virgifera
  misc_feature: Coding regions on vcDNA: vcDNA=SeqID_13007; Strand=+; Position=2-922
  misc_feature: Homolog annotation: Hit_ID=EAA16908.1; Match level="QueryCoverage =90%, HitCoverage=19%, E-value=2e-18, Identity=27%"; Hit description =Drosophila melanogaster CG8797 gene product-related [Plasmodium yoelii yoelii]
  misc_feature (79)..(84): Xaa can be any naturally occurring amino acid
SPSVRTDLDQQQVEHLDFGQKVENVLHQVTGGKVHLKPLNQGQQVEDLSQQQQTDLDQQQIEHLDFGQKVENVLHQVTXXXXXXKPIDQSQQVEDLSQQQQVDFGQQIEEGGKIHQTNGGKIQQKNLDQNQQTEDLSQQQQIDFGQQIEEETTTIGQEIEETTTVVYQKVENIDQQQQIDFGQQIEETHLDQSKLHLKPLDQSQQQEELGQEQEEVNFTIGPQVEDDFPHGNQGKIQIGGSQDQEQEQDTQQVEQQISGWHDQPRIQQKPLDQSQEPTDTQQVEIFDVNSVKGTDDHLPKDILKKG

SEQ ID NO: 33311 - protein, 237 aa, Diabrotica virgifera
  misc_feature: Coding regions on vcDNA: vcDNA=SeqID_13008; Strand=+; Position=3-716
  misc_feature: Homolog annotation: Hit_ID=BAC06447.1; Match level="QueryCoverage =94%, HitCoverage=70%, E-value=2e-28, Identity=31%"; Hit description =chitinase [Haemaphysalis longicornis]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=61.3, E -value=2.7e-15, Copies=1"; Pfam description=Glycosyl hydrolases family 18
  misc_feature (21)..(41): Xaa can be any naturally occurring amino acid
  misc_feature (94)..(105): Xaa can be any naturally occurring amino acid
WRAYSGATPDTFEPSLCTHLXXXXXXXXXXXXXXXXXXXXXKYKGMGLFKMTTDLKKRNKSLKVLLSVGGSGGTNSSLFRELANNNNKTKAFLXXXXXXXXXXXXDGLDIFWFYPEVDDKERYIRLLEKIKNNFKKQRWLLCVTVRPGLEDAGYDPKKMDGIVDWVNLKTYDFYGSWSSSTGNHNSLYFSSKEYNWEKEHSNIAAAAKNWLNAGLSKEKTVLGVAFYGVRFEVKAKQ

SEQ ID NO: 33312 - protein, 291 aa, Diabrotica virgifera
  misc_feature: Coding regions on vcDNA: vcDNA=SeqID_13009; Strand=+; Position=3-875
  misc_feature: Homolog annotation: Hit_ID=AAF87760.1; Match level="QueryCoverage =98%, HitCoverage=65%, E-value=1e-100, Identity=68%"; Hit description= cytochrome oxidase subunit I [Diabrotica virgifera zeae]
  misc_feature: Pfam annotation: Pfam_ID=COX1; Match level="Score=-70.0, E-value=7.5e- 09, Copies=1"; Pfam description=Cytochrome C and Quinol oxidase polyp
  misc_feature (8)..(16): Xaa can be any naturally occurring amino acid
  misc_feature (20)..(26): Xaa can be any naturally occurring amino acid
  misc_feature (37)..(44): Xaa can be any naturally occurring amino acid
  misc_feature (65)..(65): Xaa can be any naturally occurring amino acid
  misc_feature (100)..(100): Xaa can be any naturally occurring amino acid
  misc_feature (117)..(117): Xaa can be any naturally occurring amino acid
  misc_feature (120)..(126): Xaa can be any naturally occurring amino acid
  misc_feature (153)..(159): Xaa can be any naturally occurring amino acid
  misc_feature (173)..(173): Xaa can be any naturally occurring amino acid
  misc_feature (181)..(197): Xaa can be any naturally occurring amino acid
  misc_feature (227)..(227): Xaa can be any naturally occurring amino acid
  misc_feature (243)..(250): Xaa can be any naturally occurring amino acid
  misc_feature (271)..(271): Xaa can be any naturally occurring amino acid
YPRPPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSEFAILSSN

SEQ ID NO: 33313 - protein, 84 aa, Diabrotica virgifera
  misc_feature: Coding regions on vcDNA: vcDNA=SeqID_13010; Strand=-; Position=337-591
  misc_feature (24)..(24): Xaa can be any naturally occurring amino acid
IFNIQILPTNFFYSTNNSYSIPPXLLILLQHYLQILNLSIIQPLIIKTPNSLYSLLIPYSYIIQFFSLHSFNFYQILYFLQQTI

SEQ ID NO: 33314 - protein, 85 aa, Diabrotica virgifera
  misc_feature: Coding regions on vcDNA: vcDNA=SeqID_13011; Strand=-; Position=239-496
  misc_feature (9)..(17): Xaa can be any naturally occurring amino acid
FLFTKPKFXXXXXXXXXPVPERRSRTMTPLTATLNRMLVSILYQSRKFFNYKVFFFLLFSLAYFLAYLTHLITLFSIFDTSHYMF

SEQ ID NO: 33315 - protein, 160 aa, Diabrotica virgifera
  misc_feature: Coding regions on vcDNA: vcDNA=SeqID_13012; Strand=+; Position=81-563
  misc_feature: Homolog annotation: Hit_ID=CAG31340.1; Match level="QueryCoverage =99%, HitCoverage=34%, E-value=2e-26, Identity=40%"; Hit description =hypothetical protein [Gallus gallus]
  misc_feature: Gene Ontology Annotation: Biological process=gametogenesis
  misc_feature: Pfam annotation: Pfam_ID=WD40; Match level="Score=38.4, E-value=2.1e -08, Copies=2"; Pfam description=WD domain, G-beta repeat
MDEDFDEDDFEELILDDDGVIYEEEPVEHMLDDISLQDQNNEEIEEQIIDVSSLTLQKHKKAVFSSALSKDDTLAITGGEDDIAYLWNTETGEVLFEFSGHKDSVTEVHFNFDGQYVTTGDMGGMIQGWSLKEKRLAWCYEGDDVEWVKWDPFANAVFCG

SEQ ID NO: 33316 - protein, 69 aa, Diabrotica virgifera
  misc_feature: Coding regions on vcDNA: vcDNA=SeqID_13013; Strand=-; Position=1-207
  misc_feature (1)..(7): Xaa can be any naturally occurring amino acid
  misc_feature (9)..(16): Xaa can be any naturally occurring amino acid
XXXXXXXDXXXXXXXXISIIITSHFYFYLFKFKCLLKILFSKIKPIEAANSYAISCLIKIESNRTLRMD

SEQ ID NO: 33317 - protein, 103 aa, Diabrotica virgifera
  misc_feature: Coding regions on vcDNA: vcDNA=SeqID_13014; Strand=-; Position=75-386
QFRDDHFSTRINASTGWGDLRTRIGFEIPSPDGTNDEHAPKNGTGGFVTISKTYKNRVLEQTYIIEDIPHFVFTAGFCTLQKFHVITYQFRQPTLTSKPTYLM

SEQ ID NO: 33318 - protein, 72 aa, Diabrotica virgifera
  misc_feature: Coding regions on vcDNA: vcDNA=SeqID_13015; Strand=-; Position=456-674
  misc_feature: Pfam annotation: Pfam_ID=CENP-B_N; Match level="Score=24.6, E-value =0.0003, Copies=1"; Pfam description=CENP-B N-terminal DNA-binding domain
IFLSLKEKVDVVHYGEKHKLNVRQLAEKFGIRKPQASEILNHKSDIINQFYENGHLEAKRKFLKTDGTALDL

SEQ ID NO: 33319 - protein, 139 aa, Diabrotica virgifera
  misc_feature: Coding regions on vcDNA: vcDNA=SeqID_13016; Strand=+; Position=166-586
  misc_feature: Homolog annotation: Hit_ID=EAL24671.1; Match level="QueryCoverage =86%, HitCoverage=22%, E-value=2e-33, Identity=59%"; Hit description =GA21078-PA [Drosophila pseudoobscura]
  misc_feature: Gene Ontology Annotation: Molecular function=chaperone activity; Cellular component=actin filament; Biological process=cell organization and biogenesis
  misc_feature (15)..(15): Xaa can be any naturally occurring amino acid
  misc_feature (25)..(25): Xaa can be any naturally occurring amino acid
  misc_feature (43)..(43): Xaa can be any naturally occurring amino acid
  misc_feature (47)..(47): Xaa can be any naturally occurring amino acid
  misc_feature (57)..(57): Xaa can be any naturally occurring amino acid
  misc_feature (67)..(67): Xaa can be any naturally occurring amino acid
  misc_feature (89)..(89): Xaa can be any naturally occurring amino acid
  misc_feature (106)..(106): Xaa can be any naturally occurring amino acid
VVGGRIVESFEEVSXEKIGDGGLVXEIEFGISKDRMLVIEECXKLKXVMIVVRGGNXMLVGERKRSXDDVLCVVRSLVKEIRVVYGGGXVEIGCCLVVVGQADQLXSVEQNAYRACAEDLESDTTCCCMITGGYLRIIR

SEQ ID NO: 33320 - protein, 71 aa, Diabrotica virgifera
  misc_feature: Coding regions on vcDNA: vcDNA=SeqID_13017; Strand=+; Position=98-313
  misc_feature: Homolog annotation: Hit_ID=XP_393870.1; Match level="QueryCoverage =94%, HitCoverage=5%, E-value=1e-18, Identity=56%"; Hit description =similar to ENSANGP00000017604 [Apis mellifera]
  misc_feature: Gene Ontology Annotation: Molecular function=RNA binding; Cellular component=nucleus; Biological process=mRNA cleavage
MMETDERLHIDWGNDKLHRTQKQVERNPYDLESWSILLRESQIKHISEVRALYEHLIGIFPSASRYWRIYH

SEQ ID NO: 33321 - protein, 104 aa, Diabrotica virgifera
  misc_feature: Coding regions on vcDNA: vcDNA=SeqID_13018; Strand=+; Position=1-315
LECEDQFYSSLQLSTVKSEINNNNCQLTTKSVVPEIVITNDKVKPDNEDEVTKKIDVKERISNTRKLFGNLKEVERTRRATSMLILRYFKYFETTQDVKFISIV

SEQ ID NO: 33322 - protein, 33 aa, Diabrotica virgifera
  misc_feature: Coding regions on vcDNA: vcDNA=SeqID_13019; Strand=-; Position=2-100
  misc_feature (3)..(11): Xaa can be any naturally occurring amino acid
  misc_feature (14)..(25): Xaa can be any naturally occurring amino acid
TAXXXXXXXXXQYXXXXXXXXXXXXSFSSVKKC

SEQ ID NO: 33323 - protein, 20 aa, Diabrotica virgifera
  misc_feature: Coding regions on vcDNA: vcDNA=SeqID_13020; Strand=+; Position=3-62
MKVLVLFSLVVLSVALPHSL

SEQ ID NO: 33324 - protein, 249 aa, Diabrotica virgifera
  misc_feature: Coding regions on vcDNA: vcDNA=SeqID_13021; Strand=+; Position=90-839
  misc_feature: Homolog annotation: Hit_ID=XP_314945.1; Match level="QueryCoverage =95%, HitCoverage=98%, E-value=2e-58, Identity=48%"; Hit description =ENSANGP00000019329 [Anopheles gambiae] gb|EAA10150.2| ENSANGP00000019329 [Anopheles gambiae
  misc_feature: Gene Ontology Annotation: Molecular function=endopeptidase activity; Cellular component=cytosol; Biological process=proteolysis and peptidolysis
  misc_feature: Pfam annotation: Pfam_ID=Proteasome; Match level="Score=19.6, E-value= 7.6e-07, Copies=1"; Pfam description=Proteasome A-type and B-type
  misc_feature (3)..(4): Xaa can be any naturally occurring amino acid
  misc_feature (8)..(8): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(17): Xaa can be any naturally occurring amino acid
  misc_feature (23)..(23): Xaa can be any naturally occurring amino acid
  misc_feature (27)..(27): Xaa can be any naturally occurring amino acid
  misc_feature (30)..(30): Xaa can be any naturally occurring amino acid
  misc_feature (35)..(37): Xaa can be any naturally occurring amino acid
  misc_feature (41)..(42): Xaa can be any naturally occurring amino acid
  misc_feature (53)..(53): Xaa can be any naturally occurring amino acid
  misc_feature (55)..(57): Xaa can be any naturally occurring amino acid
  misc_feature (61)..(63): Xaa can be any naturally occurring amino acid
  misc_feature (73)..(73): Xaa can be any naturally occurring amino acid
  misc_feature (77)..(77): Xaa can be any naturally occurring amino acid
  misc_feature (79)..(79): Xaa can be any naturally occurring amino acid
  misc_feature (83)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(103): Xaa can be any naturally occurring amino acid
  misc_feature (111)..(111): Xaa can be any naturally occurring amino acid
  misc_feature (113)..(114): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(123): Xaa can be any naturally occurring amino acid
  misc_feature (126)..(126): Xaa can be any naturally occurring amino acid
  misc_feature (131)..(132): Xaa can be any naturally occurring amino acid
  misc_feature (134)..(135): Xaa can be any naturally occurring amino acid
  misc_feature (140)..(140): Xaa can be any naturally occurring amino acid
  misc_feature (144)..(144): Xaa can be any naturally occurring amino acid
  misc_feature (151)..(152): Xaa can be any naturally occurring amino acid
  misc_feature (154)..(155): Xaa can be any naturally occurring amino acid
  misc_feature (158)..(159): Xaa can be any naturally occurring amino acid
  misc_feature (164)..(164): Xaa can be any naturally occurring amino acid
  misc_feature (166)..(167): Xaa can be any naturally occurring amino acid
  misc_feature (172)..(172): Xaa can be any naturally occurring amino acid
  misc_feature (174)..(174): Xaa can be any naturally occurring amino acid
  misc_feature (178)..(179): Xaa can be any naturally occurring amino acid
  misc_feature (182)..(182): Xaa can be any naturally occurring amino acid
  misc_feature (187)..(187): Xaa can be any naturally occurring amino acid
  misc_feature (196)..(196): Xaa can be any naturally occurring amino acid
  misc_feature (200)..(200): Xaa can be any naturally occurring amino acid
  misc_feature (202)..(202): Xaa can be any naturally occurring amino acid
  misc_feature (204)..(204): Xaa can be any naturally occurring amino acid
  misc_feature (213)..(213): Xaa can be any naturally occurring amino acid
  misc_feature (229)..(229): Xaa can be any naturally occurring amino acid
MFXXRSDXDRGXNXFXXEGRLFXVEYXIEXIKLGXXXIGIXXSGGVVVGVEKXIXXXLMEXXXIEKIVEVDKXIGCXVXGFMXDXRXMIDRXXVECXNYWFXXNENISVEXCXXGVXNLXIXXGDXDEDGXXMXXIFGVXILFXGIDEKGXXLXXMDXXGIFVXFXXKGIGXGXEGVXXKFXEVYYXSMILEEVIXIDLXIXKXVMEEKLNFXNVEVMNMNLKEMFNMXKKEKVEKVIVKLKLGKKKRI

SEQ ID NO: 33325 - protein, 193 aa, Diabrotica virgifera
  misc_feature: Coding regions on vcDNA: vcDNA=SeqID_13022; Strand=-; Position=1-579
  misc_feature (2)..(17): Xaa can be any naturally occurring amino acid
  misc_feature (23)..(137): Xaa can be any naturally occurring amino acid
  misc_feature (140)..(193): Xaa can be any naturally occurring amino acid
RXXXXXXXXXXXXXXXXKKNVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISXXXXXXXXXXXXXXXXXXXXXXXXXXXXXXXXXXXXXXXXXXXXXXXXXXXXXX

SEQ ID NO: 33326 - protein, 118 aa, Diabrotica virgifera
  misc_feature: Coding regions on vcDNA: vcDNA=SeqID_13023; Strand=+; Position=1-354
  misc_feature (1)..(79): Xaa can be any naturally occurring amino acid
  misc_feature (82)..(112): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXGGXXXXXXXXXXXXXXXXXXXXXXXXXXXXXXXLRGKHG

SEQ ID NO: 33327 - protein, 236 aa, Diabrotica virgifera
  misc_feature: Coding regions on vcDNA: vcDNA=SeqID_13024; Strand=-; Position=72-782
  misc_feature (16)..(26): Xaa can be any naturally occurring amino acid
  misc_feature (31)..(59): Xaa can be any naturally occurring amino acid
  misc_feature (89)..(117): Xaa can be any naturally occurring amino acid
  misc_feature (122)..(128): Xaa can be any naturally occurring amino acid
  misc_feature (133)..(152): Xaa can be any naturally occurring amino acid
  misc_feature (158)..(179): Xaa can be any naturally occurring amino acid
  misc_feature (213)..(219): Xaa can be any naturally occurring amino acid
  misc_feature (221)..(235): Xaa can be any naturally occurring amino acid
FPPHPRRSPPPARGWXXXXXXXXXXXPHPPXXXXXXXXXXXXXXXXXXXXXXXXXXXXXTGKLCVFCVWGGGTRPPPPPPPPPPPRVVXXXXXXXXXXXXXXXXXXXXXXXXXXXXXPPQTXXXXXXXWCCCXXXXXXXXXXXXXXXXXXXXPSPNTXXXXXXXXXXXXXXXXXXXXXXLWGGRKSKAPPPPPHPIYFLLLRKKKDDPAPPNXXXXXXXSXXXXXXXXXXXXXXXL

SEQ ID NO: 33328 - protein, 282 aa, Diabrotica virgifera
  misc_feature: Coding regions on vcDNA: vcDNA=SeqID_13025; Strand=-; Position=1-846
  misc_feature (12)..(97): Xaa can be any naturally occurring amino acid
  misc_feature (99)..(140): Xaa can be any naturally occurring amino acid
  misc_feature (145)..(169): Xaa can be any naturally occurring amino acid
  misc_feature (173)..(183): Xaa can be any naturally occurring amino acid
  misc_feature (185)..(191): Xaa can be any naturally occurring amino acid
  misc_feature (198)..(227): Xaa can be any naturally occurring amino acid
  misc_feature (239)..(256): Xaa can be any naturally occurring amino acid
  misc_feature (265)..(275): Xaa can be any naturally occurring amino acid
SLPSPPPPRPPXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXNKKEXXXXXXXXXXXXXXXXXXXXXXXXXPPKXXXXXXXXXXXGXXXXXXXPGRGRGXXXXXXXXXXXXXXXXXXXXXXXXXXXXXXPARAPKKTTPPXXXXXXXXXXXXXXXXXXGGGAPPHRXXXXXXXXXXXGRPPPFF

SEQ ID NO: 33329 - protein, 149 aa, Diabrotica virgifera
  misc_feature: Coding regions on vcDNA: vcDNA=SeqID_13026; Strand=+; Position=266-715
  misc_feature: Homolog annotation: Hit_ID=CAA10770.1; Match level="QueryCoverage =81%, HitCoverage=36%, E-value=6e-21, Identity=34%"; Hit description =reverse transcriptase-like [Bos taurus]
LKRLLNIFGESGVSLKTILNAQLTVNQQNIERVEQYTYLGTNLNSQWDYSTEIKQRIIKAKAAYVRMRPIFNSRDISLKTKYRLLKCYIFTVLLYGMEAWTLTVASMNRLEAFEMWCYRRILRISWVDRITNVEFLRRMGKECEILHNH

SEQ ID NO: 33330 - protein, 109 aa, Diabrotica virgifera
  misc_feature: Coding regions on vcDNA: vcDNA=SeqID_13027; Strand=+; Position=1-327
  misc_feature (1)..(20): Xaa can be any naturally occurring amino acid
  misc_feature (22)..(30): Xaa can be any naturally occurring amino acid
  misc_feature (59)..(65): Xaa can be any naturally occurring amino acid
  misc_feature (80)..(88): Xaa can be any naturally occurring amino acid
  misc_feature (97)..(108): Xaa can be any naturally occurring amino acid
XXXXXXXXXXXXXXXXXXXXPXXXXXXXXXPLGIKGEIFFGEGSNSKIKNWAPPPCWDXXXXXXXGGRQAIILFKFRVPXXXXXXXXXRGSWGFKNXXXXXXXXXXXXV

SEQ ID NO: 33331 - protein, 94 aa, Diabrotica virgifera
  misc_feature: Coding regions on vcDNA: vcDNA=SeqID_13028; Strand=+; Position=58-339
CATHAKERWSFSTRRQIPETAKQPRGRYLNAATMPPNAVEVHNQQLYTVAVSHPATAPEYGKHIEPHIPDNSTMCDLYINSSASVTSRTRRHAS

SEQ ID NO: 33332 - protein, 80 aa, Diabrotica virgifera
  misc_feature: Coding regions on vcDNA: vcDNA=SeqID_13029; Strand=-; Position=138-380
TNTITQAEPEAHTDQRPFFSSTCEYLIEILPSVFQLPMLILFSYSPVIRKYFEQILREIIAENWQKCRIEYVTINDEQKI

SEQ ID NO: 33333 - protein, 30 aa, Diabrotica virgifera
  misc_feature: Coding regions on vcDNA: vcDNA=SeqID_13030; Strand=+; Position=2-94
  misc_feature (10)..(16): Xaa can be any naturally occurring amino acid
LSNSLTKYIXXXXXXXPVVHLLRLRLALFY

SEQ ID NO: 33334 - protein, 123 aa, Diabrotica virgifera
  misc_feature: Coding regions on vcDNA: vcDNA=SeqID_13031; Strand=+; Position=381-749
  misc_feature (74)..(75): Xaa can be any naturally occurring amino acid
  misc_feature (77)..(84): Xaa can be any naturally occurring amino acid
PTPPPHPPHPTPHPPVGVGIERERRRGEKGQTLRGREPSRRRGWEKKEGRRPPPRAGGGNFFSPLSPPPPPPPXXPXXXXXXXXQGRKEKTQAGARTLPLSIYFLIFVCGWGAWDNTKVVFPF

SEQ ID NO: 33335 - protein, 66 aa, Diabrotica virgifera; identical to SEQ ID NO: 26808
  misc_feature: Coding regions on vcDNA: vcDNA=SeqID_13032; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33336 - protein, 209 aa, Diabrotica virgifera
  misc_feature: Coding regions on vcDNA: vcDNA=SeqID_13033; Strand=+; Position=1-627
  misc_feature (3)..(22): Xaa can be any naturally occurring amino acid
  misc_feature (24)..(70): Xaa can be any naturally occurring amino acid
  misc_feature (72)..(127): Xaa can be any naturally occurring amino acid
  misc_feature (140)..(151): Xaa can be any naturally occurring amino acid
  misc_feature (157)..(203): Xaa can be any naturally occurring amino acid
FMXXXXXXXXXXXXXXXXXXXXGXXXXXXXXXXXXXXXXXXXXXXXXXXXXXXXXXXXXXXXXXXXXXXXAXXXXXXXXXXXXXXXXXXXXXXXXXXXXXXXXXXXXXXXXXXXXXXXXXXXXXXXXKGEHTPTTAAGEXXXXXXXXXXXXSIYIKXXXXXXXXXXXXXXXXXXXXXXXXXXXXXXXXXXXXXXXXXXXXXXXFFFGPL

SEQ ID NO: 33337 - protein, 213 aa, Diabrotica virgifera
  misc_feature: Coding regions on vcDNA: vcDNA=SeqID_13034; Strand=-; Position=0-638
  misc_feature (3)..(47): Xaa can be any naturally occurring amino acid
  misc_feature (61)..(139): Xaa can be any naturally occurring amino acid
  misc_feature (143)..(177): Xaa can be any naturally occurring amino acid
  misc_feature (184)..(197): Xaa can be any naturally occurring amino acid
  misc_feature (200)..(209): Xaa can be any naturally occurring amino acid
PPXXXXXXXXXXXXXXXXXXXXXXXXXXXXXXXXXXXXXXXXXXXXXERKEREKKTPTPLXXXXXXXXXXXXXXXXXXXXXXXXXXXXXXXXXXXXXXXXXXXXXXXXXXXXXXXXXXXXXXXXXXXXXXXXXXXXXXXPPPXXXXXXXXXXXXXXXXXXXXXXXXXXXXXXXXXXXGGAPPPXXXXXXXXXXXXXXPPXXXXXXXXXXANPP

SEQ ID NO: 33338 - protein, 94 aa, Diabrotica virgifera
  misc_feature: Coding regions on vcDNA: vcDNA=SeqID_13035; Strand=-; Position=342-626
  misc_feature (56)..(84): Xaa can be any naturally occurring amino acid
  misc_feature (86)..(94): Xaa can be any naturally occurring amino acid
LALNGIDSAHVIFYKSTWRNHLVVSTSILHIYIIEVAIGIIVLILYNKSSLLSLRXXXXXXXXXXXXXXXXXXXXXXXXXXXXXTXXXXXXXXX

SEQ ID NO: 33339 - protein, 43 aa, Diabrotica virgifera
  misc_feature: Coding regions on vcDNA: vcDNA=SeqID_13036; Strand=+; Position=1-129
  misc_feature (3)..(39): Xaa can be any naturally occurring amino acid
EFXXXXXXXXXXXXXXXXXXXXXXXXXXXXXXXXXXXXXSFYS

SEQ ID NO: 33340 - protein, 39 aa, Diabrotica virgifera
  misc_feature: Coding regions on vcDNA: vcDNA=SeqID_13037; Strand=+; Position=2-118
  misc_feature (23)..(23): Xaa can be any naturally occurring amino acid
FSFWLPSSSISGSSFFHLATPFXFCFFLVETTFGFAFIN

SEQ ID NO: 33341 - protein, 190 aa, Diabrotica virgifera
  misc_feature: Coding regions on vcDNA: vcDNA=SeqID_13038; Strand=-; Position=0-569
  misc_feature (5)..(15): Xaa can be any naturally occurring amino acid
  misc_feature (26)..(67): Xaa can be any naturally occurring amino acid
  misc_feature (69)..(76): Xaa can be any naturally occurring amino acid
  misc_feature (78)..(108): Xaa can be any naturally occurring amino acid
  misc_feature (117)..(122): Xaa can be any naturally occurring amino acid
  misc_feature (125)..(135): Xaa can be any naturally occurring amino acid
  misc_feature (141)..(186): Xaa can be any naturally occurring amino acid
GGGHXXXXXXXXXXXRGGRRRNKKPXXXXXXXXXXXXXXXXXXXXXXXXXXXXXXXXXXXXXXXXXXEXXXXXXXXCXXXXXXXXXXXXXXXXXXXXXXXXXXXXXXXEEKKRRVGXXXXXXSTXXXXXXXXXXXNTPPSXXXXXXXXXXXXXXXXXXXXXXXXXXXXXXXXXXXXXXXXXXXXXXGGSG

SEQ ID NO: 33342 - protein, 52 aa, Diabrotica virgifera
  misc_feature: Coding regions on vcDNA: vcDNA=SeqID_13039; Strand=+; Position=426-584
NFVYKSSPLLFSYGSRFSVNLSEKFKYQNLFPSKCGMINMVIIKIVMNNILQ

SEQ ID NO: 33343 - protein, 71 aa, Diabrotica virgifera
  misc_feature: Coding regions on vcDNA: vcDNA=SeqID_13040; Strand=-; Position=28-243
  misc_feature (23)..(23): Xaa can be any naturally occurring amino acid
  misc_feature (35)..(35): Xaa can be any naturally occurring amino acid
IETSKASESTPCIVSRNSVQGGXPSLYESVVIVKXTSKAGYLFGEAIIFEHNHSFINKTDIYRKYFKSLVH

SEQ ID NO: 33344 - protein, 52 aa, Diabrotica virgifera
  misc_feature: Coding regions on vcDNA: vcDNA=SeqID_13041; Strand=-; Position=2-157
  misc_feature (3)..(17): Xaa can be any naturally occurring amino acid
  misc_feature (33)..(51): Xaa can be any naturally occurring amino acid
GGXXXXXXXXXXXXXXXLVIPKVNFFWNKKNGXXXXXXXXXXXXXXXXXXXP

SEQ ID NO: 33345 - protein, 79 aa, Diabrotica virgifera
  misc_feature: Coding regions on vcDNA: vcDNA=SeqID_13042; Strand=+; Position=1-237
  misc_feature (4)..(37): Xaa can be any naturally occurring amino acid
IKKXXXXXXXXXXXXXXXXXXXXXXXXXXXXXXXXXXSSPPPPPPRGGGRGGVAEKGGAEGGAGAPTPPRQGTAGGVLL

SEQ ID NO: 33346 - protein, 19 aa, Diabrotica virgifera
  misc_feature: Coding regions on vcDNA: vcDNA=SeqID_13043; Strand=-; Position=1-57
  misc_feature (1)..(17): Xaa can be any naturally occurring amino acid
XXXXXXXXXXXXXXXXXLF

SEQ ID NO: 33347 - protein, 191 aa, Diabrotica virgifera
  misc_feature: Coding regions on vcDNA: vcDNA=SeqID_13044; Strand=-; Position=1-573
  misc_feature (6)..(31): Xaa can be any naturally occurring amino acid
  misc_feature (36)..(77): Xaa can be any naturally occurring amino acid
  misc_feature (79)..(79): Xaa can be any naturally occurring amino acid
  misc_feature (83)..(117): Xaa can be any naturally occurring amino acid
  misc_feature (135)..(143): Xaa can be any naturally occurring amino acid
  misc_feature (147)..(159): Xaa can be any naturally occurring amino acid
  misc_feature (161)..(191): Xaa can be any naturally occurring amino acid
HPTTTXXXXXXXXXXXXXXXXXXXXXXXXXXFGSRXXXXXXXXXXXXXXXXXXXXXXXXXXXXXXXXXXXXXXXXXXPXGGGXXXXXXXXXXXXXXXXXXXXXXXXXXXXXXXXXXXHKNQKTTPTPSPWGGEMXXXXXXXXXPPPXXXXXXXXXXXXXPXXXXXXXXXXXXXXXXXXXXXXXXXXXXXXX

SEQ ID NO: 33348 - protein, 205 aa, Diabrotica virgifera
  misc_feature: Coding regions on vcDNA: vcDNA=SeqID_13045; Strand=+; Position=3-620
PIEPEIPPNIPTSELNNATPSKTPAYKRGHSEVESTSEQTDIPDNTSVTNLSEDNIMPPPSNDIKKPKKKPRTSSASDRYLCDLTKDSIKEAFKKTSESLVIPPENLIAFIENTFGCSNPYAEALKFTENVPGLIANIQALHPACQERSTKSRLTRLTKKLRKALNTDPEDPENLSNPKLSSDHTEDNYNSDSSESSQSSQISSY

SEQ ID NO: 33349 - protein, 20 aa, Diabrotica virgifera
  misc_feature: Coding regions on vcDNA: vcDNA=SeqID_13046; Strand=-; Position=1-60
  misc_feature (3)..(20): Xaa can be any naturally occurring amino acid
KKXXXXXXXXXXXXXXXXXX

SEQ ID NO: 33350 - protein, 41 aa, Diabrotica virgifera
  misc_feature: Coding regions on vcDNA: vcDNA=SeqID_13047; Strand=+; Position=131-256
QHIVERQDSKSVFMIPSLDSLQSICTVYEENVKTYLLTIYL

SEQ ID NO: 33351 - protein, 80 aa, Diabrotica virgifera
  misc_feature: Coding regions on vcDNA: vcDNA=SeqID_13048; Strand=+; Position=612-854
RYRAQFQKYVSMWKLLYNKKKPVPPLRTTKNTLSSNKHFYPVPRFCVTFDLLKIEFFITRNRTSLTSAIFRAHVYKNYCF

SEQ ID NO: 33352 - protein, 95 aa, Diabrotica virgifera
  misc_feature: Coding regions on vcDNA: vcDNA=SeqID_13049; Strand=-; Position=2-286
  misc_feature (9)..(95): Xaa can be any naturally occurring amino acid
KITLLSLEXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33353 - protein, 22 aa, Diabrotica virgifera
  misc_feature: Coding regions on vcDNA: vcDNA=SeqID_13050; Strand=+; Position=1-66
RRRCMTGTCSSACHYCCDTKYA

SEQ ID NO: 33354 - protein, 20 aa, Diabrotica virgifera
  misc_feature: Coding regions on vcDNA: vcDNA=SeqID_13051; Strand=-; Position=1-60
  misc_feature (8)..(20): Xaa can be any naturally occurring amino acid
KKIVSFFXXXXXXXXXXXXX

SEQ ID NO: 33355 - protein, 50 aa, Diabrotica virgifera
  misc_feature: Coding regions on vcDNA: vcDNA=SeqID_13052; Strand=-; Position=21-173
  misc_feature (22)..(32): Xaa can be any naturally occurring amino acid
  misc_feature (35)..(41): Xaa can be any naturally occurring amino acid
CLLHLTIMSNTGKCFWFSDVIXXXXXXXXXXXIYXXXXXXXNMSLYNLRK

SEQ ID NO: 33356 - protein, 129 aa, Diabrotica virgifera
  misc_feature: Coding regions on vcDNA: vcDNA=SeqID_13053; Strand=+; Position=513-899
  misc_feature: Homolog annotation: Hit_ID=NP_740797.1; Match level="QueryCoverage =77%, HitCoverage=50%, E-value=8e-11, Identity=34%"; Hit description =predicted CDS, reverse transcriptase family member (1C450) [Caenorhabditis elegans]
  misc_feature (81)..(81): Xaa can be any naturally occurring amino acid
FYVQNVFLNSLAPDAVRALALVQDGPETLTLTKARVSKLRIEQRNMERSILGIRLMDRVRNLEIRQRTGVQEIIERISRLXWSFAGHIARLQDDRWIKKLLEWRPRMDKRSRGRPPHAGDDIKRIDGRW

SEQ ID NO: 33357 - protein, 95 aa, Diabrotica virgifera
  misc_feature: Coding regions on vcDNA: vcDNA=SeqID_13054; Strand=-; Position=3-287
  misc_feature (21)..(59): Xaa can be any naturally occurring amino acid
  misc_feature (83)..(83): Xaa can be any naturally occurring amino acid
VPLSRTGSIPVEPRISILNNXXXXXXXXXXXXXXXXXXXXXXXXXXXXXXXXXXXXXXXLSSSLKILLYYYILNIFRDHKKAXFSLFRVLSDASK

SEQ ID NO: 33358 - protein, 43 aa, Diabrotica virgifera
  misc_feature: Coding regions on vcDNA: vcDNA=SeqID_13055; Strand=-; Position=1-129
  misc_feature (4)..(4): Xaa can be any naturally occurring amino acid
  misc_feature (9)..(21): Xaa can be any naturally occurring amino acid
  misc_feature (33)..(43): Xaa can be any naturally occurring amino acid
QKKXKTVEXXXXXXXXXXXXXTVSFSSSPFISXXXXXXXXXXX

SEQ ID NO: 33359 - protein, 77 aa, Diabrotica virgifera
  misc_feature: Coding regions on vcDNA: vcDNA=SeqID_13056; Strand=+; Position=434-664
YSLLILFLYLHLFRYILPKPGLSQCRVIFSCYVLDDAVDIYSMNSTSYYSSVFHDVLCYSTLLLSTTFSYTLLDATK

SEQ ID NO: 33360 - protein, 20 aa, Diabrotica virgifera
  misc_feature: Coding regions on vcDNA: vcDNA=SeqID_13057; Strand=+; Position=3-62
HASDHFELRVKVLKMRFLIL

SEQ ID NO: 33361 - protein, 297 aa, Diabrotica virgifera
  misc_feature: Coding regions on vcDNA: vcDNA=SeqID_13058; Strand=+; Position=2-891
  misc_feature: Homolog annotation: Hit_ID=XP_396943.1; Match level="QueryCoverage =99%, HitCoverage=51%, E-value=1e-103, Identity=62%"; Hit description= similar to MGC69122 protein [Apis mellifera]
  misc_feature: Gene Ontology Annotation: Molecular function=protein binding; Cellular component=anaphase-promoting complex; Biological process =mitosis
  misc_feature: Pfam annotation: Pfam_ID=TPR_1; Match level="Score=99.8, E-value=7.2e- 27, Copies=5"; Pfam description=Tetratricopeptide repeat
  misc_feature (220)..(221): Xaa can be any naturally occurring amino acid
  misc_feature (263)..(263): Xaa can be any naturally occurring amino acid
  misc_feature (270)..(270): Xaa can be any naturally occurring amino acid
  misc_feature (282)..(282): Xaa can be any naturally occurring amino acid
DLVSVAIEVFIKSVIAEPMLWSAWFELGKIIPDKNFIFSVALPEHWIKSFFLAHTFLEQLNNDESLQMYNTFFSLGFQNNTYVLSQIALGHHNRRNLNDAIEIFQRILEIDPYRLDNLDTYSNLLYVLEMKKELADLAHKVVNIDKYRVETCCVIGNYYSLRSDHTKAVLYFRRALKLNPQFLSAWTLMGHEFMEMKNTNAAIQSYRHAIEINSRDYRAXXYGLGQTYEILKMPNYCLHYYKRAQQLKPNDSRMVIALGEAYXKLDKTEXALKCYYKACNFXWNVEGTALLKLAKLY

SEQ ID NO: 33362 - protein, 75 aa, Diabrotica virgifera
  misc_feature: Coding regions on vcDNA: vcDNA=SeqID_13059; Strand=+; Position=10-237
RHHMSALDAPCCRDRWALARHTSGPLGTIDEIRNPHIITLPLRESATIIGYPEQPQTFRGATGRIHIRDSTVLYP

SEQ ID NO: 33363 - protein, 93 aa, Diabrotica virgifera
  misc_feature: Coding regions on vcDNA: vcDNA=SeqID_13060; Strand=-; Position=82-363
NVYHMLVSPFKFFPTKRCRPFTNSSVHILFVHICHVILHFFLLLPMCFPFNPCQCYFFTPFLSSPLLSNSNLKSITRKSASFLLSTSDMIIYM

SEQ ID NO: 33364 - protein, 92 aa, Diabrotica virgifera
  misc_feature: Coding regions on vcDNA: vcDNA=SeqID_13061; Strand=-; Position=20-298
LSRHLQIYYSDQSKAVALLSLAGSGSSTTPPITMCGVYNFYSILYILIHKQLCPRLYFIFLVLSKKRLIPSKLCRLNIVNVKRWTEKIIKMM

SEQ ID NO: 33365 - protein, 160 aa, Diabrotica virgifera
  misc_feature: Coding regions on vcDNA: vcDNA=SeqID_13062; Strand=-; Position=1-480
  misc_feature (4)..(10): Xaa can be any naturally occurring amino acid
  misc_feature (12)..(47): Xaa can be any naturally occurring amino acid
  misc_feature (56)..(72): Xaa can be any naturally occurring amino acid
  misc_feature (81)..(94): Xaa can be any naturally occurring amino acid
  misc_feature (98)..(122): Xaa can be any naturally occurring amino acid
  misc_feature (125)..(139): Xaa can be any naturally occurring amino acid
GCVXXXXXXXSXXXXXXXXXXXXXXXXXXXXXXXXXXXXXXXXXXXXPNKTQKKGXXXXXXXXXXXXXXXXXPRGPAGAGXXXXXXXXXXXXXXTPLXXXXXXXXXXXXXXXXXXXXXXXXXSPXXXXXXXXXXXXXXXGCGEKEKKHPPRGRGAGGGEE

SEQ ID NO: 33366 - protein, 24 aa, Diabrotica virgifera
  misc_feature: Coding regions on vcDNA: vcDNA=SeqID_13063; Strand=+; Position=2-76
RIVYLVGNIYVHKRNSATTFTPAS

SEQ ID NO: 33367 - protein, 98 aa, Diabrotica virgifera
  misc_feature: Coding regions on vcDNA: vcDNA=SeqID_13064; Strand=+; Position=354-650
  misc_feature (56)..(68): Xaa can be any naturally occurring amino acid
IIKKGQFLQKKNTFLTADVIQLLTKVYRTIFYKFEGQIFHIRLAELDLTPWWYNSXXXXXXXXXXXXXLVSGRFPGGQLSRRHFKMLNPRDVVKRSNL

SEQ ID NO: 33368 - protein, 264 aa, Diabrotica virgifera
  misc_feature: Coding regions on vcDNA: vcDNA=SeqID_13065; Strand=+; Position=67-859
  misc_feature: Homolog annotation: Hit_ID=XP_319555.1; Match level="QueryCoverage =100%, HitCoverage=61%, E-value=2e-61, Identity=43%"; Hit description= ENSANGP00000017837 [Anopheles gambiae]
  misc_feature (235)..(235): Xaa can be any naturally occurring amino acid
  misc_feature (238)..(238): Xaa can be any naturally occurring amino acid
  misc_feature (259)..(259): Xaa can be any naturally occurring amino acid
SMAERLDLLLFGATGVTGLHAIRYLHKFSKEKKLTWGVSGRSETKLKAVLKNEGLRMGEDLSKIPIILADTKDQESLNEMAKKAKVLLNCCGPYRLLGFPVVEACIKAGTHHLDVSGEPSYIDSLPEKYDAAAKEKGIYIVSACGVDCVPTDLGSAYLQQKFDGVLNSVVAYVELWTEGKSSGSVGGYGTWQSLVYEFQTMGSLSKLKAKLIPPSDSAFKPTLPVKIRPFYSEVXRGXVMPFAGHDRKIMAETQKYFYXKESQR

SEQ ID NO: 33369 - protein, 246 aa, Diabrotica virgifera
  misc_feature: Coding regions on vcDNA: vcDNA=SeqID_13066; Strand=+; Position=169-906
  misc_feature: Homolog annotation: Hit_ID=AAB69448.1; Match level="QueryCoverage =83%, HitCoverage=48%, E-value=4e-40, Identity=43%"; Hit description =Tis11 family protein [Crassostrea virginica]
  misc_feature: Gene Ontology Annotation: Molecular function=transcription factor activity; Cellular component=cytoplasm; Biological process=cell proliferation
  misc_feature: Pfam annotation: Pfam_ID=zf-CCCH; Match level="Score=98.2, E-value=2e- 26, Copies=2"; Pfam description=Zinc finger C-x8-C-x5-C-x3-H type (an
MSTAIMSQNAMYEFGESLIKVGQSKLFFRYPTNNEQSNYRNEINGITPDSTTTSHIPIGSTQMRLTLTRMASTPIGQASSNQLAALLDNLTQHRRLERTQSAPAPQVSAPAAAVTATTVNTSRYKTELCRPFEEFGVCKYGDKCQFAHGMSELRSLARHPKYKTELCRTYHTVGFCPYGPRCHFVHNQDEVTKPPMLSNRPSSVTPRAARPAALSPSLSLDSPSPPCLSQSPTSSDGIVLQQRTRL

SEQ ID NO: 33370 - protein, 256 aa, Diabrotica virgifera
  misc_feature: Coding regions on vcDNA: vcDNA=SeqID_13067; Strand=+; Position=74-844
  misc_feature: Homolog annotation: Hit_ID=EAA08090.3; Match level="QueryCoverage =95%, HitCoverage=96%, E-value=5e-19, Identity=29%"; Hit description =ENSANGP00000014883 [Anopheles gambiae str. PEST] ref|XP_563791.1| ENSANGP00000014883 [Anopheles gambiae st
MVYESDFYTTRRPYRATPSVSSYTISGVPSRQVRVLPGLGKVHVTYTYDRIVPYVGHKRLTVVTAPPRVWGTRPSVLQREFDRIENKIRPWTGYSATNRYLNSNSAVIFDDETRLIRAQTASLLKRIHDPVPRVQRYSWPAVAAKYDNGLPARLHNDNYIHRLLVTSPNSKTEYTTYYTEPVKKYIGDRVYSRRPHIYLYEDPLKNDIQLLSYYINKFKQEKAITASSEPAKAAKVEKAQSPEKEQEKAEITEITE

SEQ ID NO: 33371 - protein, 208 aa, Diabrotica virgifera
  misc_feature: Coding regions on vcDNA: vcDNA=SeqID_13068; Strand=-; Position=1-624
  misc_feature (1)..(208): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33372 - protein, 299 aa, Diabrotica virgifera
  misc_feature: Coding regions on vcDNA: vcDNA=SeqID_13069; Strand=+; Position=2-896
  misc_feature: Homolog annotation: Hit_ID=XP_396048.1; Match level="QueryCoverage =100%, HitCoverage=18%, E-value=1e-118, Identity=70%"; Hit description=similar to ENSANGP00000003051 [Apis mellifera]
  misc_feature: Gene Ontology Annotation: Cellular component=nucleus; Biological process=DNA replication
  misc_feature: Pfam annotation: Pfam_ID=CPSF_A; Match level="Score=103.9, E-value =4.1e-28, Copies=1"; Pfam description=CPSF A subunit region
  misc_feature (269)..(269): Xaa can be any naturally occurring amino acid
  misc_feature (272)..(272): Xaa can be any naturally occurring amino acid
  misc_feature (275)..(275): Xaa can be any naturally occurring amino acid
NMKEVNHMCSLNAEAYPDSLALATDTSVTIGTIDEIQKLHIRTVPLQESARRIAYQEQTQTFGVVTARIDIQDSTGLNPARQSASTMAQSVTISSSVGSLGISKSGSSSLLSSQAPDYGQEVEIHNLLIIDQNTFEILHAHQLMQQEYAMSLVSCTLGNDPSPYFVVGTANVNPEEAEPKQGRLLVFHWNDNKLTQVSEKEIKGACYSLSEFNGKLLASINSTVRLFEWTAEKELRLECSQFNNIISLFLKTKGDFILIGDLMRSMTLXTYXTMXEGSFEEIARDLHPHWMTAVEILDD

SEQ ID NO: 33373 - protein, 17 aa, Diabrotica virgifera
  misc_feature: Coding regions on vcDNA: vcDNA=SeqID_13070; Strand=-; Position=3-53
SLSTVNQLNIYFNQKFI

SEQ ID NO: 33374 - protein, 36 aa, Diabrotica virgifera
  misc_feature: Coding regions on vcDNA: vcDNA=SeqID_13071; Strand=+; Position=54-161
  misc_feature (20)..(28): Xaa can be any naturally occurring amino acid
RFLVLTHLYHNSFICVINKXXXXXXXXXTHNFLIHF

SEQ ID NO: 33375 - protein, 70 aa, Diabrotica virgifera
  misc_feature: Coding regions on vcDNA: vcDNA=SeqID_13072; Strand=+; Position=15-227
  misc_feature (1)..(9): Xaa can be any naturally occurring amino acid
  misc_feature (25)..(34): Xaa can be any naturally occurring amino acid
  misc_feature (44)..(50): Xaa can be any naturally occurring amino acid
XXXXXXXXXKYTSYIYDIFNLIALXXXXXXXXXXISYTLSIVNXXXXXXXFLSSNFLKLKNDILYCDRNI

SEQ ID NO: 33376 - protein, 239 aa, Diabrotica virgifera
  misc_feature: Coding regions on vcDNA: vcDNA=SeqID_13073; Strand=+; Position=187-906
  misc_feature: Homolog annotation: Hit_ID=NP_524806.1; Match level="QueryCoverage =99%, HitCoverage=55%, E-value=3e-89, Identity=66%"; Hit description =CG5061-PA [Drosophila melanogaster] gb|AAF51408.2| CG5061-PA [Drosophila melanogaster]
  misc_feature: Gene Ontology Annotation: Molecular function=cytoskeletal protein binding; Cellular component=cytoplasm; Biological process=cellular morphogenesis
  misc_feature: Pfam annotation: Pfam_ID=CAP; Match level="Score=31.4, E-value=3.4e -19, Copies=1"; Pfam description=CAP protein
  misc_feature (202)..(202): Xaa can be any naturally occurring amino acid
  misc_feature (223)..(223): Xaa can be any naturally occurring amino acid
MSVLGFSDIVNGPLAQYLQLSAQIGGDVAEHSNLVKNAFNAQYKFIELASQSSKPAPNDLNNFLVPTSDSIRQIQEFREKHRTSQYFNHLSAISESIPALGWVTVSPTPGPFVKEMNDAGQFYTNRVLKDWKEKDKKHFDWTKSWVQTLSDLQAFVKQYHTTGLVWSGKGAPRSLGGFPPPPPPGCPPPPPVLDLASMGGAXDASQDRSALFAEINKGQDITXSLKKVTSDMQTHKNQL

SEQ ID NO: 33377 - protein, 191 aa, Diabrotica virgifera
  misc_feature: Coding regions on vcDNA: vcDNA=SeqID_13074; Strand=+; Position=114-689
  misc_feature: Homolog annotation: Hit_ID=XP_320212.1; Match level="QueryCoverage =95%, HitCoverage=23%, E-value=3e-41, Identity=50%"; Hit description =ENSANGP00000020077 [Anopheles gambiae]
MVVIFRLKRYFFIRFIFLLSLSLFLVIFIYHIFEIFDKVYSSSTKNCQYNENIDVVYTWVNGSDPEFLRNLNGYLKDHRNITCDASKQRFDDKYELKFSLRSLEKYAPWINHVYIVTNGQIPYWLNLDYEKVTIVTHEDIFKDVSNLPTFSSPAIECNLHRIPGLSKKFIYFNDDIFLGSPLYLDDFMGWK

SEQ ID NO: 33378 - protein, 290 aa, Diabrotica virgifera
  misc_feature: Coding regions on vcDNA: vcDNA=SeqID_13075; Strand=+; Position=1-870
  misc_feature: Homolog annotation: Hit_ID=EAA06781.2; Match level="QueryCoverage =62%, HitCoverage=37%, E-value=1e-45, Identity=49%"; Hit description =ENSANGP00000001626 [Anopheles gambiae str. PEST] ref|XP_559401.1| ENSANGP00000001626 [Anopheles gambiae st
  misc_feature: Pfam annotation: Pfam_ID=PHD; Match level="Score=31.6, E-value=2.4e -06, Copies=1"; Pfam description=PHD-finger
KRVWTNTAEENKDLLKEQQELRTKYDKVLKKSNDLIAKSNDLKQSIHKFHSAILSACPTKNLPSIDDLGKPVSNRTPQPMMVPTAAALKMGVGFPLQNIPSGRTDRVLSSHANKDPLQLNECGTCRQRRDQHLLAKCDTCHLYYHLDCLNPPLSRLPKKSKLYGWQCSECDKTSDSEVEELKTPRRSRSIYSNRESKSDQDISTPKLKIKSVDSSADSAEKEKSKSRDSSPSKKKTYENIFTELAQMNGVQVIVDNGYEGYEGSHKSAKIRRREKHRSSSGSPDASREHK

SEQ ID NO: 33379 - protein, 291 aa, Diabrotica virgifera
  misc_feature: Coding regions on vcDNA: vcDNA=SeqID_13076; Strand=+; Position=2-874
  misc_feature: Homolog annotation: Hit_ID=XP_311576.1; Match level="QueryCoverage =99%, HitCoverage=49%, E-value=1e-101, Identity=62%"; Hit description= ENSANGP00000016083 [Anopheles gambiae]
  misc_feature: Gene Ontology Annotation: Molecular function=lyase activity; Cellular component=peroxisome; Biological process=lipid metabolism
  misc_feature: Pfam annotation: Pfam_ID=TPP_enzyme_M; Match level="Score=135.4, E -value=1.3e-37, Copies=1"; Pfam description=Thiamine pyrophosphate enzyme, central
KIPDQYGPVPIPQVFPDPRQIEKVITVLSQAQNPLIIVGKGAAYSRAEKEVRDLIEFANLPFLATPMGKGVVPDTSTKFVGSARSTALQQADVILLLGARLNWILHFGRPPRFSPNVKVIQIDITAEELHNSVKSEVAIQSDIKSALELINAGLKKRNFKYNDNSEWWSLLRKKCRDNQRTVKAMCADISVPLNYYAVFQNLFDHLPEDCIIVSEGANTMDIGRTLLLNNQPRHRLDAGTFGTMGVGPGFAIAAAFYCRHNQPNKRVICVEGDSAFGFSGMEIETMVRYKL

SEQ ID NO: 33380 - protein, 58 aa, Diabrotica virgifera
  misc_feature: Coding regions on vcDNA: vcDNA=SeqID_13077; Strand=+; Position=3-179
  misc_feature (2)..(2): Xaa can be any naturally occurring amino acid
  misc_feature (6)..(12): Xaa can be any naturally occurring amino acid
  misc_feature (20)..(28): Xaa can be any naturally occurring amino acid
  misc_feature (36)..(53): Xaa can be any naturally occurring amino acid
LXFFHXXXXXXXVYTIINNXXXXXXXXXLNLSTCRXXXXXXXXXXXXXXXXXXRSHFF

SEQ ID NO: 33381 - protein, 45 aa, Diabrotica virgifera
  misc_feature: Coding regions on vcDNA: vcDNA=SeqID_13078; Strand=+; Position=81-215
  misc_feature (5)..(5): Xaa can be any naturally occurring amino acid
  misc_feature (16)..(23): Xaa can be any naturally occurring amino acid
  misc_feature (34)..(43): Xaa can be any naturally occurring amino acid
SSYNXCSSYIIKVCRXXXXXXXXLKPCEARLGSXXXXXXXXXXKR

SEQ ID NO: 33382 - protein, 17 aa, Diabrotica virgifera
  misc_feature: Coding regions on vcDNA: vcDNA=SeqID_13079; Strand=-; Position=2-52
  misc_feature (4)..(17): Xaa can be any naturally occurring amino acid
LIMXXXXXXXXXXXXXX

SEQ ID NO: 33383 - protein, 264 aa, Diabrotica virgifera
  misc_feature: Coding regions on vcDNA: vcDNA=SeqID_13080; Strand=-; Position=1-792
  misc_feature (3)..(28): Xaa can be any naturally occurring amino acid
  misc_feature (40)..(88): Xaa can be any naturally occurring amino acid
  misc_feature (90)..(110): Xaa can be any naturally occurring amino acid
  misc_feature (112)..(138): Xaa can be any naturally occurring amino acid
  misc_feature (144)..(158): Xaa can be any naturally occurring amino acid
  misc_feature (163)..(163): Xaa can be any naturally occurring amino acid
  misc_feature (181)..(262): Xaa can be any naturally occurring amino acid
PPXXXXXXXXXXXXXXXXXXXXXXXXXXEKQNPPPPLFIXXXXXXXXXXXXXXXXXXXXXXXXXXXXXXXXXXXXXXXXXXXXXXXXXPXXXXXXXXXXXXXXXXXXXXXHXXXXXXXXXXXXXXXXXXXXXXXXXXXEICFFXXXXXXXXXXXXXXXKRTTXPPFPPSFLLFGRGEEGGXXXXXXXXXXXXXXXXXXXXXXXXXXXXXXXXXXXXXXXXXXXXXXXXXXXXXXXXXXXXXXXXXXXXXXXXXXXXXXXXXXGG

SEQ ID NO: 33384 - protein, 228 aa, Diabrotica virgifera
  misc_feature: Coding regions on vcDNA: vcDNA=SeqID_13081; Strand=+; Position=2-688
  misc_feature: Homolog annotation: Hit_ID=EAL44090.1; Match level="QueryCoverage =84%, HitCoverage=82%, E-value=1e-15, Identity=33%"; Hit description =hypothetical protein 298.t00006 [Entamoeba histolytica HM-1:IMSS]
  misc_feature: Gene Ontology Annotation: Molecular function=structural constituent of muscle; Cellular component=sarcomere; Biological process=striated muscle contraction
EKPAEQAPKLVATEIKEDKILLSEQKVEASPVAEEKLPELKKAEEPAPQLEGKSVLELPEEKPQPAQPEGKLEPVQPVLAAVPAVELEVKPEEKPEGEKKAKSEEPKPEEQKVQKVEEAKPSEGKSLEQQPAEIKPVELVPVAEEKPIEGPKLPEGKLEKLPLPEKPLEEPKPTDAAKIEEPKSAEEKLPEPRIVDFIYVCSKIKKSCFVIETVLFLFYSRSEFIISF

SEQ ID NO: 33385 - protein, 37 aa, Diabrotica virgifera
  misc_feature: Coding regions on vcDNA: vcDNA=SeqID_13082; Strand=-; Position=0-110
  misc_feature (4)..(36): Xaa can be any naturally occurring amino acid
IYKXXXXXXXXXXXXXXXXXXXXXXXXXXXXXXXXXP

SEQ ID NO: 33386 - protein, 118 aa, Diabrotica virgifera
  misc_feature: Coding regions on vcDNA: vcDNA=SeqID_13083; Strand=-; Position=1-354
  misc_feature (1)..(14): Xaa can be any naturally occurring amino acid
  misc_feature (28)..(39): Xaa can be any naturally occurring amino acid
  misc_feature (41)..(95): Xaa can be any naturally occurring amino acid
  misc_feature (99)..(113): Xaa can be any naturally occurring amino acid
XXXXXXXXXXXXXXGGGSFPPPRGGRGXXXXXXXXXXXXAXXXXXXXXXXXXXXXXXXXXXXXXXXXXXXXXXXXXXXXXXXXXXXXXXXXXXXXREKXXXXXXXXXXXXXXXPHTKR

SEQ ID NO: 33387 - protein, 133 aa, Diabrotica virgifera
  misc_feature: Coding regions on vcDNA: vcDNA=SeqID_13084; Strand=+; Position=285-686
  misc_feature (115)..(123): Xaa can be any naturally occurring amino acid
CSQMKVNQKKSKTDEMYVNRVEEGYQTNLISKYMVDNETKFHSFFRVTKNQLHFLLCAIKEDITKSPTRMVKRMITLYITPEEKLGVTLRLVQNVYFLCNYENNRIAYLYLEITXXXXXXXXXFLTSNLVIII

SEQ ID NO: 33388 - protein, 62 aa, Diabrotica virgifera
  misc_feature: Coding regions on vcDNA: vcDNA=SeqID_13085; Strand=+; Position=253-441
ESSPIFKRSAYYGKADGTPFKNCKEILESGRYYLKMNIPKYNSVLKRNNIEIKYDKPKLNII

SEQ ID NO: 33389 - protein, 212 aa, Diabrotica virgifera
  misc_feature: Coding regions on vcDNA: vcDNA=SeqID_13086; Strand=+; Position=1-636
  misc_feature: Homolog annotation: Hit_ID=XP_322005.1; Match level="QueryCoverage =97%, HitCoverage=3%, E-value=7e-34, Identity=39%"; Hit description =ENSANGP00000004133 [Anopheles gambiae]
  misc_feature: Gene Ontology Annotation: Molecular function=calmodulin binding
  misc_feature (182)..(182): Xaa can be any naturally occurring amino acid
  misc_feature (200)..(200): Xaa can be any naturally occurring amino acid
PHLREREEKGRSPCKSRDGNTARSGLQKFQQSFGVLSVALASRALSLLSELFDDLYLEVCGGAGSIVQVEPAPLAIMGQFTALQRISRILNAAPLNHLLFYLAIVSYRKACTLKRLHPPEGDTFSQSDSTTYYEDMIMCSDDSSTDEDDDSEPILGQWFEETLAPPETTESKSPTSENGETXTVQNERSRSMVPEKGELXDYRSFTSVFEFL

SEQ ID NO: 33390 - protein, 60 aa, Diabrotica virgifera
  misc_feature: Coding regions on vcDNA: vcDNA=SeqID_13087; Strand=+; Position=1-180
  misc_feature (3)..(13): Xaa can be any naturally occurring amino acid
  misc_feature (18)..(18): Xaa can be any naturally occurring amino acid
  misc_feature (32)..(32): Xaa can be any naturally occurring amino acid
  misc_feature (38)..(52): Xaa can be any naturally occurring amino acid
AYXXXXXXXXXXXFITLXIKFFSITLFYIIIXLLAVIXXXXXXXXXXXXXXXFLIPIFLI

SEQ ID NO: 33391 - protein, 233 aa, Diabrotica virgifera
  misc_feature: Coding regions on vcDNA: vcDNA=SeqID_13088; Strand=+; Position=1-699
  misc_feature (3)..(11): Xaa can be any naturally occurring amino acid
  misc_feature (21)..(36): Xaa can be any naturally occurring amino acid
  misc_feature (43)..(57): Xaa can be any naturally occurring amino acid
  misc_feature (59)..(87): Xaa can be any naturally occurring amino acid
  misc_feature (92)..(135): Xaa can be any naturally occurring amino acid
  misc_feature (159)..(173): Xaa can be any naturally occurring amino acid
  misc_feature (188)..(207): Xaa can be any naturally occurring amino acid
  misc_feature (212)..(220): Xaa can be any naturally occurring amino acid
GGXXXXXXXXXGGRGVGVFPXXXXXXXXXXXXXXXXWGGTTTXXXXXXXXXXXXXXXHXXXXXXXXXXXXXXXXXXXXXXXXXXXXXPKKTXXXXXXXXXXXXXXXXXXXXXXXXXXXXXXXXXXXXXXXXXXXXAARPGPPLIHLEEKGGGGGEPPPXXXXXXXXXXXXXXXSPPTPQPIVLVGGGXXXXXXXXXXXXXXXXXXXXPTPHXXXXXXXXXSRSPAAGQGGGEK

SEQ ID NO: 33392 - protein, 74 aa, Diabrotica virgifera
  misc_feature: Coding regions on vcDNA: vcDNA=SeqID_13089; Strand=+; Position=3-227
  misc_feature (31)..(41): Xaa can be any naturally occurring amino acid
  misc_feature (65)..(72): Xaa can be any naturally occurring amino acid
RLLISVLSIQHSCRSSKHKSAYNVNPMKHWXXXXXXXXXXXKYRSQCRYHDYQLVIIYILYSLIXXXXXXXXVY

SEQ ID NO: 33393 - protein, 40 aa, Diabrotica virgifera
  misc_feature: Coding regions on vcDNA: vcDNA=SeqID_13090; Strand=+; Position=4-126
  misc_feature (38)..(38): Xaa can be any naturally occurring amino acid
QRNFIGELTSIIQIATSIVDYSYNWCSSYIITSARLLXFT

SEQ ID NO: 33394 - protein, 39 aa, Diabrotica virgifera
  misc_feature: Coding regions on vcDNA: vcDNA=SeqID_13091; Strand=-; Position=2-118
  misc_feature (3)..(9): Xaa can be any naturally occurring amino acid
  misc_feature (11)..(39): Xaa can be any naturally occurring amino acid
ELXXXXXXXRXXXXXXXXXXXXXXXXXXXXXXXXXXXXX

SEQ ID NO: 33395 - protein, 91 aa, Diabrotica virgifera
  misc_feature: Coding regions on vcDNA: vcDNA=SeqID_13092; Strand=-; Position=2-274
  misc_feature (4)..(28): Xaa can be any naturally occurring amino acid
  misc_feature (36)..(67): Xaa can be any naturally occurring amino acid
  misc_feature (70)..(88): Xaa can be any naturally occurring amino acid
FIIXXXXXXXXXXXXXXXXXXXXXXXXXGGRKGEPXXXXXXXXXXXXXXXXXXXXXXXXXXXXXXXXLPXXXXXXXXXXXXXXXXXXXGSF

SEQ ID NO: 33396 - protein, 248 aa, Diabrotica virgifera
  misc_feature: Coding regions on vcDNA: vcDNA=SeqID_13093; Strand=+; Position=64-810
  misc_feature: Homolog annotation: Hit_ID=XP_395243.1; Match level="QueryCoverage =89%, HitCoverage=78%, E-value=6e-52, Identity=46%"; Hit description =similar to CG2608-PA [Apis mellifera]
  misc_feature: Pfam annotation: Pfam_ID=R3H; Match level="Score=26.1, E-value =0.00011, Copies=1"; Pfam description=R3H domain
  misc_feature (33)..(49): Xaa can be any naturally occurring amino acid
  misc_feature (51)..(57): Xaa can be any naturally occurring amino acid
YPQYSSIITIRTVLKMDLLGSIMNSMDKPPSLXXXXXXXXXXXXXXXXXRXXXXXXXLKRFKDRVEAKLLSHFKDTSNLTLKFEPMDQICRSIVHELAEACGLLSFAFGIDGVDRYIRVYKKEYPPCEDELAARRRGEPWNEEVKRRLIEKRRLDNLDDQEQECSSKKSKKFIPNSNYKDKYVHLIGEDAALKAAMKTQTNKSYGYVPSENKKDVRSIEQTMADIMAKKKQKLHTDPSESSSSALSET

SEQ ID NO: 33397 - protein, 71 aa, Diabrotica virgifera
  misc_feature: Coding regions on vcDNA: vcDNA=SeqID_13094; Strand=+; Position=4-216
  misc_feature (6)..(6): Xaa can be any naturally occurring amino acid
  misc_feature (20)..(20): Xaa can be any naturally occurring amino acid
  misc_feature (26)..(26): Xaa can be any naturally occurring amino acid
  misc_feature (33)..(34): Xaa can be any naturally occurring amino acid
  misc_feature (58)..(67): Xaa can be any naturally occurring amino acid
QRNFIXESQIDNKDCDLDVXIKFIIXCSTILIXXLSTFKILHGSEFNPLGSPGLGSIXXXXXXXXXXPQEP

SEQ ID NO: 33398 - protein, 93 aa, Diabrotica virgifera
  misc_feature: Coding regions on vcDNA: vcDNA=SeqID_13095; Strand=+; Position=21-304
  misc_feature: Homolog annotation: Hit_ID=XP_319374.1; Match level="QueryCoverage =61%, HitCoverage=29%, E-value=9e-09, Identity=50%"; Hit description =ENSANGP00000012279 [Anopheles gambiae] ref|XP_307408.1| ENSANGP00000012915 [Anopheles gambiae]
  misc_feature (37)..(37): Xaa can be any naturally occurring amino acid
GGAVAKNGTTKVIASCYHLFAAKTDHAHATYRDTIKXTDTYVLIWEHAPSRSLEEDCVEAKNIGKRRRKDARSLEPPSENASIRPLLPTREAT

SEQ ID NO: 33399 - protein, 273 aa, Diabrotica virgifera
  misc_feature: Coding regions on vcDNA: vcDNA=SeqID_13096; Strand=+; Position=62-883
  misc_feature: Homolog annotation: Hit_ID=EAL29111.1; Match level="QueryCoverage =86%, HitCoverage=24%, E-value=2e-53, Identity=42%"; Hit description =GA20183-PA [Drosophila pseudoobscura]
  misc_feature: Gene Ontology Annotation: Molecular function=protein carrier activity; Cellular component=nuclear pore; Biological process =protein-nucleus import
  misc_feature: Pfam annotation: Pfam_ID=IBN_N; Match level="Score=50.5, E-value=5e -12, Copies=1"; Pfam description=Importin-beta N-terminal domain
MEFTADNLEKAVTLFYRTEAHQQAEAHQWLTEAQNSPLAWSFVWELLNPQRSSEVQFFAATTLHTKLMKHWNEIPEDHYELLKKRILDSIISYASGPKIILNRLCITLSAYIIHTVPNHWPKVFEELVSSFQPQYLPNVEPERVIWILLEILTVIPEEFQRTTLALNQRNRVRQVLQDVSKDILTVVEMCLMPIPAAGFNMGNLTTYLNASRCASAWIQLGGLNMDECNSVNNLLIDLTCYVYWNKSDPEGLSGDMGFDGNNSRSSYSNFSAS

SEQ ID NO: 33400 - protein, 224 aa, Diabrotica virgifera
  misc_feature: Coding regions on vcDNA: vcDNA=SeqID_13097; Strand=-; Position=0-671
  misc_feature (1)..(33): Xaa can be any naturally occurring amino acid
  misc_feature (41)..(58): Xaa can be any naturally occurring amino acid
  misc_feature (60)..(71): Xaa can be any naturally occurring amino acid
  misc_feature (73)..(99): Xaa can be any naturally occurring amino acid
  misc_feature (101)..(141): Xaa can be any naturally occurring amino acid
  misc_feature (143)..(162): Xaa can be any naturally occurring amino acid
  misc_feature (166)..(184): Xaa can be any naturally occurring amino acid
  misc_feature (187)..(206): Xaa can be any naturally occurring amino acid
  misc_feature (210)..(223): Xaa can be any naturally occurring amino acid
XXXXXXXXXXXXXXXXXXXXXXXXXXXXXXXXXVRPQVPCXXXXXXXXXXXXXXXXXXVXXXXXXXXXXXXGXXXXXXXXXXXXXXXXXXXXXXXXXXXNXXXXXXXXXXXXXXXXXXXXXXXXXXXXXXXXXXXXXXXXXGXXXXXXXXXXXXXXXXXXXXPQKXXXXXXXXXXXXXXXXXXXSPXXXXXXXXXXXXXXXXXXXXAHPXXXXXXXXXXXXXXA

SEQ ID NO: 33401 - protein, 144 aa, Diabrotica virgifera
  misc_feature: Coding regions on vcDNA: vcDNA=SeqID_13098; Strand=-; Position=1-432
  misc_feature (1)..(41): Xaa can be any naturally occurring amino acid
  misc_feature (47)..(73): Xaa can be any naturally occurring amino acid
  misc_feature (76)..(82): Xaa can be any naturally occurring amino acid
  misc_feature (84)..(101): Xaa can be any naturally occurring amino acid
  misc_feature (104)..(120): Xaa can be any naturally occurring amino acid
  misc_feature (123)..(144): Xaa can be any naturally occurring amino acid
XXXXXXXXXXXXXXXXXXXXXXXXXXXXXXXXXXXXXXXXXFVWLGXXXXXXXXXXXXXXXXXXXXXXXXXXXGDXXXXXXXPXXXXXXXXXXXXXXXXXXPPXXXXXXXXXXXXXXXXXRGXXXXXXXXXXXXXXXXXXXXXX

SEQ ID NO: 33402 - protein, 98 aa, Diabrotica virgifera
  misc_feature: Coding regions on vcDNA: vcDNA=SeqID_13099; Strand=+; Position=189-485
RIRTFIAKYIFHRIFLQCSAIRCYIYLIFAQIHSSCLLSIYLLLHLLILLILPILRAELHHELLFQFTPLISKLRLQIFLILEYVIIYLTIYHHFYFL

SEQ ID NO: 33403 - protein, 71 aa, Diabrotica virgifera
  misc_feature: Coding regions on vcDNA: vcDNA=SeqID_13100; Strand=+; Position=276-491
  misc_feature (38)..(46): Xaa can be any naturally occurring amino acid
LILHKVNKIKLNTPYPHISNIIKLITIMYIPKNINTLXXXXXXXXXITNKQRLITTYNTTAYQTSQFVYWN

SEQ ID NO: 33404 - protein, 80 aa, Diabrotica virgifera
  misc_feature: Coding regions on vcDNA: vcDNA=SeqID_13101; Strand=-; Position=3-242
  misc_feature (13)..(13): Xaa can be any naturally occurring amino acid
  misc_feature (17)..(27): Xaa can be any naturally occurring amino acid
  misc_feature (37)..(45): Xaa can be any naturally occurring amino acid
  misc_feature (47)..(60): Xaa can be any naturally occurring amino acid
  misc_feature (67)..(79): Xaa can be any naturally occurring amino acid
GNIMLNIKIMLYXWSCXXXXXXXXXXXNQPGSHRCKXXXXXXXXXEXXXXXXXXXXXXXXSNIEVAXXXXXXXXXXXXXC

SEQ ID NO: 33405 - protein, 150 aa, Diabrotica virgifera
  misc_feature: Coding regions on vcDNA: vcDNA=SeqID_13102; Strand=+; Position=72-524
  misc_feature: Homolog annotation: Hit_ID=XP_319927.1; Match level="QueryCoverage =89%, HitCoverage=76%, E-value=1e-33, Identity=50%"; Hit description =ENSANGP00000016845 [Anopheles gambiae]
  misc_feature: Pfam annotation: Pfam_ID=DUF1358; Match level="Score=85.6, E-value =1.3e-22, Copies=1"; Pfam description=Protein of unknown function (DUF1358)
  misc_feature (32)..(38): Xaa can be any naturally occurring amino acid
MAAENVGVSDIKKISDEDRQFKVKAAIFLSGXXXXXXXIGFGATLASAKRQDPKHFGIGMTPTRELSETGASLALRALGWGTLYAFAGCGVLFYGIWKLSGAKNLQEFRYKMGSALPVIPRNNPPQGRTEFSGLNDLLDYLQHQKGVNDK

SEQ ID NO: 33406 - protein, 257 aa, Diabrotica virgifera
  misc_feature: Coding regions on vcDNA: vcDNA=SeqID_13103; Strand=-; Position=0-770
  misc_feature (4)..(14): Xaa can be any naturally occurring amino acid
  misc_feature (23)..(31): Xaa can be any naturally occurring amino acid
  misc_feature (34)..(41): Xaa can be any naturally occurring amino acid
  misc_feature (46)..(46): Xaa can be any naturally occurring amino acid
  misc_feature (53)..(66): Xaa can be any naturally occurring amino acid
  misc_feature (68)..(250): Xaa can be any naturally occurring amino acid
  misc_feature (252)..(256): Xaa can be any naturally occurring amino acid
VPFXXXXXXXXXXXTNLAHTGLXXXXXXXXXSNXXXXXXXXPIINXNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 33407 - protein, 151 aa, Diabrotica virgifera
  misc_feature: Coding regions on vcDNA: vcDNA=SeqID_13104; Strand=-; Position=1-453
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(127): Xaa can be any naturally occurring amino acid
  misc_feature (129)..(150): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXCXXXXXXXXXXXXXXXXXXXXXXI

SEQ ID NO: 33408 - protein, 155 aa, Diabrotica virgifera
  misc_feature: Coding regions on vcDNA: vcDNA=SeqID_13105; Strand=+; Position=2-466
  misc_feature: Homolog annotation: Hit_ID=AAF87760.1; Match level="QueryCoverage =97%, HitCoverage=34%, E-value=9e-50, Identity=68%"; Hit description =cytochrome oxidase subunit I [Diabrotica virgifera zeae]
  misc_feature (19)..(25): Xaa can be any naturally occurring amino acid
  misc_feature (39)..(39): Xaa can be any naturally occurring amino acid
  misc_feature (47)..(63): Xaa can be any naturally occurring amino acid
  misc_feature (93)..(93): Xaa can be any naturally occurring amino acid
  misc_feature (109)..(116): Xaa can be any naturally occurring amino acid
  misc_feature (137)..(137): Xaa can be any naturally occurring amino acid
GRVGSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 33409 - protein, 176 aa, Diabrotica virgifera
  misc_feature: Coding regions on vcDNA: vcDNA=SeqID_13106; Strand=-; Position=3-530
  misc_feature (16)..(176): Xaa can be any naturally occurring amino acid
INSIGSLVCKKIKLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33410 - protein, 40 aa, Diabrotica virgifera
  misc_feature: Coding regions on vcDNA: vcDNA=SeqID_13107; Strand=-; Position=90-212
YISRYIYLYDIYSYISRLYVYRSRQSSVVGTHYIDENSCV

SEQ ID NO: 33411 - protein, 17 aa, Diabrotica virgifera
  misc_feature: Coding regions on vcDNA: vcDNA=SeqID_13108; Strand=+; Position=1-51
  misc_feature (13)..(13): Xaa can be any naturally occurring amino acid
VKKITFFYKTRDXYRVL

SEQ ID NO: 33412 - protein, 33 aa, Diabrotica virgifera
  misc_feature: Coding regions on vcDNA: vcDNA=SeqID_13109; Strand=+; Position=1-102
  misc_feature (3)..(14): Xaa can be any naturally occurring amino acid
PSXXXXXXXXXXXXVYTLLISFFSINFTYIIII

SEQ ID NO: 33413 - protein, 57 aa, Diabrotica virgifera
  misc_feature: Coding regions on vcDNA: vcDNA=SeqID_13110; Strand=+; Position=719-892
VHKLVYYLYRCCFSLKKYRPLAITTNVVSALGVVKNLIYHKLNIIRTPCGSDVDNDQ

SEQ ID NO: 33414 - protein, 50 aa, Diabrotica virgifera
  misc_feature: Coding regions on vcDNA: vcDNA=SeqID_13111; Strand=-; Position=1-150
  misc_feature (3)..(47): Xaa can be any naturally occurring amino acid
INXXXXXXXXXXXXXXXXXXXXXXXXXXXXXXXXXXXXXXXXXXXXXKKM

SEQ ID NO: 33415 - protein, 40 aa, Diabrotica virgifera
  misc_feature: Coding regions on vcDNA: vcDNA=SeqID_13112; Strand=+; Position=1-120
  misc_feature (9)..(27): Xaa can be any naturally occurring amino acid
VTKLTFFYXXXXXXXXXXXXXXXXXXXNYSLYNLFNCRDY

SEQ ID NO: 33416 - protein, 31 aa, Diabrotica virgifera
  misc_feature: Coding regions on vcDNA: vcDNA=SeqID_13113; Strand=-; Position=1-93
  misc_feature (6)..(14): Xaa can be any naturally occurring amino acid
  misc_feature (23)..(30): Xaa can be any naturally occurring amino acid
IINRYXXXXXXXXXMSCNNNIIXXXXXXXXS

SEQ ID NO: 33417 - protein, 164 aa, Diabrotica virgifera
  misc_feature: Coding regions on vcDNA: vcDNA=SeqID_13114; Strand=-; Position=0-491
  misc_feature (3)..(20): Xaa can be any naturally occurring amino acid
  misc_feature (43)..(56): Xaa can be any naturally occurring amino acid
  misc_feature (62)..(70): Xaa can be any naturally occurring amino acid
  misc_feature (72)..(90): Xaa can be any naturally occurring amino acid
  misc_feature (94)..(148): Xaa can be any naturally occurring amino acid
  misc_feature (152)..(161): Xaa can be any naturally occurring amino acid
PPXXXXXXXXXXXXXXXXXXTNIYIKYSPPPPRAGGGGGARGXXXXXXXXXXXXXXPTTQPXXXXXXXXXGXXXXXXXXXXXXXXXXXXXHQKXXXXXXXXXXXXXXXXXXXXXXXXXXXXXXXXXXXXXXXXXXXXXXXXXXXXXXXTKQXXXXXXXXXXHPP

SEQ ID NO: 33418 - protein, 90 aa, Diabrotica virgifera
  misc_feature: Coding regions on vcDNA: vcDNA=SeqID_13115; Strand=-; Position=267-539
ILRLKNNTLSKYVIIKYSIVIRCITIFNIKFLFHKIISIRGIHINKVCGIQIKIKINTEALVPFQINRLVSRHWCPPLVVLQLRKRNTGG

SEQ ID NO: 33419 - protein, 296 aa, Diabrotica virgifera
  misc_feature: Coding regions on vcDNA: vcDNA=SeqID_13116; Strand=+; Position=3-890
  misc_feature: Homolog annotation: Hit_ID=XP_308743.1; Match level="QueryCoverage =87%, HitCoverage=49%, E-value=2e-56, Identity=45%"; Hit description =ENSANGP00000015016 [Anopheles gambiae]
  misc_feature: Gene Ontology Annotation: Cellular component=membrane fraction; Biological process=steroid metabolism
  misc_feature: Pfam annotation: Pfam_ID=UDPGT; Match level="Score=-165.9, E-value =0.025, Copies=1"; Pfam description=UDP-glucoronosyl and UDP-glucosyl tra
RGIHSFSKKRNHYEADFINKVTYLLGLHNAVFPIIEKTLQHDNFQNLIKSGTEQFDVVVVEQFHSDAFKALAWYYNAHLVVLSPGASSCGTNSLVGSPTELAYNPMPYTNFPTDMNFFQRVHNTIIYSFEYLANQLYFLPQHNQLIQQHFPGCPDIFELLTNVSLVLTNSHESFTPSKPLVPNLINVGGLHIQPAGILPENLQRYLDESTDGVIYFSMGSHLKSSGMSFDKMQYFIQAFKRLKQNVLWKWEAEVLPGKPANVRIEKWVPQMGVLAHPNVKVFITHGGLLSFYESIL

SEQ ID NO: 33420 - protein, 70 aa, Diabrotica virgifera
  misc_feature: Coding regions on vcDNA: vcDNA=SeqID_13117; Strand=-; Position=137-349
  misc_feature (18)..(25): Xaa can be any naturally occurring amino acid
IQWSLEDYHIRLWSYSSXXXXXXXXRTYPGKCNEVLRRIVLIGEYLAAHGPGNEDQYFSLIVSKTYHFTH

SEQ ID NO: 33421 - protein, 278 aa, Diabrotica virgifera
  misc_feature: Coding regions on vcDNA: vcDNA=SeqID_13118; Strand=+; Position=3-839
  misc_feature: Homolog annotation: Hit_ID=NP_610568.1; Match level="QueryCoverage =62%, HitCoverage=68%, E-value=5e-19, Identity=37%"; Hit description =CG12911-PA [Drosophila melanogaster] gb|AAF58818.2| CG12911-PA [Drosophila melanogaster]
DSFYSIVTVFSGKYSIKSIHLPTVLLVLVAALHNGHSATLTDVLLSDESNKPQEISSDEFIPPLRLSRDVKYPRYAADNTDKDLKPEDSPDRDRDSGSAPPGKRCISCFASYPQYSNNPSYDRNRYYYDDRSRDRDYDRYDDRDRDRYNERDRYYYRDPYYDRYDRYNDRDRYYSRGRDRYGDRDRYYDPYDYDRYDPYERYDRYGDRQYDRYDRDRYDTRYSDRGIGYDNKGYDYRINDPYNKGNDDYNRGYSGRPDYGTSGYASKWNYGSSGGGRG

SEQ ID NO: 33422 - protein, 21 aa, Diabrotica virgifera
  misc_feature: Coding regions on vcDNA: vcDNA=SeqID_13119; Strand=+; Position=1-63
VIFTYYNYFVTGQVNKSYLVL

SEQ ID NO: 33423 - protein, 37 aa, Diabrotica virgifera
  misc_feature: Coding regions on vcDNA: vcDNA=SeqID_13120; Strand=-; Position=1-111
  misc_feature (2)..(35): Xaa can be any naturally occurring amino acid
TXXXXXXXXXXXXXXXXXXXXXXXXXXXXXXXXXXAF

SEQ ID NO: 33424 - protein, 145 aa, Diabrotica virgifera
  misc_feature: Coding regions on vcDNA: vcDNA=SeqID_13121; Strand=+; Position=1-438
  misc_feature: Homolog annotation: Hit_ID=AAO37649.1; Match level="QueryCoverage =97%, HitCoverage=10%, E-value=7e-38, Identity=53%"; Hit description =ATP-binding cassette transporter C4 [Homo sapiens] emb|CAI16722.1| ATP-binding cassette, sub-family C (CFT
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=7.9, E-value =1.3e-06, Copies=1"; Pfam description=ABC transporter
IRSNLDPFNKFNDEELWSAIDKANLKSFILDLDSKIIASSSSLSLGQKQMFCVARAIISNAKIIVLDEATANMDNETQTLVNKSIRDNFSGCTVLTIAHRLENIIESDKILVMDRGEVREYANPEQLLKNKESYFSKMVQKTLNY

SEQ ID NO: 33425 - protein, 61 aa, Diabrotica virgifera
  misc_feature: Coding regions on vcDNA: vcDNA=SeqID_13122; Strand=-; Position=65-250
FAYLGNPCNISKQILQNTNRCLQYLKSYCFFFSCNLAACYLHKTLLPIILMERNKIHRIEC

SEQ ID NO: 33426 - protein, 39 aa, Diabrotica virgifera
  misc_feature: Coding regions on vcDNA: vcDNA=SeqID_13123; Strand=-; Position=0-116
VILIFNKIYKATKVLTIYLESRSYKYKNVCYFLNSLDLL

SEQ ID NO: 33427 - protein, 34 aa, Diabrotica virgifera
  misc_feature: Coding regions on vcDNA: vcDNA=SeqID_13124; Strand=-; Position=1-102
  misc_feature (3)..(4): Xaa can be any naturally occurring amino acid
  misc_feature (7)..(33): Xaa can be any naturally occurring amino acid
HPXXKIXXXXXXXXXXXXXXXXXXXXXXXXXXXK

SEQ ID NO: 33428 - protein, 106 aa, Diabrotica virgifera
  misc_feature: Coding regions on vcDNA: vcDNA=SeqID_13125; Strand=+; Position=3-323
  misc_feature (29)..(38): Xaa can be any naturally occurring amino acid
LILSLMSLNVYFCVATKDICRATRRQEVXXXXXXXXXXQDSENKLKILRQFFENLLPGSSDSRVYCRMAKGLRNKVDYYFLIYSYYRVIFERLFFNTHMQNSCLCK

SEQ ID NO: 33429 - protein, 164 aa, Diabrotica virgifera
  misc_feature: Coding regions on vcDNA: vcDNA=SeqID_13126; Strand=+; Position=627 -1118
  misc_feature (13)..(19): Xaa can be any naturally occurring amino acid
  misc_feature (49)..(60): Xaa can be any naturally occurring amino acid
  misc_feature (95)..(118): Xaa can be any naturally occurring amino acid
  misc_feature (122)..(132): Xaa can be any naturally occurring amino acid
  misc_feature (148)..(161): Xaa can be any naturally occurring amino acid
NGLISQKIKLQCXXXXXXXIITKTMDGLKAPTNILQYISSITKLELFGXXXXXXXXXXXXFFIKSSSWHQTKMKLSNLCVKNIKFDKNKVPLLLXXXXXXXXXXXXXXXXXXXXXXXXLLFXXXXXXXXXXXTVQKNGIYFPFPKLTXXXXXXXXXXXXXXVFQ

SEQ ID NO: 33430 - protein, 87 aa, Diabrotica virgifera
  misc_feature: Coding regions on vcDNA: vcDNA=SeqID_13127; Strand=+; Position=429-692
  misc_feature (60)..(67): Xaa can be any naturally occurring amino acid
LINILEDTKLNERLCTTPVVLEIGGVSSFLGARLNLPETTMRRIQVALVIGIWGRSGRSXXXXXXXXLLMHLNLSSHSTITMRQSLK

SEQ ID NO: 33431 - protein, 43 aa, Diabrotica virgifera
  misc_feature: Coding regions on vcDNA: vcDNA=SeqID_13128; Strand=-; Position=2-133
KVGQALIKLLVPANYKLYSNIGGRQSLFSDLNFPIKITLLSLK

SEQ ID NO: 33432 - protein, 104 aa, Diabrotica virgifera
  misc_feature: Coding regions on vcDNA: vcDNA=SeqID_13129; Strand=-; Position=22-336
YLAIDGVYLPHRAALSSKPPNEERSYRNRCRSLRSWHPLPAATHVTSAMDSPHDIRIHVPSDTPTIPGDRYTTRDLGDRFIPLCSLIIRESHLAYLPLPSNKGR

SEQ ID NO: 33433 - protein, 80 aa, Diabrotica virgifera
  misc_feature: Coding regions on vcDNA: vcDNA=SeqID_13130; Strand=-; Position=299-541
  misc_feature (15)..(23): Xaa can be any naturally occurring amino acid
TWKSYLEKLGKKWIXXXXXXXXXVKNHQKHEYRKIISKFSIPAMLLKKQVPNKPHQFSNAILKGCPIKILICQYIYRKYT

SEQ ID NO: 33434 - protein, 29 aa, Diabrotica virgifera
  misc_feature: Coding regions on vcDNA: vcDNA=SeqID_13131; Strand=+; Position=1-87
  misc_feature (1)..(5): Xaa can be any naturally occurring amino acid
  misc_feature (7)..(7): Xaa can be any naturally occurring amino acid
  misc_feature (9)..(18): Xaa can be any naturally occurring amino acid
  misc_feature (22)..(29): Xaa can be any naturally occurring amino acid
XXXXXYXIXXXXXXXXXXLFIXXXXXXXX

SEQ ID NO: 33435 - protein, 71 aa, Diabrotica virgifera
  misc_feature: Coding regions on vcDNA: vcDNA=SeqID_13132; Strand=-; Position=0-212
TEKIRPITTYIRFTNICIEIGADISKLNHFYILHVTKGKVANMPTFNLNTSLKSNQIFCYDNCIFNGYILT

SEQ ID NO: 33436 - protein, 89 aa, Diabrotica virgifera
  misc_feature: Coding regions on vcDNA: vcDNA=SeqID_13133; Strand=-; Position=266-535
TLQPYTSALVKGGQFIICFTFNQTSFVQGDIIIPHLPVLLKLHIFKMRLIVHHRLLGDRPYITYIVKKILFYTKVHIFPILNWYFITYH

SEQ ID NO: 33437 - protein, 116 aa, Diabrotica virgifera
  misc_feature: Coding regions on vcDNA: vcDNA=SeqID_13134; Strand=-; Position=1-348
  misc_feature (1)..(42): Xaa can be any naturally occurring amino acid
  misc_feature (44)..(85): Xaa can be any naturally occurring amino acid
  misc_feature (89)..(116): Xaa can be any naturally occurring amino acid
XXXXXXXXXXXXXXXXXXXXXXXXXXXXXXXXXXXXXXXXXXEXXXXXXXXXXXXXXXXXXXXXXXXXXXXXXXXXXXXXXXXXXPSPXXXXXXXXXXXXXXXXXXXXXXXXXXXX

SEQ ID NO: 33438 - protein, 293 aa, Diabrotica virgifera
  misc_feature: Coding regions on vcDNA: vcDNA=SeqID_13135; Strand=+; Position=3-881
  misc_feature: Homolog annotation: Hit_ID=EAA14478.2; Match level="QueryCoverage =71%, HitCoverage=61%, E-value=6e-23, Identity=34%"; Hit description =ENSANGP00000014394 [Anopheles gambiae str. PEST] ref|XP_553612.1| ENSANGP00000014394 [Anopheles gambiae st
FVVALLRVSNGEIFDFADEDPLNSVWPQGERIKLKTTECQVQTQNGVKWGQCVPYASCLLSQGTPNGFCGILQTCCVYESTCGKTSNAKVSYFETTELGNGQTNCEYIVNLRNKNICQIRLDFIKFNLAPATLTTPQYASYKSYRCVDDIFRVTPNHFNIPDLCGNNDKQHVYIHVNQTDGVTKGVQLQMTLANRNYNPLLFSPTWRIKITQLECPGHRSGINFGENKDIIEDFPLLAPLGAIQYFSESTGYIKSFGFDGSVSNPQSYTYGQQYAIAFKREIGVCGIRFVPDY

SEQ ID NO: 33439 - protein, 168 aa, Diabrotica virgifera
  misc_feature: Coding regions on vcDNA: vcDNA=SeqID_13136; Strand=-; Position=2-505
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(168): Xaa can be any naturally occurring amino acid
PFXXXXXXXXXXXTNLAHSGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33440 - protein, 184 aa, Diabrotica virgifera
  misc_feature: Coding regions on vcDNA: vcDNA=SeqID_13137; Strand=+; Position=2-553
  misc_feature (1)..(158): Xaa can be any naturally occurring amino acid
  misc_feature (161)..(161): Xaa can be any naturally occurring amino acid
  misc_feature (170)..(179): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQEXLFLTLKRFXXXXXXXXXXHRVFI

SEQ ID NO: 33441 - protein, 241 aa, Diabrotica virgifera
  misc_feature: Coding regions on vcDNA: vcDNA=SeqID_13138; Strand=+; Position=51-776
  misc_feature: Homolog annotation: Hit_ID=XP_319587.1; Match level="QueryCoverage =93%, HitCoverage=47%, E-value=6e-14, Identity=24%"; Hit description =ENSANGP00000016661 [Anopheles gambiae]
  misc_feature: Pfam annotation: Pfam_ID=zf-AD; Match level="Score=72.0, E-value=1.7e- 18, Copies=1"; Pfam description=Zinc-finger associated domain (zf-AD)
  misc_feature (3)..(3): Xaa can be any naturally occurring amino acid
KTXRTCLLEKANLKPLFEACVANMLMSCSAIQVIQGDGLPNQICTQCLQSVNRAYTFKQLCEKSDMALRSYLSINLQPIALPTENLINEVKSDLFSTSEVLQQSSLFQDIFNDATTHSFVETFTNQNTSTDLAETMQSLQTIAEQCLPESWESDGNIVPCNSDEATDNFSLDALYKCQFCENIFKDEWSLSEHLKIHTIQHRYFCNMCDKIYDDSNELNKHIIEHTFIDNQKSQDIDHTSF

SEQ ID NO: 33442 - protein, 93 aa, Diabrotica virgifera
  misc_feature: Coding regions on vcDNA: vcDNA=SeqID_13139; Strand=-; Position=0-278
  misc_feature (4)..(10): Xaa can be any naturally occurring amino acid
  misc_feature (31)..(38): Xaa can be any naturally occurring amino acid
  misc_feature (57)..(91): Xaa can be any naturally occurring amino acid
PRRXXXXXXXAGFPPQIKKNLLNSNPWGGVXXXXXXXXFGTFSQYKNLPLVIPPKGXXXXXXXXXXXXXXXXXXXXXXXXXXXXXXXXXXXPP

SEQ ID NO: 33443 - protein, 34 aa, Diabrotica virgifera
  misc_feature: Coding regions on vcDNA: vcDNA=SeqID_13140; Strand=+; Position=1-102
  misc_feature (1)..(13): Xaa can be any naturally occurring amino acid
  misc_feature (16)..(30): Xaa can be any naturally occurring amino acid
  misc_feature (34)..(34): Xaa can be any naturally occurring amino acid
XXXXXXXXXXXXXLFXXXXXXXXXXXXXXXLICX

SEQ ID NO: 33444 - protein, 69 aa, Diabrotica virgifera
  misc_feature: Coding regions on vcDNA: vcDNA=SeqID_13141; Strand=-; Position=2-208
  misc_feature (5)..(16): Xaa can be any naturally occurring amino acid
  misc_feature (26)..(33): Xaa can be any naturally occurring amino acid
  misc_feature (36)..(49): Xaa can be any naturally occurring amino acid
  misc_feature (55)..(68): Xaa can be any naturally occurring amino acid
IFGPXXXXXXXXXXXXTNLAHTGVNXXXXXXXXSNXXXXXXXXXXXXXXPTSRSXXXXXXXXXXXXXXV

SEQ ID NO: 33445 - protein, 302 aa, Diabrotica virgifera
  misc_feature: Coding regions on vcDNA: vcDNA=SeqID_13142; Strand=+; Position=1-905
  misc_feature: Homolog annotation: Hit_ID=NP_652705.1; Match level="QueryCoverage =98%, HitCoverage=94%, E-value=1e-71, Identity=34%"; Hit description =CG1915-PC, isoform C [Drosophila melanogaster] gb|AAG22226.2| CG1915- PC, isoform C [Drosophila
  misc_feature: Gene Ontology Annotation: Molecular function=structural constituent of muscle; Cellular component=cytoskeleton; Biological process =mitotic chromosome condensation
  misc_feature: Pfam annotation: Pfam_ID=I-set; Match level="Score=106.9, E-value =5.1e-29, Copies=1"; Pfam description=Immunoglobulin I-set domain
  misc_feature (179)..(212): Xaa can be any naturally occurring amino acid
  misc_feature (283)..(283): Xaa can be any naturally occurring amino acid
  misc_feature (285)..(285): Xaa can be any naturally occurring amino acid
PYASARNREGEASVTFTLKIKKIKKTQEGKFKIVARNREGEASVTFTLKVITSEKEAPEVLSPLESITVRKGEPVTLSTTIFGNPEPTIEWLKDGKPLTRPKFKKDGNTYTLTIPKTSTDDTATYTVRATNSMGTIETSANLTVEEFPENQEPPLFVKRFEEQTVPQKSPLTLKAKVVXXXXXXXXXXXXXXXXXXXXXXXXXXXXXXXXXXIKETNSELDSGDYKCIAVNPAGKASHGAKVSIEVDTVKFTKELKEVYETIERKTIELECETSHSVRTKWWXHXTEISGMDHRVVVQDGRT

SEQ ID NO: 33446 - protein, 141 aa, Diabrotica virgifera
  misc_feature: Coding regions on vcDNA: vcDNA=SeqID_13143; Strand=+; Position=89-514
  misc_feature (10)..(16): Xaa can be any naturally occurring amino acid
  misc_feature (30)..(92): Xaa can be any naturally occurring amino acid
QNMLFLYKKXXXXXXXVSGIIPPHLYPYYXXXXXXXXXXXXXXXXXXXXXXXXXXXXXXXXXXXXXXXXXXXXXXXXXXXXXXXXXXXXXXXDELNPRILLKFPCYVRIRINHLHILNHHIILVHLSLFLSPIHSCSRYKF

SEQ ID NO: 33447 - protein, 55 aa, Diabrotica virgifera
  misc_feature: Coding regions on vcDNA: vcDNA=SeqID_13144; Strand=+; Position=3-167
  misc_feature (2)..(32): Xaa can be any naturally occurring amino acid
FXXXXXXXXXXXXXXXXXXXXXXXXXXXXXXXFLEQFFWIITINYLKGYNRNFIG

SEQ ID NO: 33448 - protein, 61 aa, Diabrotica virgifera
  misc_feature: Coding regions on vcDNA: vcDNA=SeqID_13145; Strand=+; Position=114-299
LSEKLILRNVFVIATHRTANTLMPPLHDSADESLTNVPTKYATASIPHERNDDIITSRTSE

SEQ ID NO: 33449 - protein, 18 aa, Diabrotica virgifera
  misc_feature: Coding regions on vcDNA: vcDNA=SeqID_13146; Strand=+; Position=3-59
RRKVTCVYLSTLMDLLHQ

SEQ ID NO: 33450 - protein, 295 aa, Diabrotica virgifera
  misc_feature: Coding regions on vcDNA: vcDNA=SeqID_13147; Strand=+; Position=15-900
  misc_feature: Homolog annotation: Hit_ID=XP_320319.1; Match level="QueryCoverage =92%, HitCoverage=45%, E-value=7e-69, Identity=51%"; Hit description =ENSANGP00000016591 [Anopheles gambiae]
  misc_feature: Gene Ontology Annotation: Molecular function=permease activity; Cellular component=cellular_component unknown; Biological process =biological_process unknown
  misc_feature: Pfam annotation: Pfam_ID=MFS_1; Match level="Score=-8.5, E-value =0.0075, Copies=1"; Pfam description=Major Facilitator Superfamily
  misc_feature (213)..(213): Xaa can be any naturally occurring amino acid
  misc_feature (244)..(244): Xaa can be any naturally occurring amino acid
  misc_feature (256)..(257): Xaa can be any naturally occurring amino acid
  misc_feature (265)..(265): Xaa can be any naturally occurring amino acid
  misc_feature (270)..(270): Xaa can be any naturally occurring amino acid
  misc_feature (275)..(275): Xaa can be any naturally occurring amino acid
  misc_feature (278)..(278): Xaa can be any naturally occurring amino acid
MKVSNVCTEKFAGSEDDNLLHKGLKETSKKEEAIQRRKEILAQVFVTSAVMLSAASCGMPVGYSAVLLPQLKFMNDSMQIDDEMGSWIASIHSAATPLGSLLSGILMERCGRKLALQIASMPLIFGWFLIAFSLNHSILLLGRLIAGFSAGLTAAAGQVLIGEISEPRLRGLFSSVPLASYSFGILLVYALGSLLPWRYVAVSSTVLPVIITXMVFFFLPESPVWLTRQEKLEDAKKALVWLRXGNKIKAKQEMQXXVDRLESEXKSQTXSNITXSLXPEVLKPLIIYNVFYILQ

SEQ ID NO: 33451 - protein, 62 aa, Diabrotica virgifera
  misc_feature: Coding regions on vcDNA: vcDNA=SeqID_13148; Strand=-; Position=2-187
  misc_feature (1)..(21): Xaa can be any naturally occurring amino acid
  misc_feature (24)..(47): Xaa can be any naturally occurring amino acid
  misc_feature (49)..(62): Xaa can be any naturally occurring amino acid
XXXXXXXXXXXXXXXXXXXXXTPXXXXXXXXXXXXXXXXXXXXXXXXIXXXXXXXXXXXXXX

SEQ ID NO: 33452 - protein, 78 aa, Diabrotica virgifera
  misc_feature: Coding regions on vcDNA: vcDNA=SeqID_13149; Strand=+; Position=1-237
QLILLQLIIVIFGQAFSNFFNGLPKRTFETHYAVSVTPTLFLTAVILPIPATLASLGQALYHLSLRSSFSQIILQLLL

SEQ ID NO: 33453 - protein, 141 aa, Diabrotica virgifera
  misc_feature: Coding regions on vcDNA: vcDNA=SeqID_13150; Strand=+; Position=1-423
  misc_feature (1)..(135): Xaa can be any naturally occurring amino acid
  misc_feature (138)..(138): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLXDTA

SEQ ID NO: 33454 - protein, 177 aa, Diabrotica virgifera
  misc_feature: Coding regions on vcDNA: vcDNA=SeqID_13151; Strand=-; Position=3-533
  misc_feature (5)..(17): Xaa can be any naturally occurring amino acid
  misc_feature (19)..(29): Xaa can be any naturally occurring amino acid
  misc_feature (39)..(47): Xaa can be any naturally occurring amino acid
  misc_feature (49)..(62): Xaa can be any naturally occurring amino acid
  misc_feature (69)..(81): Xaa can be any naturally occurring amino acid
  misc_feature (83)..(177): Xaa can be any naturally occurring amino acid
VIRNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33455 - protein, 164 aa, Diabrotica virgifera
  misc_feature: Coding regions on vcDNA: vcDNA=SeqID_13152; Strand=+; Position=2-496
  misc_feature: Homolog annotation: Hit_ID=XP_307685.1; Match level="QueryCoverage =100%, HitCoverage=65%, E-value=1e-67, Identity=64%"; Hit description= ENSANGP00000017097 [Anopheles gambiae]
  misc_feature: Pfam annotation: Pfam_ID=3HCDH; Match level="Score=181.7, E-value =1.6e-51, Copies=1"; Pfam description=3-hydroxyacyl-CoA dehydrogenase, C-te
SIAEIASVTKRLDRFGGLHFFNPVPMMKLLEVIRISETSDQTYNAMMAWGKSIGKVCITCKDTPGFVVNRLLVPYVAEAVRMLERGDASAQDIDTAMKLGAGYPMGPLELADYTGLDTGVFVLEGWHKKFPENPLFNPVELQKKLVKEGKLGRKTGQGFYKYTK

SEQ ID NO: 33456 - protein, 108 aa, Diabrotica virgifera; identical to SEQ ID NO: 27732
  misc_feature: Coding regions on vcDNA: vcDNA=SeqID_13153; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33457 - protein, 56 aa, Diabrotica virgifera
  misc_feature: Coding regions on vcDNA: vcDNA=SeqID_13154; Strand=-; Position=1-168
  misc_feature (2)..(2): Xaa can be any naturally occurring amino acid
  misc_feature (6)..(25): Xaa can be any naturally occurring amino acid
  misc_feature (30)..(55): Xaa can be any naturally occurring amino acid
NXIIIXXXXXXXXXXXXXXXXXXXXSSRLXXXXXXXXXXXXXXXXXXXXXXXXXXP

SEQ ID NO: 33458 - protein, 75 aa, Diabrotica virgifera
  misc_feature: Coding regions on vcDNA: vcDNA=SeqID_13155; Strand=-; Position=446-673
IFTNFYKVTRFFAAKTNDVDEDSADLIYEALEKISLNVFCALNSILQSLDLNIRINHNLFVIKKNFHSIPPICNI

SEQ ID NO: 33459 - protein, 44 aa, Diabrotica virgifera
  misc_feature: Coding regions on vcDNA: vcDNA=SeqID_13156; Strand=-; Position=1-132
  misc_feature (2)..(9): Xaa can be any naturally occurring amino acid
  misc_feature (11)..(19): Xaa can be any naturally occurring amino acid
  misc_feature (30)..(42): Xaa can be any naturally occurring amino acid
TXXXXXXXXEXXXXXXXXXNYKLNPTSRSXXXXXXXXXXXXXLL

SEQ ID NO: 33460 - protein, 66 aa, Diabrotica virgifera; identical to SEQ ID NO: 26808
  misc_feature: Coding regions on vcDNA: vcDNA=SeqID_13157; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33461 - protein, 227 aa, Diabrotica virgifera
  misc_feature: Coding regions on vcDNA: vcDNA=SeqID_13158; Strand=+; Position=53-736
  misc_feature: Homolog annotation: Hit_ID=XP_396159.1; Match level="QueryCoverage =96%, HitCoverage=95%, E-value=1e-89, Identity=71%"; Hit description =similar to MGC68689 protein [Apis mellifera]
  misc_feature: Gene Ontology Annotation: Molecular function=transcription factor activity; Cellular component=nucleus; Biological process=biological _process unknown
  misc_feature: Pfam annotation: Pfam_ID=YEATS; Match level="Score=153.3, E-value =5.5e-43, Copies=1"; Pfam description=YEATS family
MSLPTDFGPDSGGRMKGICIVKPLVYGNIARYFGKKREEDGHTHQWTVYVKPYNNEDMSTYIKKVQFKLHESYANQNRIVVKPPYELSETGWGEFEIVIKIYFHDPNERPVTMYHILKLFHSGNTQDIGIEQSKGLVSESYDEIIFQDPTQLMHHLLTNVKHLPVGRWDHNTNFEEKKEKTLKSILEAKQKIRNEILNLKNKLKLAKETISSFKEEIAKSQDNQFVM

SEQ ID NO: 33462 - protein, 43 aa, Diabrotica virgifera
  misc_feature: Coding regions on vcDNA: vcDNA=SeqID_13159; Strand=-; Position=2-130
  misc_feature (7)..(27): Xaa can be any naturally occurring amino acid
  misc_feature (31)..(42): Xaa can be any naturally occurring amino acid
ICDHPKXXXXXXXXXXXXXXXXXXXXXNSIXXXXXXXXXXXXY

SEQ ID NO: 33463 - protein, 256 aa, Diabrotica virgifera
  misc_feature: Coding regions on vcDNA: vcDNA=SeqID_13160; Strand=+; Position=131-898
  misc_feature: Homolog annotation: Hit_ID=EAL25852.1; Match level="QueryCoverage =92%, HitCoverage=12%, E-value=4e-14, Identity=23%"; Hit description =GA21308-PA [Drosophila pseudoobscura]
MSLTIWMRVYPIIGPKEQHVGEHVVKEVMDICKKHITDVLQMYRPYTREAFILWRDTCYCKEIVEDDEMCNFVHTLSRRMNLCANQTWDTICNFLVYEYHGKRDELKNIIRFNSKLDILIERIWDFYSLERLFLVKTLRHILENADNKFDRHYKKFQAFLSAVDMSKLWKMSVQSFKELTKEISKQSCHLVTEDLLKEWIHRNNREQVEMVFILMDILPRYKLVQGDIEKFLSICIRHFFGRAPLYPDSLYLEKMI

SEQ ID NO: 33464 - protein, 78 aa, Diabrotica virgifera
  misc_feature: Coding regions on vcDNA: vcDNA=SeqID_13161; Strand=-; Position=2-235
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
XXXXXXXXXXXXPLXXXXXXXXXXXTNLAHTGLNXXXXXXXXSNXXXXXXXXXXXXXXPTSRSXXXXXXXXXXXXXXV

SEQ ID NO: 33465 - protein, 30 aa, Diabrotica virgifera
  misc_feature: Coding regions on vcDNA: vcDNA=SeqID_13162; Strand=-; Position=0-89
  misc_feature (1)..(11): Xaa can be any naturally occurring amino acid
  misc_feature (18)..(29): Xaa can be any naturally occurring amino acid
XXXXXXXXXXXDTKKLSXXXXXXXXXXXXG

SEQ ID NO: 33466 - protein, 74 aa, Diabrotica virgifera
  misc_feature: Coding regions on vcDNA: vcDNA=SeqID_13163; Strand=+; Position=490-714
  misc_feature (22)..(28): Xaa can be any naturally occurring amino acid
EYYLEKKPASVEFVLRRFLRKXXXXXXXECIMKKKWKSGEFGFKECIIAGIWKKHMKGSYWEKNFRRCGNLFLK

SEQ ID NO: 33467 - protein, 84 aa, Diabrotica virgifera
  misc_feature: Coding regions on vcDNA: vcDNA=SeqID_13164; Strand=+; Position=205-459
MLRILLLHLLSQIMFLKRIVILLPPPLIILKTRLNIFINLTSILNHFYLIRIKNFYLLNLDFYINSNFYYQLRFSISLFPQYNI

SEQ ID NO: 33468 - protein, 305 aa, Diabrotica virgifera
  misc_feature: Coding regions on vcDNA: vcDNA=SeqID_13165; Strand=-; Position=2-916
  misc_feature (31)..(39): Xaa can be any naturally occurring amino acid
  misc_feature (50)..(56): Xaa can be any naturally occurring amino acid
  misc_feature (145)..(301): Xaa can be any naturally occurring amino acid
KTQTFLNQFSTLLGFFSHYLLSCFFSNFLQXXXXXXXXXHFYDFSPLCTXXXXXXXPALKIFLKHISHFRFFSPTCSVIRVFKLLPTLTSLILISHLNEFFFIIHSQMIYNSQSLLNLLILISPSLLISHILTFFFHIKFITNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGPGV

SEQ ID NO: 33469 - protein, 57 aa, Diabrotica virgifera
  misc_feature: Coding regions on vcDNA: vcDNA=SeqID_13166; Strand=-; Position=1-171
  misc_feature (12)..(19): Xaa can be any naturally occurring amino acid
  misc_feature (33)..(33): Xaa can be any naturally occurring amino acid
  misc_feature (43)..(52): Xaa can be any naturally occurring amino acid
DRNHLGFHRFKXXXXXXXXSTRLNLYSCYTNYXTLIQTSRSAXXXXXXXXXXKITLL

SEQ ID NO: 33470 - protein, 70 aa, Diabrotica virgifera
  misc_feature: Coding regions on vcDNA: vcDNA=SeqID_13167; Strand=+; Position=55-267
ARRFLEYIGWHLLIILLFTQLGVHKSLERILSGGCYITIMPGAEIFHFARRNILSRNESIYIRVAWFVAI

SEQ ID NO: 33471 - protein, 312 aa, Diabrotica virgifera
  misc_feature: Coding regions on vcDNA: vcDNA=SeqID_13168; Strand=-; Position=0-935
  misc_feature (2)..(309): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPG

SEQ ID NO: 33472 - protein, 58 aa, Diabrotica virgifera
  misc_feature: Coding regions on vcDNA: vcDNA=SeqID_13169; Strand=-; Position=153-329
QLQYDLIHVLGYLLSSSLFSLHIQYHCRAVITLFTYLVFCTFILYVIISNFKIIHLIL

SEQ ID NO: 33473 - protein, 156 aa, Diabrotica virgifera
  misc_feature: Coding regions on vcDNA: vcDNA=SeqID_13170; Strand=-; Position=1-468
  misc_feature (9)..(17): Xaa can be any naturally occurring amino acid
  misc_feature (24)..(34): Xaa can be any naturally occurring amino acid
  misc_feature (36)..(117): Xaa can be any naturally occurring amino acid
  misc_feature (122)..(122): Xaa can be any naturally occurring amino acid
  misc_feature (128)..(138): Xaa can be any naturally occurring amino acid
  misc_feature (143)..(151): Xaa can be any naturally occurring amino acid
CTYKTLLVXXXXXXXXXLFISKIXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXELNLXIIIILXXXXXXXXXXXILIKXXXXXXXXXRTPVG

SEQ ID NO: 33474 - protein, 278 aa, Diabrotica virgifera
  misc_feature: Coding regions on vcDNA: vcDNA=SeqID_13171; Strand=+; Position=106-942
  misc_feature: Homolog annotation: Hit_ID=AAS07044.1; Match level="QueryCoverage =83%, HitCoverage=27%, E-value=2e-24, Identity=35%"; Hit description =plus agglutinin [Chlamydomonas reinhardtii]
  misc_feature: Gene Ontology Annotation: Molecular function=structural constituent of cytoskeleton; Cellular component=cornified envelope; Biological process=regulation of cell shape
MDSEDSREASSGSGSEDDQGRISRASKKSAGRDSYKSRSSSRSSSAGSRAHSASSQSSAGSRSRPPSPEADRLQSRSNKSRSPDSRSSRSRSPNEVSAAPRSQSPNPRSPKVRSKEKQGPRSPSSSSSSSSEDEEPKSPEPERPVSGGPRSPPSSPPNDYPKSPSPAPDMLSHPRSPSPNQVRSPLPNHPLSSPPNHPKSPPMNHPQSPSPNHPRSPSPNHHRSPSPNHPRSPSPNHPRFPSPNHPRSPSQTIPDPLHQTILDPLHKPQIAFTSELLS

SEQ ID NO: 33475 - protein, 272 aa, Diabrotica virgifera
  misc_feature: Coding regions on vcDNA: vcDNA=SeqID_13172; Strand=+; Position=105-923
  misc_feature: Homolog annotation: Hit_ID=CAF95339.1; Match level="QueryCoverage =65%, HitCoverage=40%, E-value=1e-21, Identity=29%"; Hit description =unnamed protein product [Tetraodon nigroviridis]
  misc_feature: Gene Ontology Annotation: Molecular function=zinc ion binding; Cellular component=nucleus; Biological process=regulation of transcription, DNA-dependent
  misc_feature (115)..(122): Xaa can be any naturally occurring amino acid
  misc_feature (142)..(149): Xaa can be any naturally occurring amino acid
  misc_feature (170)..(177): Xaa can be any naturally occurring amino acid
  misc_feature (192)..(202): Xaa can be any naturally occurring amino acid
  misc_feature (221)..(233): Xaa can be any naturally occurring amino acid
  misc_feature (238)..(238): Xaa can be any naturally occurring amino acid
  misc_feature (257)..(257): Xaa can be any naturally occurring amino acid
  misc_feature (261)..(261): Xaa can be any naturally occurring amino acid
MEETCKIEIENSEMDDAVLDSFKCEIQEEESKREIITHGTYDPLDLKKCPIKTEIEQHGNKLIPFEEHQKTEKGYLQEENKTEIIEKLVEDPSYQGNDMTRHTQENVGTGKRQYXXXXXXXXCITAINLKRHMRVHTGEKPXXXXXXXXRLSQACDLKNHLRVHTGEKPXXXXXXXXQFNVGSNLKTHITLXXXXXXXXXXXCFKQFSTAGNLKTHLRVHXXXXXXXXXXXXXQCITXSNLKKHMRVHTGKKPYKCXICFXQFGHFSSLKST

SEQ ID NO: 33476 - protein, 113 aa, Diabrotica virgifera
  misc_feature: Coding regions on vcDNA: vcDNA=SeqID_13173; Strand=-; Position=139-480
  misc_feature (8)..(14): Xaa can be any naturally occurring amino acid
  misc_feature (38)..(44): Xaa can be any naturally occurring amino acid
  misc_feature (79)..(90): Xaa can be any naturally occurring amino acid
NYLISYSXXXXXXXLIFLLQLNLHTPLFFRFSLLIFLXXXXXXXYLNYVSNSYTPFPSSLHYFSLLSIFISLPPILFYXXXXXXXXXXXXIYIIDQSHLFFHYILFQIDHKLL

SEQ ID NO: 33477 - protein, 108 aa, Diabrotica virgifera; identical to SEQ ID NO: 27732
  misc_feature: Coding regions on vcDNA: vcDNA=SeqID_13174; Strand=+; Position=274-600
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 33478 - protein, 329 aa, Diabrotica virgifera
  misc_feature: Coding regions on vcDNA: vcDNA=SeqID_13175; Strand=+; Position=1-987
  misc_feature (4)..(4): Xaa can be any naturally occurring amino acid
  misc_feature (7)..(7): Xaa can be any naturally occurring amino acid
  misc_feature (10)..(11): Xaa can be any naturally occurring amino acid
  misc_feature (15)..(15): Xaa can be any naturally occurring amino acid
  misc_feature (17)..(17): Xaa can be any naturally occurring amino acid
  misc_feature (28)..(328): Xaa can be any naturally occurring amino acid
THYXGKXWYXXAGTXVXGIPAVPSLASXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXD

SEQ ID NO: 33479 - protein, 184 aa, Diabrotica virgifera
  misc_feature: Coding regions on vcDNA: vcDNA=SeqID_13176; Strand=+; Position=356-907
  misc_feature: Homolog annotation: Hit_ID=CAB62280.1; Match level="QueryCoverage =100%, HitCoverage=90%, E-value=1e-33, Identity=41%"; Hit description= hydroxyproline-rich glycoprotein DZ-HRGP [Volvox carteri f. nagariensis]
  misc_feature: Gene Ontology Annotation: Molecular function=profilin binding; Cellular component=actin filament; Biological process=actin filament- based process
  misc_feature (22)..(22): Xaa can be any naturally occurring amino acid
  misc_feature (34)..(34): Xaa can be any naturally occurring amino acid
  misc_feature (105)..(105): Xaa can be any naturally occurring amino acid
PTSPPIRDPPLSPPPSPPLRSXPPPPEQGNIASXPHPYARPHTVPTPALPPLPHPTLHRPIRPPLPLPCPVYPNALIPSDAKDTPPLLPDWQPPPTPPTPSPRPXSHASSCPTPQPPPPAPPTERQTPHHRAPPHSSDPNPPVPPPPARPPRASPPMHNRLPPRHPPPTLPPRSLPPPNPLYLP

SEQ ID NO: 33480 - protein, 34 aa, Diabrotica virgifera; identical to SEQ ID NO: 27603
  misc_feature: Coding regions on vcDNA: vcDNA=SeqID_13177; Strand=-; Position=80-184

SEQ ID NO: 33481 - protein, 82 aa, Diabrotica virgifera
  misc_feature: Coding regions on vcDNA: vcDNA=SeqID_13178; Strand=+; Position=447-692
YKRIFHLDFQDDYLQYHYEFMLLFYSDMTIYESPLSTSDSIYGRTLSYRSKVPWITCHYRNNLLIESAKSSLINSSFDRHVA

SEQ ID NO: 33482 - protein, 88 aa, Diabrotica virgifera
  misc_feature: Coding regions on vcDNA: vcDNA=SeqID_13179; Strand=+; Position=651-914
  misc_feature (50)..(57): Xaa can be any naturally occurring amino acid
HFLHPMSLQKLDVLRLIVYRFYLWIFLTFLFVFLLLFFRLCFYFCFFRLXXXXXXXXQPFLGFLFYPAYFLNFSSNNSFYLGLLEKIF

SEQ ID NO: 33483 - protein, 64 aa, Diabrotica virgifera
  misc_feature: Coding regions on vcDNA: vcDNA=SeqID_13180; Strand=+; Position=322-516
  misc_feature (47)..(54): Xaa can be any naturally occurring amino acid
HDDDLGFHDDDSKRLLLSTDLTFEYYVKIIIFHRIVALISGTQYKIXXXXXXXXYLNISLLHVL

SEQ ID NO: 33484 - protein, 293 aa, Diabrotica virgifera
  misc_feature: Coding regions on vcDNA: vcDNA=SeqID_13181; Strand=+; Position=1-878
  misc_feature: Homolog annotation: Hit_ID=XP_321301.1; Match level="QueryCoverage =99%, HitCoverage=26%, E-value=9e-90, Identity=59%"; Hit description =ENSANGP00000008459 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=MMR_HSR1; Match level="Score=-15.1, E-value =0.012, Copies=1"; Pfam description=GTPase of unknown function
  misc_feature (205)..(205): Xaa can be any naturally occurring amino acid
  misc_feature (276)..(277): Xaa can be any naturally occurring amino acid
  misc_feature (283)..(283): Xaa can be any naturally occurring amino acid
  misc_feature (289)..(289): Xaa can be any naturally occurring amino acid
GVLSAVFGVMRHIYLKSSKNIKRLEGIMRSPVFTHLRATIEGLTTIRAFGAQSTLMDEFDHHQDYHSSAWYMFIVSSTAFGFYLDCFCTIFLAVLTFCLLLFGETFNLRGGEVGLAITQATALANFLQWGMRQSAEVTNQLMSVERILEYKSLDKEPQPVGPKKPAKEWPQKGEITFKDTCLRYFEGGPLVLKHLNLSIQPKEKXVGVVGRTGAGKSSLIQALFRLAPIEGTIKIDEIDTKDITLNDLRLKISIIPQDPVLFSGTLRYNLDPFEEXXDEVLYXAIEDVXVRDP

SEQ ID NO: 33485 - protein, 33 aa, Diabrotica virgifera
  misc_feature: Coding regions on vcDNA: vcDNA=SeqID_13182; Strand=-; Position=1-99
  misc_feature (6)..(33): Xaa can be any naturally occurring amino acid
YFLIPXXXXXXXXXXXXXXXXXXXXXXXXXXXX

SEQ ID NO: 33486 - protein, 290 aa, Diabrotica virgifera
  misc_feature: Coding regions on vcDNA: vcDNA=SeqID_13183; Strand=+; Position=2-871
  misc_feature: Homolog annotation: Hit_ID=XP_522258.1; Match level="QueryCoverage =92%, HitCoverage=9%, E-value=2e-17, Identity=37%"; Hit description =PREDICTED: similar to hypothetical protein BC008326 [Pan troglodytes]
LPPGSDDRPVVLDRPSFDLPTSRDRDATVVVGGNDRPLLDLPTSRDRDATVVVRGNDRPVVLERPTFDLPTSRDRDATVVIGGNDRPLLDFPTSRDRDTTVVVGGNDRPLLDLPTSRDRDATVVVGGNDRPVVLERPTFNLPTSRDRDATVVIGGNDRPLLDRPTSRDRDATVVLGGNDRPVVLDRPTFDLPTSRDRDATDVIGGNDRPLLDRPTSRDRDATVVLGGNDRPVLDRPTSRDRDATVVLGGNDRPVVRDRPTFDLPTSGDRDANVGVGGNDRPLLDLPTSRD

SEQ ID NO: 33487 - protein, 284 aa, Diabrotica virgifera
  misc_feature: Coding regions on vcDNA: vcDNA=SeqID_13184; Strand=+; Position=83-934
  misc_feature: Homolog annotation: Hit_ID=AAH61203.1; Match level="QueryCoverage =94%, HitCoverage=87%, E-value=7e-47, Identity=42%"; Hit description =Unknown (protein for MGC:74346) [Mus musculus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=142.1, E-value =1.3e-39, Copies=5"; Pfam description=Zinc finger, C2H2 type
MFNQTEVKEVSETTCKEEIDKEVEDTCKVEIKEELITESANDTFEYLDVKKCHIKAEIGQDDGVSCEDMKTDASSLLLENHDRSDINLNQYITSTTNVNGGQRFICIICQKPLSNNYHLELHMKRHTGAKPYQCEICTKQFSAKPTLKSHMTVHTGEKPFECEICNKQFSRKIYLKTHIRVHTGEKPFKCEICTKQLSTKQALQWHMKLHTDKEPLKSEIYTKQYSTTFNLKTHMAVDTDKKPFECEICTKKCSTKTQLNTHMRVHTEEKPFACEICTKQFSTN

SEQ ID NO: 33488 - protein, 211 aa, Diabrotica virgifera
  misc_feature: Coding regions on vcDNA: vcDNA=SeqID_13185; Strand=+; Position=1-636
  misc_feature: Homolog annotation: Hit_ID=NP_651529.2; Match level="QueryCoverage =94%, HitCoverage=62%, E-value=5e-22, Identity=36%"; Hit description =CG6131-PA [Drosophila melanogaster] gb|AAF56660.2| CG6131-PA [Drosophila melanogaster]
  misc_feature: Gene Ontology Annotation: Molecular function=cyclin-dependent protein kinase inhibitor activity; Cellular component=actin filament; Biological process=signal transduction
NSLNLHQLQHQSQDADYYEPQPQPQIPIRKAAIARPRPQQQPQPQQAFEDYSPPQQFEPAPAPPRPAPAQSNFDFDFGPVARPSPARAFAPAPAPAPRPRPLQIPGARPSPIDDGFGPAPASVTRTQVPRVTYAQPAPIPSRPAPSYDIPSARFAPAPAPAPRPAPVYQPRPAPSIPVAGRSGGILDQLSKDYALPSDGAAPLHDISFGYY

SEQ ID NO: 33489 - protein, 104 aa, Diabrotica virgifera
  misc_feature: Coding regions on vcDNA: vcDNA=SeqID_13186; Strand=-; Position=564-878
  misc_feature (15)..(15): Xaa can be any naturally occurring amino acid
  misc_feature (22)..(22): Xaa can be any naturally occurring amino acid
  misc_feature (35)..(35): Xaa can be any naturally occurring amino acid
  misc_feature (38)..(46): Xaa can be any naturally occurring amino acid
VKTANHFQKTLPYYXEKRVSFXGANKLTLLYTSAXRKXXXXXXXXXYPTSTSMFMTCGRQGNECRISEIIKGLCQKYLTFHHNFKLSTMLLLSHPARGIVNISQ

SEQ ID NO: 33490 - protein, 117 aa, Diabrotica virgifera
  misc_feature: Coding regions on vcDNA: vcDNA=SeqID_13187; Strand=+; Position=79-434
  misc_feature: Homolog annotation: Hit_ID=AAC04806.1; Match level="QueryCoverage =99%, HitCoverage=23%, E-value=4e-21, Identity=52%"; Hit description =B subunit V-ATPase [Culex pipiens quinquefasciatus]
  misc_feature: Gene Ontology Annotation: Molecular function=hydrogen-transporting ATPase activity, rotational mechanism; Cellular component=plasma membrane; Biological process=proton transport
  misc_feature (17)..(17): Xaa can be any naturally occurring amino acid
  misc_feature (28)..(28): Xaa can be any naturally occurring amino acid
  misc_feature (44)..(44): Xaa can be any naturally occurring amino acid
  misc_feature (67)..(67): Xaa can be any naturally occurring amino acid
  misc_feature (93)..(93): Xaa can be any naturally occurring amino acid
YVSKHFISQPKLTYKTXAGVNVRTIEPXDEKFSMNNYIVQHRIXDRSLIENQVLEIIVSKGEVLRFXGTLIIDDIHPVCEFTGDILLTPFSRXDRLRIVFDGSGKPIDTGPSFLTEN

SEQ ID NO: 33491 - protein, 294 aa, Diabrotica virgifera
  misc_feature: Coding regions on vcDNA: vcDNA=SeqID_13188; Strand=+; Position=18-902
  misc_feature: Homolog annotation: Hit_ID=XP_394218.1; Match level="QueryCoverage =73%, HitCoverage=35%, E-value=7e-45, Identity=43%"; Hit description =similar to ENSANGP00000024305 [Apis mellifera]
  misc_feature: Gene Ontology Annotation: Biological process=reproduction
  misc_feature: Pfam annotation: Pfam_ID=GMC_oxred_N; Match level="Score=86.8, E -value=5.8e-23, Copies=1"; Pfam description=GMC oxidoreductase
  misc_feature (262)..(262): Xaa can be any naturally occurring amino acid
MILFKPVPLAVLALTFFSSKDFRATASDKVFDEVQYYEKLITDELQKALNYETQTNAKMYEPDDTTIRDFGTFDFIIIGAGSTGSVIASRLSEISRWKILVLEAGHYPNNFTMIPGMFAIQAMTSYNWGFKSTPQKTACLGAVDNRCVIPRGKGVGGTSLINQNIYSRGNSIDYDRLAELVNDQSWRYENVLNYFKKSEDFHQNNPQAPVDWNYHGKNGYLSTNFHLPPSNFTEMFLQANRELGRNITDYNGKEQIGATILXINTKKGRRYDQASAFITPVRERSTLSSPKEST

SEQ ID NO: 33492 - protein, 58 aa, Diabrotica virgifera
  misc_feature: Coding regions on vcDNA: vcDNA=SeqID_13189; Strand=+; Position=102-278
FRIKLTIPNIMYLQKCKYNIYIVQSLKLKINPNLAILITFIDLLENLKLRLFYPPLQT

SEQ ID NO: 33493 - protein, 126 aa, Diabrotica virgifera
  misc_feature: Coding regions on vcDNA: vcDNA=SeqID_13190; Strand=+; Position=2-382
  misc_feature (8)..(15): Xaa can be any naturally occurring amino acid
IVQPDHGXXXXXXXXKKGYQMGKKQLKIICYANDAILISQSEDDLQRMLHQFNIITRKFNMLISSQKTKCMVITADPIKCKLEMEGQIIEQLMEFEYLGITLSSYGRLETEVEDQVNRANSRRLPE

SEQ ID NO: 33494 - protein, 261 aa, Diabrotica virgifera
  misc_feature: Coding regions on vcDNA: vcDNA=SeqID_13191; Strand=+; Position=13-798
  misc_feature: Homolog annotation: Hit_ID=XP_391943.1; Match level="QueryCoverage =92%, HitCoverage=41%, E-value=8e-50, Identity=39%"; Hit description =similar to RE16761p [Apis mellifera]
  misc_feature: Gene Ontology Annotation: Molecular function=carboxylesterase activity; Cellular component=synaptic junction; Biological process =synaptic vesicle targeting
  misc_feature: Pfam annotation: Pfam_ID=COesterase; Match level="Score=-42.9, E -value=2.3e-09, Copies=1"; Pfam description=Carboxylesterase
MLCSSYAFVLVSLLAGYCCYNPLCDLLLVQLPEGKIRGHVLESQDGKDFFAFQEIPYAAPPVGKNRFKDPLPPVPWTGILNATQNKRVCMQNNASALTGVPEDMEISEDCLYINVYTPRVPGTSQELLPVLFWVHAGGYFYGSGALQYYDPKYFMDYDIIVVTMNYRLGPLGFLTTEDNVIPGNLGLKDTVQALKWTYDNINTFGGDKHKITVMGESAGSTTAGFMHLSKRTQGMVAGYILESGTPISPLCLPTKCQTIRF

SEQ ID NO: 33495 - protein, 127 aa, Diabrotica virgifera
  misc_feature: Coding regions on vcDNA: vcDNA=SeqID_13192; Strand=+; Position=458-841
  misc_feature (65)..(70): Xaa can be any naturally occurring amino acid
  misc_feature (72)..(79): Xaa can be any naturally occurring amino acid
  misc_feature (96)..(108): Xaa can be any naturally occurring amino acid
HDDVIQCFYYRSPEISETAKVRQIENFGYATLSDLTVKLISAFSCVNFKTLCIMSRDCALSVLFXXXXXXFXXXXXXXXNCILDTITRRFYLAISXXXXXXXXXXXXXRLYTAGNRSFLIIFHIFRF

SEQ ID NO: 33496 - protein, 238 aa, Diabrotica virgifera
  misc_feature: Coding regions on vcDNA: vcDNA=SeqID_13193; Strand=-; Position=1-714
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (52)..(65): Xaa can be any naturally occurring amino acid
  misc_feature (67)..(238): Xaa can be any naturally occurring amino acid
PFXXXXXXXXXXXTSLAHTGLNXXXXXXXXSNXXXXXXXXPIINFNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33497 - protein, 80 aa, Diabrotica virgifera; identical to SEQ ID NO: 30388
  misc_feature: Coding regions on vcDNA: vcDNA=SeqID_13194; Strand=-; Position=1-240
  misc_feature (1)..(80): Xaa can be any naturally occurring amino acid

SEQ ID NO: 33498 - protein, 63 aa, Diabrotica virgifera
  misc_feature: Coding regions on vcDNA: vcDNA=SeqID_13195; Strand=-; Position=491-682
LIHTHECSIFYQVTLLGAVSGGGTMKKIQCHTFCPLKKAHPTILIRSNKNLKHPFHVCQITYL

SEQ ID NO: 33499 - protein, 111 aa, Diabrotica virgifera
  misc_feature: Coding regions on vcDNA: vcDNA=SeqID_13196; Strand=-; Position=212-547
HHSRIFRQKLCFYNPSQIPSRIVIERTFGIVKRFPILPYVMRCKLPFIQRIISACSVLHIAVVHNRENVEILANECAVDIDIEAVAVHFQPGANLMRLNCVCVCLKLLFDI

SEQ ID NO: 33500 - protein, 282 aa, Diabrotica virgifera
  misc_feature: Coding regions on vcDNA: vcDNA=SeqID_13197; Strand=+; Position=3-851
  misc_feature: Homolog annotation: Hit_ID=XP_318671.1; Match level="QueryCoverage =100%, HitCoverage=76%, E-value=1e-103, Identity=59%"; Hit description=ENSANGP00000022213 [Anopheles gambiae]
PAERPTAKRPEDNLRPEGEFERPTPTKVGPAERRTPIKHDDNLHPEGDFDRPEKPRYKPAERPTPKKPEDNLHPEGEFERPERPGYVPAERPQQKRPEDNLRPEGDFERPTPTKIGPAERRTPIKHDDNLRPEGDFERPERPGYVPAERPRQKRPEDNLRPEGDFERPSPTKVGPAERRTPIKHDDNLRPEGDFERPEKPTYKAAERPTPKKPEDNLKPEGEIQVPEKTQYRPAERPTQKKPQDNLRPEGEFERPEIIEVGPAELRKPIRHGDNLKPEVNDY

SEQ ID NO: 33501 - protein, 77 aa, Diabrotica virgifera
  misc_feature: Coding regions on vcDNA: vcDNA=SeqID_13198; Strand=-; Position=102-335
ERYQIRERTARASPPDADAFDDIRTYAYNFQFSCLSEFSINTFLVMICSSLTPNGQNLWYYIYGDNIISAPPVTSTR

SEQ ID NO: 33502 - protein, 67 aa, Diabrotica virgifera
  misc_feature: Coding regions on vcDNA: vcDNA=SeqID_13199; Strand=+; Position=1-201
  misc_feature (4)..(24): Xaa can be any naturally occurring amino acid
  misc_feature (27)..(27): Xaa can be any naturally occurring amino acid
  misc_feature (30)..(30): Xaa can be any naturally occurring amino acid
  misc_feature (34)..(42): Xaa can be any naturally occurring amino acid
  misc_feature (44)..(66): Xaa can be any naturally occurring amino acid
CRGXXXXXXXXXXXXXXXXXXXXXSLXFFXRREXXXXXXXXXNXXXXXXXXXXXXXXXXXXXXXXXF

SEQ ID NO: 33503 - protein, 287 aa, Diabrotica virgifera
  misc_feature: Coding regions on vcDNA: vcDNA=SeqID_13200; Strand=+; Position=32-892
  misc_feature: Homolog annotation: Hit_ID=NP_651226.1; Match level="QueryCoverage =93%, HitCoverage=74%, E-value=2e-87, Identity=55%"; Hit description =CG6198-PA [Drosophila melanogaster] gb|AAF56252.1| CG6198-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=CHORD; Match level="Score=281.3, E-value =1.6e-81, Copies=2"; Pfam description=CHORD
KFYKRIIYRLIRKNEKALLQCYNRGCGQKFDPDKNNEDSCRHHPGEPVFHDAYKGWSCCNKKCTDFTEFLNIQGCTLSKHSNIKPVEPEKPVAKDVDVNEVIEVKPIVQSTMERPSFNTPLVTIKAQVAPSLQQQLKILETKQEVKTTNLSGEIVIGTTCKNGGCGTTYEGPQTNDTTCTYHPGVPIFHEGLKFWSCCQKRTTDFDAFLNQVGCETGTHIWSKEAAGDETVQCRVGFSSNRLPTVVVSIYAKEYCLKESIVKLNQVRMYAKLVFPQQSNASFLLDNE

SEQ ID NO: 33504 - protein, 318 aa, Diabrotica virgifera
  misc_feature: Coding regions on vcDNA: vcDNA=SeqID_13201; Strand=-; Position=1-957
  misc_feature (11)..(317): Xaa can be any naturally occurring amino acid
KKFIFYFYSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 33505 - protein, 93 aa, Diabrotica virgifera
  misc_feature: Coding regions on vcDNA: vcDNA=SeqID_13202; Strand=-; Position=1-279
  misc_feature (2)..(22): Xaa can be any naturally occurring amino acid
  misc_feature (24)..(92): Xaa can be any naturally occurring amino acid
KXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXL

SEQ ID NO: 33506 - protein, 56 aa, Diabrotica virgifera
  misc_feature: Coding regions on vcDNA: vcDNA=SeqID_13203; Strand=+; Position=1-171
  misc_feature (1)..(15): Xaa can be any naturally occurring amino acid
XXXXXXXXXXXXXXXINGRDEEKNDRNRPDSHRLEIQILEHFICRTNIHNINCYTN

SEQ ID NO: 33507 - protein, 104 aa, Diabrotica virgifera
  misc_feature: Coding regions on vcDNA: vcDNA=SeqID_13204; Strand=+; Position=366-680
  misc_feature: Homolog annotation: Hit_ID=AAL61976.1; Match level="QueryCoverage =87%, HitCoverage=40%, E-value=4e-21, Identity=51%"; Hit description =ATPase 6 [Aedes albopictus]
  misc_feature: Pfam annotation: Pfam_ID=ATP-synt_A; Match level="Score=-46.7, E -value=0.015, Copies=1"; Pfam description=ATP synthase A chain
  misc_feature (51)..(51): Xaa can be any naturally occurring amino acid
  misc_feature (59)..(59): Xaa can be any naturally occurring amino acid
  misc_feature (70)..(70): Xaa can be any naturally occurring amino acid
DYIRYESRGRTLIFISLCRLIVFNNFLGLFPNMCTGTRHITLTIRLAVTLXLRFIIYGXICNSIHMLGHXAPRGSPAIVRPLIVWIESMKNGIRPGTFSRTSSC

SEQ ID NO: 33508 - protein, 309 aa, Diabrotica virgifera
  misc_feature: Coding regions on vcDNA: vcDNA=SeqID_13205; Strand=+; Position=1-927
  misc_feature: Homolog annotation: Hit_ID=EAA03235.2; Match level="QueryCoverage =99%, HitCoverage=59%, E-value=6e-63, Identity=42%"; Hit description =ENSANGP00000014604 [Anopheles gambiae str. PEST] ref|XP_560716.1| ENSANGP00000014604 [Anopheles gambiae st
  misc_feature (63)..(72): Xaa can be any naturally occurring amino acid
AVLFYYFAVKPMSYWKERGIKQTKPVWLLGDSWGTLLKMHSLVDFIQNVYDQVPDVRYFGLYXXXXXXXXXXDPDLIKQIAVKDFEHFTDHRIMFPKNSDPLMAKNLFSLKGQVWRDTRPILSPTFTSSKMRAMFVLMSECGENFIKYFLDNDKDTIETEMKDTFRRFTNDVIATTAFGVKTDSLKHRNNDFFVMGMKAVDFGFWKSLKFFGYMLMPKVLGFFKVTIFGKELSDFFMDLINKTVRIREEKGIVRPDMIHLLMEARKGIQQNEEKVIDTGFAVVEEADLGHGKGAKEITNEDIAAHALIF

SEQ ID NO: 33509 - protein, 91 aa, Diabrotica virgifera
  misc_feature: Coding regions on vcDNA: vcDNA=SeqID_13206; Strand=-; Position=79-354
  misc_feature (1)..(14): Xaa can be any naturally occurring amino acid
  misc_feature (20)..(30): Xaa can be any naturally occurring amino acid
  misc_feature (74)..(80): Xaa can be any naturally occurring amino acid
XXXXXXXXXXXXXXPHLYRXXXXXXXXXXXTITSIYIYAHTCAYICLSFLYHSLCERACVLSVWNTQDISQNVXXXXXXXTLVGSQLWDIF

SEQ ID NO: 33510 - protein, 267 aa, Diabrotica virgifera
  misc_feature: Coding regions on vcDNA: vcDNA=SeqID_13207; Strand=+; Position=1-804
  misc_feature (3)..(234): Xaa can be any naturally occurring amino acid
  misc_feature (236)..(249): Xaa can be any naturally occurring amino acid
LIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXATSDVGLKFINWCNNYII

SEQ ID NO: 33511 - protein, 34 aa, Diabrotica virgifera; identical to SEQ ID NO: 27603
  misc_feature: Coding regions on vcDNA: vcDNA=SeqID_13208; Strand=-; Position=80-184

SEQ ID NO: 33512 - protein, 137 aa, Diabrotica virgifera
  misc_feature: Coding regions on vcDNA: vcDNA=SeqID_13209; Strand=+; Position=2-415
  misc_feature: Homolog annotation: Hit_ID=EAL27893.1; Match level="QueryCoverage =92%, HitCoverage=22%, E-value=4e-27, Identity=46%"; Hit description =GA20334-PA [Drosophila pseudoobscura]
  misc_feature: Gene Ontology Annotation: Molecular function=dipeptidyl-peptidase activity; Cellular component=cellular_component unknown; Biological process=proteolysis and peptidolysis
LIQAGVVSVTQPSENDLLVTLDRSAIQGAGRVAIGQFLLQLQIYKATGNLEKAQELYNHYAEVTEPWLSWRSIVLANKQPRKMFVQANTSTAENGVSLKSYEPSLEGLVQSWVERFSTPQPLYDALLELSKADAAHF

SEQ ID NO: 33513 - protein, 286 aa, Diabrotica virgifera
  misc_feature: Coding regions on vcDNA: vcDNA=SeqID_13210; Strand=+; Position=1-858
  misc_feature: Homolog annotation: Hit_ID=XP_320234.1; Match level="QueryCoverage =53%, HitCoverage=16%, E-value=9e-34, Identity=44%"; Hit description =ENSANGP00000019994 [Anopheles gambiae]
  misc_feature: Gene Ontology Annotation: Molecular function=molecular_function unknown; Cellular component=cellular_component unknown; Biological process=N-linked glycosylation
  misc_feature: Pfam annotation: Pfam_ID=TSP_1; Match level="Score=35.2, E-value=1.9e- 07, Copies=1"; Pfam description=Thrombospondin type 1 domain
SDCTWAESYSYNLYPMDAGTDDGIGYMTSDPLRFSRKLIMPITPNNPNDPRSPFYDEDGTPMNPIAKLHFTRQRVYEKPCDSNEQEESSGEDACATTKWGDWTPCSVPCGLGKKTRMRSYVDIRKSQNCYVQLVQHQTCQGTAKYCKISSRKSNRRNRLKNRIKSKATEEEEGKSKEESKSKDEEETKEDKGSDEEAKDSDEEGESKEEKDSKEGDDNSNDEKDSKDEEDEEKENKSKKQKDSDEEKKSGEEEGDSDEKDSKDEKINLMIKKIPTKRSRKENPNLM

SEQ ID NO: 33514 - protein, 106 aa, Diabrotica virgifera
  misc_feature: Coding regions on vcDNA: vcDNA=SeqID_13211; Strand=+; Position=110-427
  misc_feature: Homolog annotation: Hit_ID=EAA09218.2; Match level="QueryCoverage =95%, HitCoverage=21%, E-value=4e-25, Identity=46%"; Hit description =ENSANGP00000003522 [Anopheles gambiae str. PEST] ref|XP_562050.1| ENSANGP00000003522 [Anopheles gambiae st
MSYDDVISLLGEFGRYQKKIYFLLCLPAILCAFHKLGNVFLVAEPNYRCKLPNETDNSSYHLNETTLSLYYPRDTLHKKYSSCEIYDTNNITKPCESYIFDHEIYG

SEQ ID NO: 33515 - protein, 31 aa, Diabrotica virgifera
  misc_feature: Coding regions on vcDNA: vcDNA=SeqID_13212; Strand=-; Position=2-94
  misc_feature (3)..(27): Xaa can be any naturally occurring amino acid
PPXXXXXXXXXXXXXXXXXXXXXXXXXIGFS

SEQ ID NO: 33516 - protein, 55 aa, Diabrotica virgifera
  misc_feature: Coding regions on vcDNA: vcDNA=SeqID_13213; Strand=+; Position=252-416
  misc_feature: Homolog annotation: Hit_ID=AAM53173.1; Match level="QueryCoverage =94%, HitCoverage=11%, E-value=2e-11, Identity=55%"; Hit description =Hsp70 protein [Lamna ditropis]
  misc_feature (12)..(12): Xaa can be any naturally occurring amino acid
RSTIFDARRHIXRRNDDSAVQTEMKNWSFEVINDAGIPRMKVEFKGDDQFLLPRR

SEQ ID NO: 33517 - protein, 149 aa, Diabrotica virgifera
  misc_feature: Coding regions on vcDNA: vcDNA=SeqID_13214; Strand=-; Position=2-448
  misc_feature (6)..(12): Xaa can be any naturally occurring amino acid
  misc_feature (57)..(111): Xaa can be any naturally occurring amino acid
  misc_feature (114)..(121): Xaa can be any naturally occurring amino acid
  misc_feature (125)..(149): Xaa can be any naturally occurring amino acid
FNPREXXXXXXXGTRIKKISLPPPYKTFNPPGGSQSFFSIWLPQKNSGFSLKVIFSXXXXXXXXXXXXXXXXXXXXXXXXXXXXXXXXXXXXXXXXXXXXXXXXXXXXXXXSLXXXXXXXXKNRXXXXXXXXXXXXXXXXXXXXXXXXX

SEQ ID NO: 33518 - protein, 27 aa, Diabrotica virgifera
  misc_feature: Coding regions on vcDNA: vcDNA=SeqID_13215; Strand=-; Position=1-81
  misc_feature (1)..(15): Xaa can be any naturally occurring amino acid
  misc_feature (21)..(27): Xaa can be any naturally occurring amino acid
XXXXXXXXXXXXXXXSIGFSXXXXXXX

SEQ ID NO: 33519 - protein, 74 aa, Diabrotica virgifera
  misc_feature: Coding regions on vcDNA: vcDNA=SeqID_13216; Strand=-; Position=18-242
  misc_feature (39)..(45): Xaa can be any naturally occurring amino acid
GKNNIYLLNKHSFLSSDNSKMYFKLNKSHTFLSLSQSMXXXXXXXHPVYTIIPMFIVLNRESNNLSNELSRPDG

SEQ ID NO: 33520 - protein, 134 aa, Diabrotica virgifera
  misc_feature: Coding regions on vcDNA: vcDNA=SeqID_13217; Strand=+; Position=3-407
  misc_feature (99)..(108): Xaa can be any naturally occurring amino acid
SNWAVGKPSRRGSKECIQVDQMGFWSDEDCNNVRYFICEVQMSPGKPVPTKPSVSTGQGQCPEPVINVYINTNLDGDSSSNLISSKDVKLSDSGYQVLXXXXXXXXXXAAGGNGNIAKTTTESYYDQLNGLGGL

SEQ ID NO: 33521 - protein, 67 aa, Diabrotica virgifera
  misc_feature: Coding regions on vcDNA: vcDNA=SeqID_13218; Strand=+; Position=379-582
LYEFIKTLLFFNRNYDYSSSYFSICNYHILVYIISFTLCIDCVLDHKRTVFRVTLDDTISISFWHIE

SEQ ID NO: 33522 - protein, 166 aa, Diabrotica virgifera
  misc_feature: Coding regions on vcDNA: vcDNA=SeqID_13219; Strand=-; Position=0-497
  misc_feature (3)..(19): Xaa can be any naturally occurring amino acid
  misc_feature (27)..(50): Xaa can be any naturally occurring amino acid
  misc_feature (59)..(76): Xaa can be any naturally occurring amino acid
  misc_feature (90)..(118): Xaa can be any naturally occurring amino acid
  misc_feature (120)..(160): Xaa can be any naturally occurring amino acid
PPXXXXXXXXXXXXXXXXXIFCSGLYXXXXXXXXXXXXXXXXXXXXXXXXTPTTPPPPXXXXXXXXXXXXXXXXXXFLLSRGEEGKEGGXXXXXXXXXXXXXXXXXXXXXXXXXXXXXGXXXXXXXXXXXXXXXXXXXXXXXXXXXXXXXXXXXXXXXXXGPPPRP

SEQ ID NO: 33523 - protein, 68 aa, Diabrotica virgifera
  misc_feature: Coding regions on vcDNA: vcDNA=SeqID_13220; Strand=+; Position=87-293
IFGIIGQYMELHLLGLDLHQCIETLLILNDRPATNVLPKHFGLSRILPNIFAYIISISTDLRCCLRHR

SEQ ID NO: 33524 - protein, 84 aa, Diabrotica virgifera
  misc_feature: Coding regions on vcDNA: vcDNA=SeqID_13221; Strand=-; Position=0-251
  misc_feature (1)..(80): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXLVEL

SEQ ID NO: 33525 - protein, 124 aa, Diabrotica virgifera
  misc_feature: Coding regions on vcDNA: vcDNA=SeqID_13222; Strand=+; Position=457-828
  misc_feature (52)..(58): Xaa can be any naturally occurring amino acid
PTIIMIKISATLKLSIIGLIIFTMIFLRFQGSLLQRNTYSLTTKLLLNGKTXXXXXXXYNRLLNISFNFSMINQVCQESAPVLVLIVVHSAPSNFKKRQTIRDTWGQVEETKQIVFMKGNPSSP

SEQ ID NO: 33526 - protein, 340 aa, Diabrotica virgifera
  misc_feature: Coding regions on vcDNA: vcDNA=SeqID_13223; Strand=-; Position=2-1021
  misc_feature (28)..(81): Xaa can be any naturally occurring amino acid
  misc_feature (88)..(99): Xaa can be any naturally occurring amino acid
  misc_feature (102)..(114): Xaa can be any naturally occurring amino acid
  misc_feature (129)..(336): Xaa can be any naturally occurring amino acid
TLIPPSGAQFFIIDLNFSNKITLLSPKXXXXXXXXXXXXXXXXXXXXXXXXXXXXXXXXXXXXXXXXXXXXXXXXXXXXXXLHRVFSXXXXXXXXXXXXDFXXXXXXXXXXXXXLSFQFQLKKLNIMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRCG

SEQ ID NO: 33527 - protein, 63 aa, Diabrotica virgifera
  misc_feature: Coding regions on vcDNA: vcDNA=SeqID_13224; Strand=-; Position=15-206
  misc_feature (2)..(10): Xaa can be any naturally occurring amino acid
QXXXXXXXXXDNKDIDLVSWIKVNNVAYHHNIIKFVVFFGLYLIGFYPGVIQVVLYQKSNYII

SEQ ID NO: 33528 - protein, 87 aa, Diabrotica virgifera
  misc_feature: Coding regions on vcDNA: vcDNA=SeqID_13225; Strand=-; Position=1-261
  misc_feature: Homolog annotation: Hit_ID=AAC28142.1; Match level="QueryCoverage =100%, HitCoverage=56%, E-value=3e-33, Identity=77%"; Hit description= mariner transposase [Buenoa sp. HMR-1997]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=5.1, E -value=0.00012, Copies=1"; Pfam description=Transposase
RIGDSKKCMKLFNSNKTEFLRRYVTMDETWLHHFTPESNRQSAEWTAREELTLKRGKMQQSADKVKASVFWDAHGLIFIDYLESGKT

SEQ ID NO: 33529 - protein, 66 aa, Diabrotica virgifera; identical to SEQ ID NO: 26808
  misc_feature: Coding regions on vcDNA: vcDNA=SeqID_13226; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33530 - protein, 92 aa, Diabrotica virgifera
  misc_feature: Coding regions on vcDNA: vcDNA=SeqID_13227; Strand=-; Position=2-277
  misc_feature (85)..(92): Xaa can be any naturally occurring amino acid
YDPIFFLVHFLSRNRSIFSDSLAPLYTNKQTFAWGVLLYCLDSCIGSLHLIGPPFVFLLHPISRPPNNFKKFSHIPYLIALIKDXXXXXXXX

SEQ ID NO: 33531 - protein, 150 aa, Diabrotica virgifera
  misc_feature: Coding regions on vcDNA: vcDNA=SeqID_13228; Strand=+; Position=25-477
  misc_feature: Homolog annotation: Hit_ID=AAR31117.1; Match level="QueryCoverage =89%, HitCoverage=87%, E-value=6e-32, Identity=52%"; Hit description =RH58379p [Drosophila melanogaster] ref|NP_609195.1| CG8360-PA [Drosophila melanogaster] gb|AAF52621.1| CG8
  misc_feature: Gene Ontology Annotation: Molecular function=cytidine deaminase activity; Cellular component=cellular_component unknown; Biological process=nucleobase, nucleoside, nucleotide and nucleic acid metabolism
  misc_feature: Pfam annotation: Pfam_ID=dCMP_cyt_deam; Match level="Score=45.2, E -value=1.9e-10, Copies=1"; Pfam description=Cytidine and deoxycytidylate deaminase
  misc_feature (105)..(110): Xaa can be any naturally occurring amino acid
MSICVCTDNIYKLKALDPKIQNLINIATEGRLNAYCPYSNFKVGASVMCDDGTIFSGCNVENSAFTVGLCAERCAYVKAISEGKMKFKAVCVVAQQENSFTTPCXXXXXXMSEFGNVDVYITKPSGSDVLVLSLDKLLPYQFETVDHTFT

SEQ ID NO: 33532 - protein, 37 aa, Diabrotica virgifera
  misc_feature: Coding regions on vcDNA: vcDNA=SeqID_13229; Strand=-; Position=1-111
  misc_feature (2)..(35): Xaa can be any naturally occurring amino acid
PXXXXXXXXXXXXXXXXXXXXXXXXXXXXXXXXXXAF

SEQ ID NO: 33533 - protein, 142 aa, Diabrotica virgifera
  misc_feature: Coding regions on vcDNA: vcDNA=SeqID_13230; Strand=+; Position=272-700
MNQNQMVVKQEIIEETCKIEYNDLDGALLDGLKCEILEESNGQSTHDTYEYLDVKEFPISTEREHENKLNPFGEIQETEKDMEVKTEIKEEFGEYEQKYEENQLSTAIDLGECKDEPVDSSDLFSKNAAGDIRRCGMTDEDA

SEQ ID NO: 33534 - protein, 65 aa, Diabrotica virgifera
  misc_feature: Coding regions on vcDNA: vcDNA=SeqID_13231; Strand=-; Position=158-355
  misc_feature (12)..(17): Xaa can be any naturally occurring amino acid
EYETIVVKCINXXXXXXESVIDNSKFQKLHQSLSLGLRHHQCFLIALVCLFNCFIALFVLSACAS

SEQ ID NO: 33535 - protein, 227 aa, Diabrotica virgifera
  misc_feature: Coding regions on vcDNA: vcDNA=SeqID_13232; Strand=+; Position=3-686
  misc_feature (7)..(35): Xaa can be any naturally occurring amino acid
  misc_feature (41)..(57): Xaa can be any naturally occurring amino acid
  misc_feature (60)..(95): Xaa can be any naturally occurring amino acid
  misc_feature (98)..(188): Xaa can be any naturally occurring amino acid
  misc_feature (191)..(223): Xaa can be any naturally occurring amino acid
FITKPGXXXXXXXXXXXXXXXXXXXXXXXXXXXXXKLIKMXXXXXXXXXXXXXXXXXGIXXXXXXXXXXXXXXXXXXXXXXXXXXXXXXXXXXXXKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGXXXXXXXXXXXXXXXXXXXXXXXXXXXXXXXXXLFLN

SEQ ID NO: 33536 - protein, 59 aa, Diabrotica virgifera
  misc_feature: Coding regions on vcDNA: vcDNA=SeqID_13233; Strand=+; Position=669-845
  misc_feature (47)..(57): Xaa can be any naturally occurring amino acid
NTTRLAGRGQHILTFSPAPGTIGPDPTTPRPSPAYHEPTLPAPPSTXXXXXXXXXXXPP

SEQ ID NO: 33537 - protein, 22 aa, Diabrotica virgifera
  misc_feature: Coding regions on vcDNA: vcDNA=SeqID_13234; Strand=-; Position=2-67
  misc_feature (2)..(10): Xaa can be any naturally occurring amino acid
  misc_feature (15)..(21): Xaa can be any naturally occurring amino acid
TXXXXXXXXXLKVIXXXXXXXW

SEQ ID NO: 33538 - protein, 148 aa, Diabrotica virgifera
  misc_feature: Coding regions on vcDNA: vcDNA=SeqID_13235; Strand=+; Position=1-444
  misc_feature (14)..(65): Xaa can be any naturally occurring amino acid
  misc_feature (72)..(115): Xaa can be any naturally occurring amino acid
  misc_feature (118)..(140): Xaa can be any naturally occurring amino acid
KKAPFFLGKIFPLXXXXXXXXXXXXXXXXXXXXXXXXXXXXXXXXXXXXXXXXXXXXXXXXXXXXRKGNFIXXXXXXXXXXXXXXXXXXXXXXXXXXXXXXXXXXXXXXXXXXXXNKXXXXXXXXXXXXXXXXXXXXXXXHPPRHSPR

SEQ ID NO: 33539 - protein, 68 aa, Diabrotica virgifera
  misc_feature: Coding regions on vcDNA: vcDNA=SeqID_13236; Strand=-; Position=35-241
  misc_feature (8)..(22): Xaa can be any naturally occurring amino acid
  misc_feature (35)..(41): Xaa can be any naturally occurring amino acid
FWGPLFGXXXXXXXXXXXXXXXTPGPPPGFKTQSXXXXXXXGPKFNKKVAPPIYTFNPPWGFPFLFLI

SEQ ID NO: 33540 - protein, 82 aa, Diabrotica virgifera
  misc_feature: Coding regions on vcDNA: vcDNA=SeqID_13237; Strand=+; Position=827 -1075
  misc_feature (24)..(29): Xaa can be any naturally occurring amino acid
  misc_feature (68)..(75): Xaa can be any naturally occurring amino acid
VPAVLPIPLLVQGSSLNFQNWGRXXXXXXCFSAPLPASLGKKCPLKCNPDCGTCLPCCIPPHPGTSLXXXXXXXXKFSSNPF

SEQ ID NO: 33541 - protein, 172 aa, Diabrotica virgifera
  misc_feature: Coding regions on vcDNA: vcDNA=SeqID_13238; Strand=+; Position=1-516
  misc_feature (1)..(171): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 33542 - protein, 34 aa, Diabrotica virgifera; identical to SEQ ID NO: 27603
  misc_feature: Coding regions on vcDNA: vcDNA=SeqID_13239; Strand=-; Position=80-184

SEQ ID NO: 33543 - protein, 139 aa, Diabrotica virgifera
  misc_feature: Coding regions on vcDNA: vcDNA=SeqID_13240; Strand=+; Position=105-524
  misc_feature: Homolog annotation: Hit_ID=NP_001002317.1; Match level="QueryCoverage= 93%, HitCoverage=91%, E-value=2e-48, Identity=76%"; Hit description =polymerase (RNA) II (DNA directed) polypeptide D [Danio rerio] gb|AAT68113.1| RNA
  misc_feature: Gene Ontology Annotation: Cellular component=DNA-directed RNA polymerase II, holoenzyme; Biological process=transcription from Pol II promoter
  misc_feature: Pfam annotation: Pfam_ID=RNA_pol_Rpb4; Match level="Score=147.3, E -value=3.6e-41, Copies=1"; Pfam description=RNA polymerase Rpb4
  misc_feature (68)..(75): Xaa can be any naturally occurring amino acid
MANTNTDLTEEDAADLQFPKEFENAETLLISEVHMLLEHRKDQNESAEDEQEFSDVFMKTLTYTDRFXXXXXXXXISAVRNLLMQTKKLHKFELAAIANLCPETTEEAKSLILSLEGRFEDEELQAILDDIQTKRSIQY

SEQ ID NO: 33544 - protein, 86 aa, Diabrotica virgifera
  misc_feature: Coding regions on vcDNA: vcDNA=SeqID_13241; Strand=-; Position=1-258
  misc_feature (1)..(13): Xaa can be any naturally occurring amino acid
  misc_feature (15)..(26): Xaa can be any naturally occurring amino acid
  misc_feature (28)..(37): Xaa can be any naturally occurring amino acid
  misc_feature (43)..(84): Xaa can be any naturally occurring amino acid
XXXXXXXXXXXXXKXXXXXXXXXXXXVXXXXXXXXXXSPIKKXXXXXXXXXXXXXXXXXXXXXXXXXXXXXXXXXXXXXXXXXXAF

SEQ ID NO: 33545 - protein, 249 aa, Diabrotica virgifera
  misc_feature: Coding regions on vcDNA: vcDNA=SeqID_13242; Strand=+; Position=88-837
EKIGGRNKNQIKQFMAKHVKPQYTVTFNDAKEYIFSSESGEISNSEGDLSQEEKTTPNNLTKSSSAAGIGCEAGDVQSASSISTSILDDGDEVKLLKNKIIELENRNKLLNLEVEKVNLCLINERNKTTKLEKKLQFVKDNQDVFIKLKEAYINMKYNEAAGRKMVEIREKSVQTWEGILCRNCIDAEQLRRQLESVQKTYKDSFIVTPLQLEQLLSTLKYLKELIDRREKTWDEMAERDDKLQAHFNI

SEQ ID NO: 33546 - protein, 48 aa, Diabrotica virgifera
  misc_feature: Coding regions on vcDNA: vcDNA=SeqID_13243; Strand=-; Position=1-144
  misc_feature (16)..(27): Xaa can be any naturally occurring amino acid
  misc_feature (34)..(46): Xaa can be any naturally occurring amino acid
RVKLRSCKILKVCQVXXXXXXXXXXXXIQHRGRXXXXXXXXXXXXXLL

SEQ ID NO: 33547 - protein, 71 aa, Diabrotica virgifera
  misc_feature: Coding regions on vcDNA: vcDNA=SeqID_13244; Strand=-; Position=1-213
FCVSCSFWGIACSTRSASEARYCGLGDDTHRSVSQRCIANIFQWCRHNANHTLRDRNYHYIGRYIVMIPDP

SEQ ID NO: 33548 - protein, 63 aa, Diabrotica virgifera
  misc_feature: Coding regions on vcDNA: vcDNA=SeqID_13245; Strand=+; Position=1-192
  misc_feature (3)..(34): Xaa can be any naturally occurring amino acid
  misc_feature (51)..(56): Xaa can be any naturally occurring amino acid
WGXXXXXXXXXXXXXXXXXXXXXXXXXXXXXXXXPLGNYSRKFYLEKFKFXXXXXXQPPKGWI

SEQ ID NO: 33549 - protein, 56 aa, Diabrotica virgifera
  misc_feature: Coding regions on vcDNA: vcDNA=SeqID_13246; Strand=-; Position=534-704
  misc_feature (36)..(36): Xaa can be any naturally occurring amino acid
IKFYYLLSYYIYSKCIFIYTYIYIKLRESSHRKTYXWRIKAFHKVHRFIKFVFHHP

SEQ ID NO: 33550 - protein, 289 aa, Diabrotica virgifera
  misc_feature: Coding regions on vcDNA: vcDNA=SeqID_13247; Strand=+; Position=2-871
  misc_feature: Homolog annotation: Hit_ID=XP_394532.1; Match level="QueryCoverage =86%, HitCoverage=54%, E-value=2e-63, Identity=42%"; Hit description =similar to CG8079-PA [Apis mellifera]
  misc_feature: Pfam annotation: Pfam_ID=FHA; Match level="Score=42.8, E-value=9.9e -10, Copies=1"; Pfam description=FHA domain
  misc_feature (106)..(111): Xaa can be any naturally occurring amino acid
DLEESYSATDNTEAIETAENTQKSLVDDIKEAAEIAMQKTGFVYEETSGLYYDYNTGYYYNAEYGLYYDGTTGKYLQYNSETQTYEYHSQVAVPSLDADRVENAIXXXXXXHKIKVKTSSDMDELLLSFNNMNINTLRTNALDISKSWPPCMRIIVESTEIPGLKKGSLHIITCSGGSLGREGAHSILLKDPNASKHHLKITFDEKGGQYQAVDLGSRNGTLLNGKRMSPSKQESDAMDVVHGSKIQIGQTVLLCHVHDGNQTCGHCEPRTYSSCRTSTRKNIQLQEIK

SEQ ID NO: 33551 - protein, 34 aa, Diabrotica virgifera
  misc_feature: Coding regions on vcDNA: vcDNA=SeqID_13248; Strand=+; Position=3-107
RDSLILSDTTIFGYLTSCENYIGLGFGDFSRLLI

SEQ ID NO: 33552 - protein, 245 aa, Diabrotica virgifera
  misc_feature: Coding regions on vcDNA: vcDNA=SeqID_13249; Strand=+; Position=103-840
  misc_feature: Homolog annotation: Hit_ID=EAA01246.3; Match level="QueryCoverage =99%, HitCoverage=81%, E-value=1e-59, Identity=44%"; Hit description =ENSANGP00000024653 [Anopheles gambiae str. PEST] ref|XP_550786.1| ENSANGP00000024653 [Anopheles gambiae st
  misc_feature: Gene Ontology Annotation: Molecular function=prenyltransferase activity; Cellular component=lipid particle; Biological process =protein modification
  misc_feature: Pfam annotation: Pfam_ID=Prenyltransf; Match level="Score=206.6, E -value=5.1e-59, Copies=1"; Pfam description=Putative undecaprenyl diphosphate syn
  misc_feature (104)..(113): Xaa can be any naturally occurring amino acid
MPWIQPKLSIFHKFFLRVLKQGPIPEHIAIIMDGNRRFAKNKKIETIQAHSLGFSTLIECHEWFRELGIRELTVYAFSTENLKRTKKEVDGLMQLAEETFSDVXXXXXXXXXXGIRLRIIGDVTKMPEHVRKAMDRACEVTKDNNEFIFNVAFFYVARDEIAASVKSVVEGVQEGCFKCEDISEDLISKSLYSQFDKNPDMMIRTSGEVRLSDFLLWQLSEKYLYFTDVLWADFSLWHLFTIIFS

SEQ ID NO: 33553 - protein, 24 aa, Diabrotica virgifera
  misc_feature: Coding regions on vcDNA: vcDNA=SeqID_13250; Strand=+; Position=3-77
RLPAKNHSTLCTKLNQILFITCDI

SEQ ID NO: 33554 - protein, 55 aa, Diabrotica virgifera
  misc_feature: Coding regions on vcDNA: vcDNA=SeqID_13251; Strand=-; Position=17-184
YLNTNYSFFLKNYSIILHFYSFQNYYILFNFFLINIYLSPLCLSHPTHHTLRETF

SEQ ID NO: 33555 - protein, 46 aa, Diabrotica virgifera
  misc_feature: Coding regions on vcDNA: vcDNA=SeqID_13252; Strand=-; Position=1-138
  misc_feature (6)..(12): Xaa can be any naturally occurring amino acid
  misc_feature (19)..(46): Xaa can be any naturally occurring amino acid
LSLRAXXXXXXXIMFPEPXXXXXXXXXXXXXXXXXXXXXXXXXXXX

SEQ ID NO: 33556 - protein, 89 aa, Diabrotica virgifera
  misc_feature: Coding regions on vcDNA: vcDNA=SeqID_13253; Strand=-; Position=19-288
  misc_feature (23)..(31): Xaa can be any naturally occurring amino acid
  misc_feature (39)..(46): Xaa can be any naturally occurring amino acid
  misc_feature (88)..(88): Xaa can be any naturally occurring amino acid
GIASRVCVEFASHTSCSVSLRVXXXXXXXXXILFSRSRXXXXXXXXRSVVNRCWNTSQSSTCFFFTLHKSIRFPSVYCNFKGCSPVCXK

SEQ ID NO: 33557 - protein, 105 aa, Diabrotica virgifera
  misc_feature: Coding regions on vcDNA: vcDNA=SeqID_13254; Strand=-; Position=117-434
FCIRFSYLPLLILSFIPPYPFQPWSSHYFPSSFHFSITFYTRHPFETVLSPSSYSQSPNYPITITPSPLFSFSHHCTPSISVCTSISLFLSFDFPHFSKYNFFPF

SEQ ID NO: 33558 - protein, 145 aa, Diabrotica virgifera
  misc_feature: Coding regions on vcDNA: vcDNA=SeqID_13255; Strand=+; Position=222-659
  misc_feature: Homolog annotation: Hit_ID=NP_650953.1; Match level="QueryCoverage =94%, HitCoverage=24%, E-value=2e-21, Identity=35%"; Hit description =CG7000-PA [Drosophila melanogaster] gb|AAF55863.2| CG7000-PA [Drosophila melanogaster]
  misc_feature: Gene Ontology Annotation: Molecular function=cell adhesion molecule activity; Cellular component=integral to membrane; Biological process=apoptosis
MTLVNDFSVCVKGGPVMVSFPHLLYGDKEYQQTVIGMEANTMKHQSFIILEELSGLPLYAAQRIQFNMFLRPVEGMESLANMSKALMPLIWVEESLIIEDKYISLLQESLFKTLSTVNILKWFVIVIGVACLLISALTLIYRQAP

SEQ ID NO: 33559 - protein, 88 aa, Diabrotica virgifera
  misc_feature: Coding regions on vcDNA: vcDNA=SeqID_13256; Strand=+; Position=281-547
  misc_feature (11)..(20): Xaa can be any naturally occurring amino acid
  misc_feature (52)..(62): Xaa can be any naturally occurring amino acid
MYLYTLRIYLXXXXXXXXXXSILRDELKKESLLKFKLYIKIMIKNCYILKYXXXXXXXXXXXMFNQFFIKPHISTYLILGLMIILPYQ

SEQ ID NO: 33560 - protein, 179 aa, Diabrotica virgifera
  misc_feature: Coding regions on vcDNA: vcDNA=SeqID_13257; Strand=-; Position=0-536
  misc_feature (23)..(34): Xaa can be any naturally occurring amino acid
  misc_feature (46)..(64): Xaa can be any naturally occurring amino acid
  misc_feature (69)..(82): Xaa can be any naturally occurring amino acid
  misc_feature (96)..(111): Xaa can be any naturally occurring amino acid
  misc_feature (118)..(178): Xaa can be any naturally occurring amino acid
APPRPFFCLVGERRRRGRGRATXXXXXXXXXXXXRGLFVFFVCKHXXXXXXXXXXXXXXXXXXXEGWGXXXXXXXXXXXXXXLGVGLLSNVRGEIXXXXXXXXXXXXXXXXAGRGRGXXXXXXXXXXXXXXXXXXXXXXXXXXXXXXXXXXXXXXXXXXXXXXXXXXXXXXXXXXXXXG

SEQ ID NO: 33561 - protein, 22 aa, Diabrotica virgifera
  misc_feature: Coding regions on vcDNA: vcDNA=SeqID_13258; Strand=-; Position=1-66
  misc_feature (18)..(22): Xaa can be any naturally occurring amino acid
GDEGGNRRVMRRKNNNRXXXXX

SEQ ID NO: 33562 - protein, 37 aa, Diabrotica virgifera
  misc_feature: Coding regions on vcDNA: vcDNA=SeqID_13259; Strand=-; Position=2-112
  misc_feature (27)..(28): Xaa can be any naturally occurring amino acid
FRHPHRFQLFCNSFKFIVNGIKGSLFXXPIFIRTLLV

SEQ ID NO: 33563 - protein, 93 aa, Diabrotica virgifera; identical to SEQ ID NO: 27329
  misc_feature: Coding regions on vcDNA: vcDNA=SeqID_13260; Strand=+; Position=477-758
  misc_feature (25)..(55): Xaa can be any naturally occurring amino acid

SEQ ID NO: 33564 - protein, 45 aa, Diabrotica virgifera
  misc_feature: Coding regions on vcDNA: vcDNA=SeqID_13261; Strand=-; Position=0-134
  misc_feature (9)..(44): Xaa can be any naturally occurring amino acid
SFSLILREXXXXXXXXXXXXXXXXXXXXXXXXXXXXXXXXXXXXG

SEQ ID NO: 33565 - protein, 325 aa, Diabrotica virgifera
  misc_feature: Coding regions on vcDNA: vcDNA=SeqID_13262; Strand=+; Position=464 -1438
  misc_feature: Homolog annotation: Hit_ID=CAB62280.1; Match level="QueryCoverage =98%, HitCoverage=80%, E-value=1e-25, Identity=34%"; Hit description =hydroxyproline-rich glycoprotein DZ-HRGP [Volvox carteri f. nagariensis]
  misc_feature: Gene Ontology Annotation: Molecular function=acrosin activity; Cellular component=extracellular space; Biological process=acrosome reaction
  misc_feature (71)..(71): Xaa can be any naturally occurring amino acid
  misc_feature (75)..(85): Xaa can be any naturally occurring amino acid
  misc_feature (90)..(101): Xaa can be any naturally occurring amino acid
  misc_feature (123)..(144): Xaa can be any naturally occurring amino acid
  misc_feature (147)..(153): Xaa can be any naturally occurring amino acid
  misc_feature (170)..(195): Xaa can be any naturally occurring amino acid
  misc_feature (197)..(204): Xaa can be any naturally occurring amino acid
  misc_feature (208)..(208): Xaa can be any naturally occurring amino acid
  misc_feature (213)..(231): Xaa can be any naturally occurring amino acid
  misc_feature (233)..(251): Xaa can be any naturally occurring amino acid
  misc_feature (293)..(306): Xaa can be any naturally occurring amino acid
FTYHCDTPFLFLSPENSPPSHPPHPRTTPTPLSTPPHPPPPKPPHPQPPPTSPPTPPSPPSLHPSPSPSPXPPPXXXXXXXXXXXPSSSXXXXXXXXXXXXSLPHTHLPSPTPHTPTLLSPFXXXXXXXXXXXXXXXXXXXXXXPSXXXXXXXAPPLFPPPSSPHPLPPXXXXXXXXXXXXXXXXXXXXXXXXXXPXXXXXXXXPPPXPRPSXXXXXXXXXXXXXXXXXXXPXXXXXXXXXXXXXXXXXXXPPPTLLPYPPPTPPSPPHLTASYPPPPLVLLSSSPRPHRPPXXXXXXXXXXXXXXLSPRPPHPPPPSRPPPRRP

SEQ ID NO: 33566 - protein, 41 aa, Diabrotica virgifera
  misc_feature: Coding regions on vcDNA: vcDNA=SeqID_13263; Strand=-; Position=1-123
  misc_feature (10)..(39): Xaa can be any naturally occurring amino acid
KKFRFFSLRXXXXXXXXXXXXXXXXXXXXXXXXXXXXXXHP

SEQ ID NO: 33567 - protein, 213 aa, Diabrotica virgifera
  misc_feature: Coding regions on vcDNA: vcDNA=SeqID_13264; Strand=+; Position=128-769
  misc_feature: Homolog annotation: Hit_ID=XP_392449.1; Match level="QueryCoverage =92%, HitCoverage=17%, E-value=1e-68, Identity=64%"; Hit description =similar to CG4752-PA [Apis mellifera]
  misc_feature: Gene Ontology Annotation: Molecular function=molecular_function unknown; Cellular component=cellular_component unknown; Biological process=glutamate metabolism
  misc_feature: Pfam annotation: Pfam_ID=Hydant_A_N; Match level="Score=255.1, E -value=1.2e-73, Copies=1"; Pfam description=Hydantoinase/oxoprolinase N-terminal r
MERPCKKFRFAIDRGGTFTDVFAKCPNGKIRVLKLLSEDPQHYKDAPTEGIRRILHEETGHALDSEGNVDSSLIEWIRMGTTVATNALLERKGEKMAFIINKGYKDLLLIGNQARPKIFDLNIRRPEILYSSVVEVDCRVIPMLEGKCKLEPQYTSKWRIVEGKTGEKFYVTKELDKEEVKQSLLKLKENGIESISVAMLHSYTVYEHELEIK

SEQ ID NO: 33568 - protein, 43 aa, Diabrotica virgifera
  misc_feature: Coding regions on vcDNA: vcDNA=SeqID_13265; Strand=-; Position=1-129
  misc_feature (2)..(8): Xaa can be any naturally occurring amino acid
LXXXXXXXHNLSPTQPFMPISSRFSNPPFEALTSRTKDRSFRN

SEQ ID NO: 33569 - protein, 88 aa, Diabrotica virgifera
  misc_feature: Coding regions on vcDNA: vcDNA=SeqID_13266; Strand=+; Position=150-416
  misc_feature: Homolog annotation: Hit_ID=XP_312077.1; Match level="QueryCoverage =90%, HitCoverage=27%, E-value=2e-10, Identity=37%"; Hit description =ENSANGP00000016869 [Anopheles gambiae]
NEKEEKVDMLKDWIKQQPHLPHKNNDVLLTRFIYCCNGSIEVAKKLIDLFYSMRLQIPELVSDKDPAHPDIDKGWRDMDLIPLHILTK

SEQ ID NO: 33570 - protein, 24 aa, Diabrotica virgifera
  misc_feature: Coding regions on vcDNA: vcDNA=SeqID_13267; Strand=-; Position=0-71
MGDIIFAGRCGLIGVDIGNKKVIR

SEQ ID NO: 33571 - protein, 86 aa, Diabrotica virgifera
  misc_feature: Coding regions on vcDNA: vcDNA=SeqID_13268; Strand=+; Position=135-395
  misc_feature (5)..(13): Xaa can be any naturally occurring amino acid
  misc_feature (19)..(28): Xaa can be any naturally occurring amino acid
IRIFXXXXXXXXXLTIIKXXXXXXXXXXTIRRCQATHPAHAIEMAIEDTIKQSADKATNNSYHQQVYLSAEGGKILTTWKTTLNNS

SEQ ID NO: 33572 - protein, 50 aa, Diabrotica virgifera
  misc_feature: Coding regions on vcDNA: vcDNA=SeqID_13269; Strand=-; Position=0-149
FWLFFFSLFSLFLSFAFFFGAPGLVVLPSSSFVCLVFFFLSLASALKSAL

SEQ ID NO: 33573 - protein, 20 aa, Diabrotica virgifera
  misc_feature: Coding regions on vcDNA: vcDNA=SeqID_13270; Strand=+; Position=1-60
  misc_feature (1)..(10): Xaa can be any naturally occurring amino acid
XXXXXXXXXXLSSPTIILIF

SEQ ID NO: 33574 - protein, 98 aa, Diabrotica virgifera
  misc_feature: Coding regions on vcDNA: vcDNA=SeqID_13271; Strand=+; Position=8-303
  misc_feature (26)..(26): Xaa can be any naturally occurring amino acid
MVFLFQYRPTLPAKRPTSAIPPSPPXPPTPPHRPPPAPLLGGPWRNGFFTFPTTIFESVPKRTTYHRTLASAFGTPFLLRPLLAAHSTRPPPGHTPRP

SEQ ID NO: 33575 - protein, 96 aa, Diabrotica virgifera
  misc_feature: Coding regions on vcDNA: vcDNA=SeqID_13272; Strand=+; Position=244-531
  misc_feature (3)..(10): Xaa can be any naturally occurring amino acid
LKXXXXXXXXEKLTPWGNRRRNRERISCERKPTNGDRMWNTSCTNSILQKTGTDADFYYAPRITQDLLLLAKQAPPTHSALNIHPTGNPLFLPGTT

SEQ ID NO: 33576 - protein, 41 aa, Diabrotica virgifera
  misc_feature: Coding regions on vcDNA: vcDNA=SeqID_13273; Strand=-; Position=112-237
  misc_feature (20)..(29): Xaa can be any naturally occurring amino acid
VNPQIYVSRHFASRHYHYLXXXXXXXXXXYSSSSRQLIIYI

SEQ ID NO: 33577 - protein, 78 aa, Diabrotica virgifera
  misc_feature: Coding regions on vcDNA: vcDNA=SeqID_13274; Strand=+; Position=1-237
LPFRAQRQQTKGAPLQRRTKKRDQEQGAEREKPMQTREEASEEAARRRDHKETNIYLVGAGQEEIKYENDHCRTMCFQ

SEQ ID NO: 33578 - protein, 37 aa, Diabrotica virgifera
  misc_feature: Coding regions on vcDNA: vcDNA=SeqID_13275; Strand=-; Position=2-112
  misc_feature (3)..(34): Xaa can be any naturally occurring amino acid
LIXXXXXXXXXXXXXXXXXXXXXXXXXXXXXXXXPLW

SEQ ID NO: 33579 - protein, 103 aa, Diabrotica virgifera
  misc_feature: Coding regions on vcDNA: vcDNA=SeqID_13276; Strand=+; Position=31-342
  misc_feature: Homolog annotation: Hit_ID=XP_311994.1; Match level="QueryCoverage =94%, HitCoverage=20%, E-value=8e-24, Identity=59%"; Hit description =ENSANGP00000018558 [Anopheles gambiae]
  misc_feature: Gene Ontology Annotation: Molecular function=pre-mRNA splicing factor activity; Cellular component=nucleus; Biological process=mRNA processing
  misc_feature (8)..(8): Xaa can be any naturally occurring amino acid
  misc_feature (78)..(78): Xaa can be any naturally occurring amino acid
  misc_feature (82)..(82): Xaa can be any naturally occurring amino acid
MVCPSNEXTKTDQATAGRNGTQGGEKRLLEQRARRGAKKTTELPAVQIQVTGLSLVGASGPAMEVLCLLNMVTPDELXKNKXYVDVLGDIKEDCIKYEVLRNI

SEQ ID NO: 33580 - protein, 98 aa, Diabrotica virgifera
  misc_feature: Coding regions on vcDNA: vcDNA=SeqID_13277; Strand=-; Position=323-619
  misc_feature (53)..(59): Xaa can be any naturally occurring amino acid
  misc_feature (70)..(78): Xaa can be any naturally occurring amino acid
  misc_feature (91)..(97): Xaa can be any naturally occurring amino acid
HKKFASNNIKRRFFKFLYKMCWFSTLCHYSSHSGAFTKISLATLHTSDFIGYXXXXXXXNLRYNVVLLSXXXXXXXXXPMILPKIYFRDAXXXXXXXL

SEQ ID NO: 33581 - protein, 110 aa, Diabrotica virgifera
  misc_feature: Coding regions on vcDNA: vcDNA=SeqID_13278; Strand=+; Position=233-565
CILSHRRRSQKDDSHLSGHIKNTEEVILTPKAKKSNELTPVKLLQLYLLAENENSAEKRIESWGLKPEYNADAATGLRVPPDHRCLGLDARCEYRMIACIWRKSETVYRR

SEQ ID NO: 33582 - protein, 190 aa, Diabrotica virgifera
  misc_feature: Coding regions on vcDNA: vcDNA=SeqID_13279; Strand=-; Position=3-575
  misc_feature (36)..(188): Xaa can be any naturally occurring amino acid
KSSTCLLIISRLNKFQRGAYLHLSEDCVINRNNCYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDA

SEQ ID NO: 33583 - protein, 85 aa, Diabrotica virgifera
  misc_feature: Coding regions on vcDNA: vcDNA=SeqID_13280; Strand=-; Position=173-430
  misc_feature (2)..(7): Xaa can be any naturally occurring amino acid
SXXXXXXFVGNFKSHNSPQNAPPYSITARRFICRTFPFSLVHRLSLHFCLYQIVKKTVGTSNSIRIICILYENKIEQVQHQKCRK

SEQ ID NO: 33584 - protein, 62 aa, Diabrotica virgifera
  misc_feature: Coding regions on vcDNA: vcDNA=SeqID_13281; Strand=-; Position=1-186
  misc_feature (2)..(62): Xaa can be any naturally occurring amino acid
VXXXXXXXXXXXXXXXXXXXXXXXXXXXXXXXXXXXXXXXXXXXXXXXXXXXXXXXXXXXXX

SEQ ID NO: 33585 - protein, 79 aa, Diabrotica virgifera
  misc_feature: Coding regions on vcDNA: vcDNA=SeqID_13282; Strand=-; Position=3-242
FLTLFRSAQIYSARYGLTAGKRSRIILRLWHLVLMSRAFSRIFSSNRKSLYGETVISLLHSIKFCYNLISHCSVIGRGN

SEQ ID NO: 33586 - protein, 52 aa, Diabrotica virgifera
  misc_feature: Coding regions on vcDNA: vcDNA=SeqID_13283; Strand=-; Position=30-188
TFSYEYRLKLVTPQNSAECEAICVLLSRQGRPILYLRLVFVKILSKIRTLCS

SEQ ID NO: 33587 - protein, 34 aa, Diabrotica virgifera; identical to SEQ ID NO: 27603
  misc_feature: Coding regions on vcDNA: vcDNA=SeqID_13284; Strand=-; Position=80-184

SEQ ID NO: 33588 - protein, 47 aa, Diabrotica virgifera
  misc_feature: Coding regions on vcDNA: vcDNA=SeqID_13285; Strand=-; Position=1-141
  misc_feature (11)..(47): Xaa can be any naturally occurring amino acid
KIFRLFIPLKXXXXXXXXXXXXXXXXXXXXXXXXXXXXXXXXXXXXX

SEQ ID NO: 33589 - protein, 255 aa, Diabrotica virgifera
  misc_feature: Coding regions on vcDNA: vcDNA=SeqID_13286; Strand=-; Position=1-765
  misc_feature (4)..(13): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(255): Xaa can be any naturally occurring amino acid
PFVXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33590 - protein, 152 aa, Diabrotica virgifera
  misc_feature: Coding regions on vcDNA: vcDNA=SeqID_13287; Strand=+; Position=258-716
  misc_feature: Homolog annotation: Hit_ID=XP_309765.1; Match level="QueryCoverage =96%, HitCoverage=32%, E-value=3e-80, Identity=98%"; Hit description =ENSANGP00000002671 [Anopheles gambiae]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin_C; Match level="Score=77.9, E-value =2.7e-20, Copies=1"; Pfam description=Tubulin/FtsZ family, C-terminal domain
VYLFNKACDPRHGRYLTVAAVFRGRMSMKEVDEQMLNIQNKNSSYFVEWIPNNVKTAVCDIPPRGLKMSATFIGNSTAIQELFKRISEQFTAMFRRKAFLHWYTGEGMDEMEFTEAESNMNDLVSEYQQYQEATADEDAEFDEDQEAEIDEN

SEQ ID NO: 33591 - protein, 46 aa, Diabrotica virgifera
  misc_feature: Coding regions on vcDNA: vcDNA=SeqID_13288; Strand=+; Position=51-188
TQTKLFSDPCLCSSMIYPVFTDCVTICDTQKLESIMVQILMLNRNV

SEQ ID NO: 33592 - protein, 76 aa, Diabrotica virgifera
  misc_feature: Coding regions on vcDNA: vcDNA=SeqID_13289; Strand=+; Position=150-380
GVIFGVVDVYVPTCKIIDMGLDLIYDYFTYHMYLTYKSNFLIFIFWRCELMPDFFFFITRYFRELVERIIFFIIVM

SEQ ID NO: 33593 - protein, 89 aa, Diabrotica virgifera
  misc_feature: Coding regions on vcDNA: vcDNA=SeqID_13290; Strand=-; Position=1-267
  misc_feature (4)..(23): Xaa can be any naturally occurring amino acid
  misc_feature (27)..(36): Xaa can be any naturally occurring amino acid
  misc_feature (46)..(53): Xaa can be any naturally occurring amino acid
  misc_feature (56)..(68): Xaa can be any naturally occurring amino acid
  misc_feature (75)..(87): Xaa can be any naturally occurring amino acid
PLDXXXXXXXXXXXXXXXXXXXXSFCXXXXXXXXXXTNLAHTGLNXXXXXXXXRTXXXXXXXXXXXXXIQHRGRXXXXXXXXXXXXXLL

SEQ ID NO: 33594 - protein, 85 aa, Diabrotica virgifera
  misc_feature: Coding regions on vcDNA: vcDNA=SeqID_13291; Strand=-; Position=0-254
  misc_feature (3)..(84): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 33595 - protein, 115 aa, Diabrotica virgifera
  misc_feature: Coding regions on vcDNA: vcDNA=SeqID_13292; Strand=+; Position=196-543
  misc_feature (42)..(48): Xaa can be any naturally occurring amino acid
  misc_feature (52)..(67): Xaa can be any naturally occurring amino acid
  misc_feature (75)..(83): Xaa can be any naturally occurring amino acid
PRSWIKDYNGCNNYIIKSRSTFIILHDLSLNQEMKQVEVYLXXXXXXXYKRXXXXXXXXXXXXXXXXTKKKEDIXXXXXXXXXEKKERGDGLRETKLKYGGLERKSSLKGPPKFN

SEQ ID NO: 33596 - protein, 57 aa, Diabrotica virgifera
  misc_feature: Coding regions on vcDNA: vcDNA=SeqID_13293; Strand=-; Position=2-172
  misc_feature (9)..(57): Xaa can be any naturally occurring amino acid
KVKDYFLVXXXXXXXXXXXXXXXXXXXXXXXXXXXXXXXXXXXXXXXXXXXXXXXXX

SEQ ID NO: 33597 - protein, 77 aa, Diabrotica virgifera
  misc_feature: Coding regions on vcDNA: vcDNA=SeqID_13294; Strand=-; Position=1-231
  misc_feature (59)..(65): Xaa can be any naturally occurring amino acid
FAPLRLCTRNPILAGLGFQRLNDVTTASMLSPRHASSEILLCSVVYSAFRSSTLLQSDXXXXXXXFKKGIVKSLKFY

SEQ ID NO: 33598 - protein, 297 aa, Diabrotica virgifera
  misc_feature: Coding regions on vcDNA: vcDNA=SeqID_13295; Strand=+; Position=1-891
  misc_feature: Homolog annotation: Hit_ID=EAA03886.3; Match level="QueryCoverage =98%, HitCoverage=60%, E-value=3e-55, Identity=35%"; Hit description =ENSANGP00000017205 [Anopheles gambiae str. PEST] ref|XP_560349.1| ENSANGP00000017205 [Anopheles gambiae st
  misc_feature: Gene Ontology Annotation: Cellular component=nucleus; Biological process=cell growth
QTCVQLYEKGLEAYLENRWEGCVVNFEKALEKYRKYRKKVQNCRLKCKSDAEYSEPLYPVDIENLLFFERAIKQTLCIIECQNGSPEILENHNVNMESGNLFEDQRPYEYLHICYFQTKQLEKAASAAFTFLVAHPDNKVMSTNLKHYLDHNVEKKDIVNYEAKDYVYLYAHGADAYEKKEWQFVVFNMEESLVHYLQAEEECRAQCEGPFDHGWYPDFIPSISNHFTVALRCKQKCRKKLSSLNGEIHDDLLPSHYHYLQYAYYKLGNLKAACQAVASYLLFYPDDETMLDNMRYY

SEQ ID NO: 33599 - protein, 126 aa, Diabrotica virgifera
  misc_feature: Coding regions on vcDNA: vcDNA=SeqID_13296; Strand=-; Position=0-377
  misc_feature (3)..(14): Xaa can be any naturally occurring amino acid
  misc_feature (26)..(37): Xaa can be any naturally occurring amino acid
  misc_feature (39)..(125): Xaa can be any naturally occurring amino acid
PPXXXXXXXXXXXXLTMSLMLFYNFXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 33600 - protein, 169 aa, Diabrotica virgifera
  misc_feature: Coding regions on vcDNA: vcDNA=SeqID_13297; Strand=-; Position=144-653
  misc_feature (25)..(31): Xaa can be any naturally occurring amino acid
  misc_feature (33)..(61): Xaa can be any naturally occurring amino acid
  misc_feature (74)..(97): Xaa can be any naturally occurring amino acid
  misc_feature (104)..(117): Xaa can be any naturally occurring amino acid
PPPSGGGERPPFPPRGSGRKQKIGXXXXXXXVXXXXXXXXXXXXXXXXXXXXXXXXXXXXXHKKPQIFYTPPEXXXXXXXXXXXXXXXXXXXXXXXXGGFSPFXXXXXXXXXXXXXXPILPPNHPFLNFLGNFCKVFFPKWGPFTFGFFGPFDPFGKKGRVEFFVQIFC

SEQ ID NO: 33601 - protein, 98 aa, Diabrotica virgifera
  misc_feature: Coding regions on vcDNA: vcDNA=SeqID_13298; Strand=+; Position=154-450
HNFWRKCKVILKKEGGGTVWDPQMGNCLTCFKEPTQTALDDPITHKNKEGNSDTHRHNQGGFGGYNPPPIGMKFELYVLNTIARRELSVVGTPPFREK

SEQ ID NO: 33602 - protein, 123 aa, Diabrotica virgifera
  misc_feature: Coding regions on vcDNA: vcDNA=SeqID_13299; Strand=+; Position=433-801
SEYTFAIPQNLRHLVAPLNPEYKYYIGHTVEFWKLPYNTVDSGIVLSEGSLKSLRRNINRNDCLSFSFSNREDYYLGKSLAQLNITPIDIRDENGFTLFFPSSLNSLIFYEDSQYQSSIFPIK

SEQ ID NO: 33603 - protein, 61 aa, Diabrotica virgifera
  misc_feature: Coding regions on vcDNA: vcDNA=SeqID_13300; Strand=+; Position=2-187
  misc_feature (1)..(38): Xaa can be any naturally occurring amino acid
XXXXXXXXXXXXXXXXXXXXXXXXXXXXXXXXXXXXXXCITGYWGRVYTNGRDQNRMTDVL

SEQ ID NO: 33604 - protein, 67 aa, Diabrotica virgifera
  misc_feature: Coding regions on vcDNA: vcDNA=SeqID_13301; Strand=-; Position=1-201
  misc_feature (10)..(19): Xaa can be any naturally occurring amino acid
  misc_feature (49)..(57): Xaa can be any naturally occurring amino acid
HVLVFPSNSXXXXXXXXXXISIVYIYFWMFYDMYNFVSYLLCNHFILNXXXXXXXXXQQCLILLIYH

SEQ ID NO: 33605 - protein, 224 aa, Diabrotica virgifera
  misc_feature: Coding regions on vcDNA: vcDNA=SeqID_13302; Strand=+; Position=76-747
  misc_feature: Homolog annotation: Hit_ID=NP_648894.2; Match level="QueryCoverage =96%, HitCoverage=41%, E-value=1e-69, Identity=59%"; Hit description =CG4573-PA [Drosophila melanogaster] gb|AAF49463.1| CG4573-PA [Drosophila melanogaster]
  misc_feature: Gene Ontology Annotation: Molecular function=glutamate-tRNA ligase activity; Cellular component=mitochondrion; Biological process =glutamyl-tRNA aminoacylation
  misc_feature: Pfam annotation: Pfam_ID=tRNA-synt_1c; Match level="Score=49.8, E -value=8.5e-17, Copies=1"; Pfam description=tRNA synthetases class I (E and Q), c
  misc_feature (49)..(55): Xaa can be any naturally occurring amino acid
MFLSVKGIVSRQLLCKLCMRTYNTQGSVRVRFAPSPTGFLHLGGLRTAXXXXXXXKKHHGKFILRIEDTDQTRLVPGAAEQLQEDLKWAGIDIDEGPLQGGNVGPYFQSKRLDIYKDQVQVLLENGSAYRCFCTDKRLELLRKEALRKQEIPKYDNKCRHLTKETLKSHLDSGKPYCIRFKISYKEESFADMIYGKITYNISLNEGDPVILKIRRLSQPYHFAN

SEQ ID NO: 33606 - protein, 46 aa, Diabrotica virgifera
  misc_feature: Coding regions on vcDNA: vcDNA=SeqID_13303; Strand=-; Position=2-139
  misc_feature (7)..(46): Xaa can be any naturally occurring amino acid
KEFKAFXXXXXXXXXXXXXXXXXXXXXXXXXXXXXXXXXXXXXXXX

SEQ ID NO: 33607 - protein, 231 aa, Diabrotica virgifera
  misc_feature: Coding regions on vcDNA: vcDNA=SeqID_13304; Strand=+; Position=100-795
  misc_feature: Homolog annotation: Hit_ID=NP_523581.1; Match level="QueryCoverage =87%, HitCoverage=56%, E-value=2e-84, Identity=73%"; Hit description =CG5876-PA [Drosophila melanogaster] gb|AAF53515.1| CG5876-PA [Drosophila melanogaster]
  misc_feature: Pfam annotation: Pfam_ID=UbiA; Match level="Score=-68.5, E-value =0.08, Copies=1"; Pfam description=UbiA prenyltransferase family
MTETLAAEEKPLTNNGRAASSPVPTKRTSGGLMKLSSYVLALRPWSLSASLIPTLLGSTIAYKYPGSSDFNYITLFFTILTIISVHGAGNVVNTYFDYVKGIDNRKSDDRILVDHILSKDEVVSLGAILYFAGCIGFIILANISPAKMEHLALVYFGGLSSSFLYTGGIGFKYIALGDVLILIIFAPISVLFAFMSQTGHVEWATIYYALPLALNTEGILHSNNTRDSEPE

SEQ ID NO: 33608 - protein, 92 aa, Diabrotica virgifera
  misc_feature: Coding regions on vcDNA: vcDNA=SeqID_13305; Strand=+; Position=284-559
QQYENTLITSSNRYILEQTIYDMVSKFQLTPPYPTFDHPTILIKYPHLHAPRKLSLYLRTPDWTIHFTCRKYKLYYHCSRKAKQLLVSSPFF

SEQ ID NO: 33609 - protein, 147 aa, Diabrotica virgifera
  misc_feature: Coding regions on vcDNA: vcDNA=SeqID_13306; Strand=+; Position=13-458
  misc_feature: Homolog annotation: Hit_ID=NP_788476.1; Match level="QueryCoverage =71%, HitCoverage=23%, E-value=3e-23, Identity=53%"; Hit description =CG7176-PG, isoform G [Drosophila melanogaster] ref|NP_729366.1| CG7176-PB, isoform B [Drosophila
  misc_feature: Gene Ontology Annotation: Molecular function=isocitrate dehydrogenase (NADP+) activity; Cellular component=cytosol; Biological process =glutathione metabolism
  misc_feature (63)..(63): Xaa can be any naturally occurring amino acid
  misc_feature (76)..(76): Xaa can be any naturally occurring amino acid
  misc_feature (90)..(90): Xaa can be any naturally occurring amino acid
  misc_feature (110)..(110): Xaa can be any naturally occurring amino acid
AQELTVTVFESPCWTKATNIVRNYGRLPSGCILIHYLIKIILYAIKEKLILPYLYFALLLYDXRIENRDKTNDHIXIKCAEAIHTYHSGXKCDTITPDDNRSIVVTLKQXWKSPNKSITNLLPGTVFRKPFIRGRIPRLSTVPATTL

SEQ ID NO: 33610 - protein, 245 aa, Diabrotica virgifera
  misc_feature: Coding regions on vcDNA: vcDNA=SeqID_13307; Strand=+; Position=54-791
  misc_feature: Homolog annotation: Hit_ID=AAL48921.1; Match level="QueryCoverage =97%, HitCoverage=96%, E-value=7e-74, Identity=56%"; Hit description =RE32803p [Drosophila melanogaster]
  misc_feature: Gene Ontology Annotation: Molecular function=molecular_function unknown; Biological process=male courtship behavior
  misc_feature: Pfam annotation: Pfam_ID=DUF233; Match level="Score=135.3, E-value =1.4e-37, Copies=1"; Pfam description=Odorant binding protein
MNYWSFFCALFAVLCFAEAENYYFIKKCYKEDKNLNMCLRQSTNFLIANLRRGIPELDIYDPEPILIDQIQLALGTGPDGYRAIFRDIEAFGVSNLTVTAVRSDIETNQYQFTMYIPKITAKARYESSGVLILVQASGGGNYWGEYEGVKIKVYLKGSPRVINDKTYLIVQQMKMDFSVKDIKMGVDGIHNGNTVLQAALNLFINSNSQELLKEMKPHLKKKLLILMRNFADKVFSQEPYEAFIA

SEQ ID NO: 33611 - protein, 106 aa, Diabrotica virgifera
  misc_feature: Coding regions on vcDNA: vcDNA=SeqID_13308; Strand=-; Position=82-402
SYFTKKISPLPGFLDTAICISRPSGLYFLLSNRHQTIKLIIFNYSPPPTFSNLDHLLQTKNKHILPILYFPFPHIFFTSVPTHHFSSNISFLIAGTLLPSPSLFYH

SEQ ID NO: 33612 - protein, 16 aa, Diabrotica virgifera
  misc_feature: Coding regions on vcDNA: vcDNA=SeqID_13309; Strand=+; Position=1-48
LLLINMSYLVRLFRTN

SEQ ID NO: 33613 - protein, 22 aa, Diabrotica virgifera
  misc_feature: Coding regions on vcDNA: vcDNA=SeqID_13310; Strand=+; Position=5-70
YFITTTYYLNSLYSCACYLYEA

SEQ ID NO: 33614 - protein, 301 aa, Diabrotica virgifera
  misc_feature: Coding regions on vcDNA: vcDNA=SeqID_13311; Strand=+; Position=3-905
  misc_feature (92)..(97): Xaa can be any naturally occurring amino acid
KTSEKMSEGDVVNTSEEVQENQEVVEESIAPVKSVKNVEAAPPNLFDIFKPKDAANADKDGAKPEDKPADGTKPADETKPADGTTEAKPNIXXXXXXKDKDTTEHKPPGFNLFDPLHLKDKAKDTKDDKPPNLLGNIFDPLHLKDKGKDISEKASDAVEKGTDDKPAPVNLLGNLLDPLHLKDKAKEQTSRPTMQDEATDKSTDSTEKPQHILGNLLDPLHLKDKPNSSEEKPGLNLLDNMLDPLHLKDKAKDLTEKIAGAAENFADPLKLKDKDKTSNPGDILGNILDPLHLKDKAKGNI

SEQ ID NO: 33615 - protein, 313 aa, Diabrotica virgifera
  misc_feature: Coding regions on vcDNA: vcDNA=SeqID_13312; Strand=+; Position=1-942
  misc_feature (269)..(299): Xaa can be any naturally occurring amino acid
ALKNFLKCPGCEIPFTEPIFQCLKGHALCKDCKDKADGDGSKCFFCDAHIDNTRNYIVEETIANLKLNKDSPSTFQDAEVVCPTSKCHQKVKLSAITHFKESHIENFHFNKFYLKNVYGYYNVEVLVKNEKTYLLFFDFDDQQFGVSVCSIEDTDETFDLMLLSDNKKFFILAEDQKIIKFNDKEHCFKCSRGTCKISDHIYKVKRKEIFRRLTTKLNRDAVKYRTNTLNYQIVLKEYKEDKTDKLIKQLFECPICKDYMIPPIPQCKXXXXXXXXXXXXXXXXXXXXXXXXXXXXXXXQKNCKRGFEKPCSF

SEQ ID NO: 33616 - protein, 192 aa, Diabrotica virgifera
  misc_feature: Coding regions on vcDNA: vcDNA=SeqID_13313; Strand=+; Position=1-576
  misc_feature: Homolog annotation: Hit_ID=XP_318963.1; Match level="QueryCoverage =100%, HitCoverage=27%, E-value=3e-76, Identity=73%"; Hit description= ENSANGP00000014782 [Anopheles gambiae]
  misc_feature: Gene Ontology Annotation: Molecular function=xenobiotic-transporting ATPase activity; Cellular component=integral to membrane; Biological process=transport
  misc_feature: Pfam annotation: Pfam_ID=ABC_tran; Match level="Score=-1.1, E-value =6.4e-06, Copies=1"; Pfam description=ABC transporter
  misc_feature (94)..(106): Xaa can be any naturally occurring amino acid
KLSAYIMQDNQLHANLRVDEAMAVAAALKIGAKSPKDREDIINEILDTLGLLDHKKTMTSGLSGGQKKRLSIALELVSNPPVMFFDEPTSGLDXXXXXXXXXXXXXLAKGGRTIICTIHQPSARLFEMFDQLYTLADGQCVYQGSTTFLVPFLASLQLQCPSYHNPASYIIEVACGEYGDHTRTLVNAIENG

SEQ ID NO: 33617 - protein, 77 aa, Diabrotica virgifera
  misc_feature: Coding regions on vcDNA: vcDNA=SeqID_13314; Strand=+; Position=137-370
RITYCCMYYVHTPIQDRRRCAKKLNARYNNLKITPPNLDPTKSSRGRQCEAKLPNINDTNEFASCHPITTHKATNFA

SEQ ID NO: 33618 - protein, 70 aa, Diabrotica virgifera
  misc_feature: Coding regions on vcDNA: vcDNA=SeqID_13315; Strand=+; Position=151-363
TVYLVLIAGILLINITLLVLIQIKMFNVLTALWNKLTSYYINSWLSQLCTNTQQQMGYTGHIICLVTNSM

SEQ ID NO: 33619 - protein, 52 aa, Diabrotica virgifera
  misc_feature: Coding regions on vcDNA: vcDNA=SeqID_13316; Strand=+; Position=213-371
LQELMGCAQHHDASNNDLHIDLFYIILNNALKIKEGEDTLPDNEDEFELASS

SEQ ID NO: 33620 - protein, 120 aa, Diabrotica virgifera
  misc_feature: Coding regions on vcDNA: vcDNA=SeqID_13317; Strand=+; Position=61-423
  misc_feature: Homolog annotation: Hit_ID=CAG25527.1; Match level="QueryCoverage =80%, HitCoverage=88%, E-value=9e-41, Identity=77%"; Hit description =putative FK506-binding protein [Suberites ficus]
  misc_feature: Gene Ontology Annotation: Molecular function=ATP-binding cassette (ABC) transporter activity; Cellular component=membrane; Biological process=transport
  misc_feature: Pfam annotation: Pfam_ID=FKBP_C; Match level="Score=173.7, E-value=4e- 49, Copies=1"; Pfam description=FKBP-type peptidyl-prolyl cis-trans is
FVPNYLSNVRKLLCLDSTVHRIAFGRTFPKTGQFVSVHYTGTLEDGQKFDSSRDRGAPFKFHIGRGEVIKGWDEGVAQLSLGQRAKLTCTADYAYGSRGHPGIIPPNATLIFDVELIAIE

SEQ ID NO: 33621 - protein, 103 aa, Diabrotica virgifera
  misc_feature: Coding regions on vcDNA: vcDNA=SeqID_13318; Strand=-; Position=1-309
  misc_feature (13)..(38): Xaa can be any naturally occurring amino acid
  misc_feature (44)..(60): Xaa can be any naturally occurring amino acid
  misc_feature (84)..(98): Xaa can be any naturally occurring amino acid
MRIVSSLLNLNHXXXXXXXXXXXXXXXXXXXXXXXXXXIRQFLXXXXXXXXXXXXXXXXXSPLKSISYLLFRKYVFIHISVYIXXXXXXXXXXXXXXXVSHLI

SEQ ID NO: 33622 - protein, 92 aa, Diabrotica virgifera
  misc_feature: Coding regions on vcDNA: vcDNA=SeqID_13319; Strand=-; Position=131-409
FFIRSIDAKSLLSMKIRDLASPLLLLVDFVGLFFEGFLIRFVIACILFLHTALFNLEAIIEYNIFISFFSFSRTCRHSLMLFTASKLNVLQS

SEQ ID NO: 33623 - protein, 86 aa, Diabrotica virgifera
  misc_feature: Coding regions on vcDNA: vcDNA=SeqID_13320; Strand=+; Position=1-258
  misc_feature (2)..(26): Xaa can be any naturally occurring amino acid
PXXXXXXXXXXXXXXXXXXXXXXXXXQKHLFCCTPSHSRYVASTANQHRYLLFFSLVPFVPDPRPQQHAASSPQPPEHPPPRPFPP

SEQ ID NO: 33624 - protein, 117 aa, Diabrotica virgifera
  misc_feature: Coding regions on vcDNA: vcDNA=SeqID_13321; Strand=+; Position=3-356
  misc_feature (7)..(55): Xaa can be any naturally occurring amino acid
  misc_feature (61)..(102): Xaa can be any naturally occurring amino acid
FITKPCXXXXXXXXXXXXXXXXXXXXXXXXXXXXXXXXXXXXXXXXXXXXXXXXXPLGIRXXXXXXXXXXXXXXXXXXXXXXXXXXXXXXXXXXXXXXXXXXIPNFLGIKNNLFYHK

SEQ ID NO: 33625 - protein, 77 aa, Diabrotica virgifera
  misc_feature: Coding regions on vcDNA: vcDNA=SeqID_13322; Strand=-; Position=2-232
  misc_feature (15)..(22): Xaa can be any naturally occurring amino acid
  misc_feature (25)..(31): Xaa can be any naturally occurring amino acid
  misc_feature (48)..(55): Xaa can be any naturally occurring amino acid
LVINNLVGNNFYAVXXXXXXXXLLXXXXXXXITFSTITIIINEIYRKXXXXXXXXLIFFNAFTLIRLILCTESFRIL

SEQ ID NO: 33626 - protein, 201 aa, Diabrotica virgifera
  misc_feature: Coding regions on vcDNA: vcDNA=SeqID_13323; Strand=+; Position=213-819
  misc_feature: Homolog annotation: Hit_ID=XP_397365.1; Match level="QueryCoverage =97%, HitCoverage=39%, E-value=3e-48, Identity=47%"; Hit description =similar to SUMO1/sentrin specific protease 1 [Apis mellifera]
  misc_feature: Gene Ontology Annotation: Molecular function=endopeptidase activity; Cellular component=nucleus; Biological process=proteolysis and peptidolysis
  misc_feature: Pfam annotation: Pfam_ID=Peptidase_C48; Match level="Score=40.8, E -value=3.9e-09, Copies=1"; Pfam description=Ulp1 protease family, C -terminal catal
  misc_feature (186)..(186): Xaa can be any naturally occurring amino acid
MGCSQQHEKINKDLHIELLSNKINNALKIKEALVPLPEKEAEVELPPLTDEQLRMVSRAFKGDPNEVLSRKFNLNITRRDLLTLSGLNWLNDEVINFYMNMIIERGKDPSYPSCHAFNTFFYTKLLKDGAESLRRWTKKIDIFACDIICIPIHLSMHWCMAIVDMRAQTIKYYDSMGNSNDRVFKXIKKYLEKEHLDKKEI

SEQ ID NO: 33627 - protein, 32 aa, Diabrotica virgifera
  misc_feature: Coding regions on vcDNA: vcDNA=SeqID_13324; Strand=+; Position=3-101
  misc_feature (1)..(6): Xaa can be any naturally occurring amino acid
XXXXXXMASQKMIVRSPSSNRSLRLFGRPFSS

SEQ ID NO: 33628 - protein, 101 aa, Diabrotica virgifera
  misc_feature: Coding regions on vcDNA: vcDNA=SeqID_13325; Strand=+; Position=148-453
PGRRLPSLQPALNALMIILPNKKIVATIHGRHPGLITATLLNTSNIQLHKRPSHRYTTGPSSSSHLTTPLSLNIPLIGQCRAQTITTVLKCSGMTIQPIVP

SEQ ID NO: 33629 - protein, 145 aa, Diabrotica virgifera
  misc_feature: Coding regions on vcDNA: vcDNA=SeqID_13326; Strand=-; Position=3-440
  misc_feature (10)..(18): Xaa can be any naturally occurring amino acid
  misc_feature (21)..(27): Xaa can be any naturally occurring amino acid
  misc_feature (47)..(54): Xaa can be any naturally occurring amino acid
  misc_feature (66)..(74): Xaa can be any naturally occurring amino acid
  misc_feature (105)..(117): Xaa can be any naturally occurring amino acid
  misc_feature (120)..(129): Xaa can be any naturally occurring amino acid
CYILKYAYFXXXXXXXXXLFXXXXXXXHPFKYLIFIIYQYFIIHIFXXXXXXXXSYKISIYLTSDXXXXXXXXXKYLFYHHHFIFLPLLNSIILSYLYFYIHHPXXXXXXXXXXXXXQYXXXXXXXXXXLLKSVSPLSLTLFLTP

SEQ ID NO: 33630 - protein, 113 aa, Diabrotica virgifera
  misc_feature: Coding regions on vcDNA: vcDNA=SeqID_13327; Strand=-; Position=8-349
CGFGSGKGSISTVNLFMRNSFYCGYISAGPPVCVMSSFVSANDKDIGFHVLGDLLLVFPVLYHSLLDLISVQWWTLHIHLQVSLYYYFVNLGLTMYNHYLKGGFSYCISNNVH

SEQ ID NO: 33631 - protein, 62 aa, Diabrotica virgifera
  misc_feature: Coding regions on vcDNA: vcDNA=SeqID_13328; Strand=-; Position=340-528
  misc_feature (23)..(36): Xaa can be any naturally occurring amino acid
  misc_feature (41)..(48): Xaa can be any naturally occurring amino acid
SSLLLINNLNLYFNSDSVTNINXXXXXXXXXXXXXXHLSNXXXXXXXXFSYYFISNLIPTNI

SEQ ID NO: 33632 - protein, 212 aa, Diabrotica virgifera
  misc_feature: Coding regions on vcDNA: vcDNA=SeqID_13329; Strand=-; Position=1-636
  misc_feature (1)..(212): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33633 - protein, 139 aa, Diabrotica virgifera
  misc_feature: Coding regions on vcDNA: vcDNA=SeqID_13330; Strand=+; Position=65-484
  misc_feature: Gene Ontology Annotation: Molecular function=DNA binding; Cellular component=nucleosome; Biological process=nucleosome assembly
  misc_feature: Pfam annotation: Pfam_ID=Histone; Match level="Score=114.6, E-value =2.5e-31, Copies=1"; Pfam description=Core histone H2A/H2B/H3/H4
MSGRGKGGKNKADKYKSRSNRAGLQFPVGRIHRFLRRGNYAHRIGSGAPVYLSAVLEYLAAEVLELAGNAARDNKKTRIIPRHLQLAIRNDEELNKLLSGVTIAQGGVLPNIQAVLLPKKSGTGTAASGGKSTKSQSQD

SEQ ID NO: 33634 - protein, 76 aa, Diabrotica virgifera
  misc_feature: Coding regions on vcDNA: vcDNA=SeqID_13331; Strand=-; Position=137-367
NNVTITHFYIILDDKMGPLTYWGPPQASRCGGLCYAPVIQLSAIDFKENQFFICEIVLYQLLEYYVEGRYDQPKRI

SEQ ID NO: 33635 - protein, 79 aa, Diabrotica virgifera
  misc_feature: Coding regions on vcDNA: vcDNA=SeqID_13332; Strand=-; Position=137-376
LDTVDSKTLESHRPDRRGHLSVLTGRRGNRSTRSVSLRRSRTSAVSRTRGGKPEAPGYMKRPLSRLLSLIKRTSYTGVA

SEQ ID NO: 33636 - protein, 42 aa, Diabrotica virgifera
  misc_feature: Coding regions on vcDNA: vcDNA=SeqID_13333; Strand=-; Position=47-175
WVVVRQLVDNRVIRILLMSIFIIKSVSRNTWLVMYWHIVRYI

SEQ ID NO: 33637 - protein, 30 aa, Diabrotica virgifera
  misc_feature: Coding regions on vcDNA: vcDNA=SeqID_13334; Strand=-; Position=1-90
  misc_feature (4)..(24): Xaa can be any naturally occurring amino acid
  misc_feature (26)..(26): Xaa can be any naturally occurring amino acid
KNWXXXXXXXXXXXXXXXXXXXXXPXNKII

SEQ ID NO: 33638 - protein, 283 aa, Diabrotica virgifera
  misc_feature: Coding regions on vcDNA: vcDNA=SeqID_13335; Strand=+; Position=68-916
  misc_feature: Homolog annotation: Hit_ID=NP_032174.2; Match level="QueryCoverage =83%, HitCoverage=39%, E-value=6e-19, Identity=26%"; Hit description =glycoprotein 5 (platelet) [Mus musculus] gb|AAF08787.1| platelet glycoprotein V [Mus musculus]
  misc_feature: Gene Ontology Annotation: Molecular function=insulin-like growth factor binding; Cellular component=integral to membrane; Biological process=cell adhesion
  misc_feature: Pfam annotation: Pfam_ID=LRR_1; Match level="Score=66.7, E-value=6.4e- 17, Copies=7"; Pfam description=Leucine Rich Repeat
  misc_feature (246)..(246): Xaa can be any naturally occurring amino acid
  misc_feature (261)..(261): Xaa can be any naturally occurring amino acid
MKTVTFLHEPYITDIFIEKQDVPVLKTGIFDGLFLLHTINIRNTNLVTLEPNIFKGLRRIRKISLNFNKIYSVPQNVFTNIPVYIVALRGNGITHISENAFYNLQNLRNLDLSSNNIELLPKNLFVNTKNLKYIDLSYNKLRHFPAVPYKPYPFFDVAFANMVPGEPSFLDLSYNNFSFISYYLLRGIHYIDELRLHNNHIKLISEYAFDDFTKINTLNLDSNDLNEMSEGLLNILTYVDNVRVEXNPWSDAFVCKYTDWXSEHEKSNYMGEEVSFTVIIIFL

SEQ ID NO: 33639 - protein, 37 aa, Diabrotica virgifera
  misc_feature: Coding regions on vcDNA: vcDNA=SeqID_13336; Strand=-; Position=0-110
  misc_feature (1)..(32): Xaa can be any naturally occurring amino acid
  misc_feature (34)..(35): Xaa can be any naturally occurring amino acid
XXXXXXXXXXXXXXXXXXXXXXXXXXXXXXXXKXXKL

SEQ ID NO: 33640 - protein, 22 aa, Diabrotica virgifera
  misc_feature: Coding regions on vcDNA: vcDNA=SeqID_13337; Strand=-; Position=1-66
  misc_feature (1)..(22): Xaa can be any naturally occurring amino acid
XXXXXXXXXXXXXXXXXXXXXX

SEQ ID NO: 33641 - protein, 91 aa, Diabrotica virgifera
  misc_feature: Coding regions on vcDNA: vcDNA=SeqID_13338; Strand=+; Position=3-275
HASAQAHFTPHNTSVSVNSFPFMKSAPIHKWGIHFSGKPNENVVSFLEKVECLRIARGNSEGECYSAAGDLFRDSAFTWYLNNRGSFASWP

SEQ ID NO: 33642 - protein, 270 aa, Diabrotica virgifera
  misc_feature: Coding regions on vcDNA: vcDNA=SeqID_13339; Strand=+; Position=140-949
  misc_feature: Homolog annotation: Hit_ID=XP_318640.1; Match level="QueryCoverage =98%, HitCoverage=80%, E-value=7e-67, Identity=53%"; Hit description =ENSANGP00000021023 [Anopheles gambiae]
  misc_feature: Gene Ontology Annotation: Molecular function=glyoxylate reductase (NADP) activity; Cellular component=cellular_component unknown; Biological process=metabolism
  misc_feature: Pfam annotation: Pfam_ID=2-Hacid_dh_C; Match level="Score=127.8, E -value=2.7e-35, Copies=1"; Pfam description=D-isomer specific 2 -hydroxyacid dehydr
  misc_feature (37)..(43): Xaa can be any naturally occurring amino acid
  misc_feature (179)..(185): Xaa can be any naturally occurring amino acid
  misc_feature (249)..(249): Xaa can be any naturally occurring amino acid
MNNFKVLVTNPTVPDSGITLLNDNGCNVTQLQTESRXXXXXXXRGMDALFWASGIKLDSEVLDAAGPQLKTIGLMSAGYNHVDVEELRKRGIRMGNTPKVLNDAVADIAILLTLAASRRLHEARLSIENGNWVTNDWAWMCGQDITNSTVGIIGLGHIGQTIARRLKGFDIQQLLYTGXXXXXXXIELGAKFVSLNTLLEDSDFVIMVVPLTTETHHMCNEEFFSKMKKTAVFINGSRGEVVDQPALIXALKRRTIFAAGLDVMTPEPLP

SEQ ID NO: 33643 - protein, 205 aa, Diabrotica virgifera
  misc_feature: Coding regions on vcDNA: vcDNA=SeqID_13340; Strand=+; Position=76-693
  misc_feature: Homolog annotation: Hit_ID=NP_651323.3; Match level="QueryCoverage =92%, HitCoverage=91%, E-value=2e-72, Identity=67%"; Hit description =CG11785-PA [Drosophila melanogaster] gb|AAF56382.2| CG11785-PA [Drosophila melanogaster]
  misc_feature: Gene Ontology Annotation: Molecular function=molecular_function unknown; Cellular component=integral to plasma membrane; Biological process=ER to Golgi transport
MDFSHCFLVFISLIVCTNCIMWNLKPNSRKCLREELQQNIPVVGEFDVSEAPGQTVNYVVTDSKGHILAKREAISKGKFSFNTESFDTYEICFISQVAPHIAGVTQEVSLITKHGIETKNYDTYGEAAQLKPIEKELKRLEDLSDAIVQDFAIMRKREEEMRDTNESTNSRVLYFSIFSLCCLMGLATWQVLYLRTYFKAKKLIE

SEQ ID NO: 33644 - protein, 69 aa, Diabrotica virgifera
  misc_feature: Coding regions on vcDNA: vcDNA=SeqID_13341; Strand=+; Position=3-209
  misc_feature (2)..(11): Xaa can be any naturally occurring amino acid
  misc_feature (14)..(34): Xaa can be any naturally occurring amino acid
  misc_feature (38)..(38): Xaa can be any naturally occurring amino acid
  misc_feature (44)..(51): Xaa can be any naturally occurring amino acid
  misc_feature (55)..(69): Xaa can be any naturally occurring amino acid
NXXXXXXXXXXEGXXXXXXXXXXXXXXXXXXXXXALIXFKDERXXXXXXXXINKXXXXXXXXXXXXXXX

SEQ ID NO: 33645 - protein, 188 aa, Diabrotica virgifera
  misc_feature: Coding regions on vcDNA: vcDNA=SeqID_13342; Strand=-; Position=1-567
  misc_feature (1)..(1): Xaa can be any naturally occurring amino acid
  misc_feature (3)..(154): Xaa can be any naturally occurring amino acid
  misc_feature (158)..(188): Xaa can be any naturally occurring amino acid
XPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTQXXXXXXXXXXXXXXXXXXXXXXXXXXXXXXX

SEQ ID NO: 33646 - protein, 76 aa, Diabrotica virgifera
  misc_feature: Coding regions on vcDNA: vcDNA=SeqID_13343; Strand=-; Position=297-527
SFLTIWYTANLGNFPFSLIKKSLVCKKTYPVSRKQNENRITYELFLIIITYTIQTQSLARSSPLTLYNFSRYTEFA

SEQ ID NO: 33647 - protein, 226 aa, Diabrotica virgifera
  misc_feature: Coding regions on vcDNA: vcDNA=SeqID_13344; Strand=-; Position=1-678
  misc_feature (1)..(8): Xaa can be any naturally occurring amino acid
  misc_feature (10)..(40): Xaa can be any naturally occurring amino acid
  misc_feature (43)..(226): Xaa can be any naturally occurring amino acid
XXXXXXXXVXXXXXXXXXXXXXXXXXXXXXXXXXXXXXXXHSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33648 - protein, 82 aa, Diabrotica virgifera
  misc_feature: Coding regions on vcDNA: vcDNA=SeqID_13345; Strand=-; Position=194-442
QYYCVGVPYIIHYHVTSSNLISIIMGVFLGNFPSPTHVKGITAHLFVILCPLSLKSSHTPCPKDTFPPAIVYYYLNIANLSN

SEQ ID NO: 33649 - protein, 112 aa, Diabrotica virgifera
  misc_feature: Coding regions on vcDNA: vcDNA=SeqID_13346; Strand=-; Position=88-426
ISFSHTFIFAAALLRSTLYTLLNISIDAHVPRIFSLMVNLNTTSTSLHDALTYSLVPSTTLYSPCFHASYHLAYHLLSFPIVDERFPDKFWNRNISSPILSFFGYYSGTENR

SEQ ID NO: 33650 - protein, 115 aa, Diabrotica virgifera
  misc_feature: Coding regions on vcDNA: vcDNA=SeqID_13347; Strand=+; Position=542-886
  misc_feature (14)..(23): Xaa can be any naturally occurring amino acid
  misc_feature (32)..(58): Xaa can be any naturally occurring amino acid
  misc_feature (69)..(76): Xaa can be any naturally occurring amino acid
  misc_feature (81)..(90): Xaa can be any naturally occurring amino acid
  misc_feature (92)..(100): Xaa can be any naturally occurring amino acid
  misc_feature (105)..(114): Xaa can be any naturally occurring amino acid
KTVYLLKIYRSTNXXXXXXXXXXINNMSFCIXXXXXXXXXXXXXXXXXXXXXXXXXXXPFIESWNDRLXXXXXXXXSFLHXXXXXXXXXXLXXXXXXXXXLYIIXXXXXXXXXXS

SEQ ID NO: 33651 - protein, 108 aa, Diabrotica virgifera
  misc_feature: Coding regions on vcDNA: vcDNA=SeqID_13348; Strand=+; Position=1-324
  misc_feature (1)..(56): Xaa can be any naturally occurring amino acid
  misc_feature (58)..(72): Xaa can be any naturally occurring amino acid
  misc_feature (77)..(84): Xaa can be any naturally occurring amino acid
XXXXXXXXXXXXXXXXXXXXXXXXXXXXXXXXXXXXXXXXXXXXXXXXXXXXXXXXKXXXXXXXXXXXXXXXVFNCXXXXXXXXVFILLYEENNLLSQCFLINGKYIT

SEQ ID NO: 33652 - protein, 81 aa, Diabrotica virgifera
  misc_feature: Coding regions on vcDNA: vcDNA=SeqID_13349; Strand=-; Position=177-422
  misc_feature (73)..(78): Xaa can be any naturally occurring amino acid
TQLAFSFTFSSAPLLLHSTQYAFLTFVSLPCNLLSLFNCRSGSISSGHPISLIHLWSHHTLENHVYDILLLLXXXXXXAFL

SEQ ID NO: 33653 - protein, 26 aa, Diabrotica virgifera
  misc_feature: Coding regions on vcDNA: vcDNA=SeqID_13350; Strand=-; Position=3-80
  misc_feature (11)..(20): Xaa can be any naturally occurring amino acid
NLQFFYMKSLXXXXXXXXXXYKTSMG

SEQ ID NO: 33654 - protein, 215 aa, Diabrotica virgifera
  misc_feature: Coding regions on vcDNA: vcDNA=SeqID_13351; Strand=-; Position=1-648
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(213): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYI

SEQ ID NO: 33655 - protein, 72 aa, Diabrotica virgifera
  misc_feature: Coding regions on vcDNA: vcDNA=SeqID_13352; Strand=-; Position=2-217
  misc_feature (8)..(19): Xaa can be any naturally occurring amino acid
  misc_feature (29)..(36): Xaa can be any naturally occurring amino acid
  misc_feature (39)..(52): Xaa can be any naturally occurring amino acid
  misc_feature (63)..(71): Xaa can be any naturally occurring amino acid
FLYIGSLXXXXXXXXXXXXTNLAHTGLNXXXXXXXXSTXXXXXXXXXXXXXXPTSRSQSLLSXXXXXXXXXV

SEQ ID NO: 33656 - protein, 66 aa, Diabrotica virgifera
  misc_feature: Coding regions on vcDNA: vcDNA=SeqID_13353; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXXXPTCAHTGLNXXXXXXXXSNXXXXXXXXXXXXXXPTSRSXXXXXXXXXXXXXXV

SEQ ID NO: 33657 - protein, 297 aa, Diabrotica virgifera
  misc_feature: Coding regions on vcDNA: vcDNA=SeqID_13354; Strand=+; Position=3-893
  misc_feature: Homolog annotation: Hit_ID=EAA14559.2; Match level="QueryCoverage =99%, HitCoverage=55%, E-value=1e-125, Identity=77%"; Hit description= ENSANGP00000004677 [Anopheles gambiae str. PEST] ref|XP_553507.1| ENSANGP00000004677 [Anopheles gambiae s
  misc_feature: Gene Ontology Annotation: Molecular function=chaperone activity; Cellular component=cytoplasm; Biological process=regulation of cell cycle
  misc_feature: Pfam annotation: Pfam_ID=Cpn60_TCP1; Match level="Score=-58.2, E -value=2.4e-13, Copies=1"; Pfam description=TCP-1/cpn60 chaperonin family
  misc_feature (15)..(22): Xaa can be any naturally occurring amino acid
  misc_feature (168)..(175): Xaa can be any naturally occurring amino acid
LLTFFLILLASELLXXXXXXXXQKIHPQTIIAGWRKAVDIARKALLETAKDNSSDSEKFREDLMNIARTTLSSKILSQHKEYFAKLAVDAVLRLKGTGDLQSIQLIKKTGGTLEDSFLDEGFLLDKKPGVHQPKRVENAKILIANTPMDTDKIKVFGSHIKVDSMAKXXXXXXXXKEKMKDKVNKILKHNANVFINRQLIYNYPEQLFADAGVMAIEHADFDGIERLALVTGGEIVSTFDHPELVKLGTCKLIEQIMIGEDILLRFSGVALGEACTIVIRGATQQIIDEADRSLHDA

SEQ ID NO: 33658 - protein, 101 aa, Diabrotica virgifera
  misc_feature: Coding regions on vcDNA: vcDNA=SeqID_13355; Strand=-; Position=150-455
LVQHLLPPFLPLEYEGPAHGRQPGAGHGAAARAGANLAEGMSSDGARSRRNWSWLSVGYSWNSNSSNRTWNRSNPIIPRRRPTTRTLQRSWTGSGGWCCSE

SEQ ID NO: 33659 - protein, 88 aa, Diabrotica virgifera
  misc_feature: Coding regions on vcDNA: vcDNA=SeqID_13356; Strand=+; Position=140-406
KTSHSPTVTEYLQQVYLRTSNCPSPSPDLNPIEQLWDIIGRRLRQRLPPPRTLQEVEIVALEIWNDIDHDQIAYLICNISTYLYYYRT

SEQ ID NO: 33660 - protein, 65 aa, Diabrotica virgifera
  misc_feature: Coding regions on vcDNA: vcDNA=SeqID_13357; Strand=+; Position=37-234
DWNSIANNIQVLLWIQQKCLILDFCHIETNTKTNNIFKQSIQQTKKPSKPSRYTILNILIFLWFI

SEQ ID NO: 33661 - protein, 76 aa, Diabrotica virgifera
  misc_feature: Coding regions on vcDNA: vcDNA=SeqID_13358; Strand=+; Position=3-233
  misc_feature (1)..(60): Xaa can be any naturally occurring amino acid
  misc_feature (65)..(73): Xaa can be any naturally occurring amino acid
XXXXXXXXXXXXXXXXXXXXXXXXXXXXXXXXXXXXXXXXXXXXXXXXXXXXXXXXXXXXCLLFXXXXXXXXXLKA

SEQ ID NO: 33662 - protein, 113 aa, Diabrotica virgifera
  misc_feature: Coding regions on vcDNA: vcDNA=SeqID_13359; Strand=+; Position=454-795
  misc_feature: Homolog annotation: Hit_ID=CAE47499.1; Match level="QueryCoverage =98%, HitCoverage=34%, E-value=3e-19, Identity=50%"; Hit description =cathepsin L-like proteinase [Diabrotica virgifera virgifera]
  misc_feature (43)..(43): Xaa can be any naturally occurring amino acid
  misc_feature (52)..(52): Xaa can be any naturally occurring amino acid
  misc_feature (86)..(87): Xaa can be any naturally occurring amino acid
RSCRTFIAAGALERQIFLEEAQTTKYCTLHKLIYCSRDYKTAXDEIEGRPRXAHDYISHNDLPPKTIYMYQADDDYYCQKCIPGIXXINDYTSINKTEDALEEDGLTAEPIAG

SEQ ID NO: 33663 - protein, 68 aa, Diabrotica virgifera
  misc_feature: Coding regions on vcDNA: vcDNA=SeqID_13360; Strand=-; Position=73-279
SSYNVHVYYKFLATKEALRHPAIVRRRGMYRSAGYCYILWGAVLFLNSLFLKIGKWPSSMFTVQFREI

SEQ ID NO: 33664 - protein, 49 aa, Diabrotica virgifera
  misc_feature: Coding regions on vcDNA: vcDNA=SeqID_13361; Strand=-; Position=1-147
  misc_feature (4)..(10): Xaa can be any naturally occurring amino acid
  misc_feature (24)..(49): Xaa can be any naturally occurring amino acid
GGSXXXXXXXFNLLPIKLRCFSLXXXXXXXXXXXXXXXXXXXXXXXXXX

SEQ ID NO: 33665 - protein, 142 aa, Diabrotica virgifera
  misc_feature: Coding regions on vcDNA: vcDNA=SeqID_13362; Strand=+; Position=3-428
LPGCTTMAFTVLFLSFLAVAFSNCYTITQDLLPIFPTQEIIGNNLVRHLPNGENVTIICPDDTILNKDTLTCDFKSQADSRNLVNEIKPCDNNCRQYELCDGGCVDKFCPPPLLFNKILEVCDYPGRANWCEFNAKNNSKIL

SEQ ID NO: 33666 - protein, 270 aa, Diabrotica virgifera
  misc_feature: Coding regions on vcDNA: vcDNA=SeqID_13363; Strand=+; Position=1-813
  misc_feature: Homolog annotation: Hit_ID=XP_394594.1; Match level="QueryCoverage =97%, HitCoverage=65%, E-value=2e-12, Identity=22%"; Hit description =similar to CG32075-PA [Apis mellifera]
  misc_feature: Pfam annotation: Pfam_ID=Las1; Match level="Score=-39.7, E-value =0.028, Copies=1"; Pfam description=Las1-like
SKSEDKLIKALSILQIWKQRMPILPAGIEGTLSILEAILLDESNIPENWLGKVKASALTTFLNVAVHNDKQGNFNKKVSKSFPKWIIDIRHDFCHGTKEISNDNVKIALNLCFEWILDDYWKKENNLRDYILEDTADTNIIDCLNTYIKLTLNIYKGVTMGDEFEHLMNKANYLASKRYNSETLDPSETLKQELSNPKSKKLSAKVAEVLVDNKALFHVHLKKDEVAGVTVIPKPFRDLWTKLLLLFDHGFLEQVLDKLLEVSSDYAEWL

SEQ ID NO: 33667 - protein, 66 aa, Diabrotica virgifera
  misc_feature: Coding regions on vcDNA: vcDNA=SeqID_13364; Strand=-; Position=2-199
  misc_feature (4)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFVXXXXXXXXXXTNLAHTGLNXXXXXXXXSNXXXXXXXXXXXXXXPTSRSXXXXXXXXXXXXXXV

SEQ ID NO: 33668 - protein, 302 aa, Diabrotica virgifera
  misc_feature: Coding regions on vcDNA: vcDNA=SeqID_13365; Strand=+; Position=2-908
  misc_feature: Homolog annotation: Hit_ID=XP_314392.1; Match level="QueryCoverage =97%, HitCoverage=35%, E-value=9e-56, Identity=38%"; Hit description =ENSANGP00000000488 [Anopheles gambiae]
  misc_feature: Pfam annotation: Pfam_ID=RVT_1; Match level="Score=143.6, E-value =4.5e-40, Copies=1"; Pfam description=Reverse transcriptase (RNA -dependent D
  misc_feature (86)..(86): Xaa can be any naturally occurring amino acid
  misc_feature (103)..(103): Xaa can be any naturally occurring amino acid
  misc_feature (179)..(180): Xaa can be any naturally occurring amino acid
  misc_feature (268)..(268): Xaa can be any naturally occurring amino acid
SNLFLSNCSFSLCRPLWLTFNRSLAEGHFPSQFKKAYVKPIHKSGDKSFVCNYRSITILSAIPKIFEALVTDFLADNLKNQLHTAXHGFLPGHSISTNLLYTXSYCKLSWTVYRWIPFRYTDLSKAFDKVDHCLLLHKLECFGVSGKLLCWLKTYLRDRSLCVKLNGFTSNEYFLLSGXXQGSHLGPLLFAVFIDDAIKSLTDCEVLAYADAIKLFSSVRDYSDCARLQKSLDLSANWCDNNRLVINRDKCQVIQFHRSVEMVDFDYXLDGFLIERVTSVKDLGVIFQRGLSFNLHIDFICN

SEQ ID NO: 33669 - protein, 114 aa, Diabrotica virgifera
  misc_feature: Coding regions on vcDNA: vcDNA=SeqID_13366; Strand=+; Position=157-501
  misc_feature: Homolog annotation: Hit_ID=XP_312794.1; Match level="QueryCoverage =93%, HitCoverage=79%, E-value=4e-25, Identity=55%"; Hit description =ENSANGP00000020494 [Anopheles gambiae]
  misc_feature: Gene Ontology Annotation: Molecular function=v-SNARE activity; Cellular component=vacuolar membrane; Biological process =intracellular protein transport
MYRDNEDFEERNRQILFQGTAALERTGESLARSTQIAIETETVGTEVISELDSQREALLRTRNRLGDANEELRNAKSTLSAMGRNVLYNKLILILIIILEILILAAICFIRFIK

SEQ ID NO: 33670 - protein, 85 aa, Diabrotica virgifera
  misc_feature: Coding regions on vcDNA: vcDNA=SeqID_13367; Strand=+; Position=4-258
  misc_feature (2)..(8): Xaa can be any naturally occurring amino acid
  misc_feature (12)..(31): Xaa can be any naturally occurring amino acid
  misc_feature (33)..(33): Xaa can be any naturally occurring amino acid
  misc_feature (36)..(36): Xaa can be any naturally occurring amino acid
  misc_feature (44)..(85): Xaa can be any naturally occurring amino acid
SXXXXXXXGMEXXXXXXXXXXXXXXXXXXXXLXRLXFFYKTRDXXXXXXXXXXXXXXXXXXXXXXXXXXXXXXXXXXXXXXXXXX

SEQ ID NO: 33671 - protein, 86 aa, Diabrotica virgifera
  misc_feature: Coding regions on vcDNA: vcDNA=SeqID_13368; Strand=+; Position=85-345
  misc_feature (2)..(12): Xaa can be any naturally occurring amino acid
  misc_feature (20)..(28): Xaa can be any naturally occurring amino acid
  misc_feature (42)..(53): Xaa can be any naturally occurring amino acid
  misc_feature (66)..(73): Xaa can be any naturally occurring amino acid
  misc_feature (76)..(83): Xaa can be any naturally occurring amino acid
NXXXXXXXXXXXVSCLARRXXXXXXXXXLIIQYRKANKLIIXXXXXXXXXXXXNEMPFYISHILSXXXXXXXXPQXXXXXXXXLSK

SEQ ID NO: 33672 - protein, 91 aa, Diabrotica virgifera
  misc_feature: Coding regions on vcDNA: vcDNA=SeqID_13369; Strand=+; Position=912 -1184
  misc_feature (9)..(45): Xaa can be any naturally occurring amino acid
  misc_feature (65)..(81): Xaa can be any naturally occurring amino acid
  misc_feature (84)..(90): Xaa can be any naturally occurring amino acid
SLLHQIKAXXXXXXXXXXXXXXXXXXXXXXXXXXXXXXXXXXXXXGLFWKRFFQKGEKGVFKTNXXXXXXXXXXXXXXXXXPGXXXXXXXF

SEQ ID NO: 33673 - protein, 62 aa, Diabrotica virgifera
  misc_feature: Coding regions on vcDNA: vcDNA=SeqID_13370; Strand=-; Position=214-402
SSDGTLIEDTVLKDCVELHKWVRTGTKSDIYGWAHSTGPAVTTRTVDEMENCYNAHTTALVL

SEQ ID NO: 33674 - protein, 186 aa, Diabrotica virgifera
  misc_feature: Coding regions on vcDNA: vcDNA=SeqID_13371; Strand=+; Position=281-840
  misc_feature: Homolog annotation: Hit_ID=EAL26606.1; Match level="QueryCoverage =65%, HitCoverage=26%, E-value=3e-20, Identity=37%"; Hit description =GA21023-PA [Drosophila pseudoobscura]
  misc_feature (4)..(10): Xaa can be any naturally occurring amino acid
  misc_feature (51)..(51): Xaa can be any naturally occurring amino acid
  misc_feature (77)..(77): Xaa can be any naturally occurring amino acid
  misc_feature (91)..(98): Xaa can be any naturally occurring amino acid
LKLXXXXXXXKLSHIGLQLNHRHPIFGASPDAISEEFVVEIKCPQSEKTIXNYLTKNMEITAKYKAQMQLQMFLCKXTKALFCVADPNFEXXXXXXXXWVPYDEEYIKMLMDAAENFWQHNIFTHLCNSFKKHDQFHFVFGDFGCELVLTFGFFTTRQIKCLPGRTSTTGAASGFSKTKGILVFGV

SEQ ID NO: 33675 - protein, 249 aa, Diabrotica virgifera
  misc_feature: Coding regions on vcDNA: vcDNA=SeqID_13372; Strand=+; Position=3-752
  misc_feature: Homolog annotation: Hit_ID=XP_316740.1; Match level="QueryCoverage =90%, HitCoverage=72%, E-value=1e-79, Identity=59%"; Hit description =ENSANGP00000016061 [Anopheles gambiae] gb|EAA11996.1| ENSANGP00000016061 [Anopheles gambiae
  misc_feature: Gene Ontology Annotation: Molecular function=inositol-14-bisphosphate 1-phosphatase activity; Cellular component=mitochondrion; Biological process=signal transduction
  misc_feature: Pfam annotation: Pfam_ID=Inositol_P; Match level="Score=72.5, E-value= 1.1e-18, Copies=1"; Pfam description=Inositol monophosphatase family
  misc_feature (234)..(234): Xaa can be any naturally occurring amino acid
LDESEVPSDWIVTESDQNILQRKCPENYVNVKPEDIVVWVDPLDGTSEYTEGLLDHVTVLIGIAVSGRAVGGVIYQPYYEYKTVKNGPGRTFWGLVGLGVGGFEPIKPPSNKFVITTSRSHRDGKVNDALKALNPDDIISVGGAGHKVIVVLEGRAHAYVYASRGCKKWDTCAPEAVLEAAGGRLTDIHGKHYDYSKNVSFPDDQGIFATASGVDHDALIAKLPQEIRDAFPYXIKNKIIRCTVAICES

SEQ ID NO: 33676 - protein, 103 aa, Diabrotica virgifera
  misc_feature: Coding regions on vcDNA: vcDNA=SeqID_13373; Strand=+; Position=344-655
ISVDPDGAEPSGYGRLYCTSIFAVMLLWLICSPRYMNSYSFEIICSIRYIFGFCYLLIICHRYCLSPSYTFFLLVLTYTPILFAAVSTTENDCTSYKKVVSYI

SEQ ID NO: 33677 - protein, 118 aa, Diabrotica virgifera
  misc_feature: Coding regions on vcDNA: vcDNA=SeqID_13374; Strand=+; Position=1-357
  misc_feature: Pfam annotation: Pfam_ID=zf-C2H2; Match level="Score=32.9, E-value =9.6e-07, Copies=2"; Pfam description=Zinc finger, C2H2 type
  misc_feature (26)..(32): Xaa can be any naturally occurring amino acid
EEPSSSKQLQKRSKSTKRKRKVEKSXXXXXXXYPCPVCKKSFTSTAPLRSHFSSHFGSIWVVCYFCGKLSFTKDDFIQHFFQHFTKLHLKELKQKPAGNFSKKKKIANGSSNKRKKRI

SEQ ID NO: 33678 - protein, 40 aa, Diabrotica virgifera; identical to SEQ ID NO: 29961
  misc_feature: Coding regions on vcDNA: vcDNA=SeqID_13375; Strand=-; Position=1-120
  misc_feature (1)..(40): Xaa can be any naturally occurring amino acid

SEQ ID NO: 33679 - protein, 246 aa, Diabrotica virgifera
  misc_feature: Coding regions on vcDNA: vcDNA=SeqID_13376; Strand=+; Position=67-804
  misc_feature: Homolog annotation: Hit_ID=XP_308381.1; Match level="QueryCoverage =100%, HitCoverage=58%, E-value=1e-121, Identity=90%"; Hit description=ENSANGP00000009431 [Anopheles gambiae]
  misc_feature: Gene Ontology Annotation: Molecular function=structural molecule activity; Cellular component=flotillin complex; Biological process =biological_process unknown
  misc_feature: Pfam annotation: Pfam_ID=Band_7; Match level="Score=161.4, E-value=2e- 45, Copies=1"; Pfam description=SPFH domain / Band 7 family
MTWGFVTCGPNEALVISGCCYSKPLLVPGGRAFVWPSIQKIQRISLNTMTLIVDSPTVYTSQGVPISVTGIAQVKIQGQNEEMLLAACEQFLGKKQDEIQLIALHTLEGHQRAIMGSMTVEEIYKDRKKFSKQVFEVASSDLVNMGITVVSYTLKDIRDEEGYLKSLGMARTAEVKRDARIGEAEARAEATIKEAIAEEQRMASVFLNDTEIAKAKRDFELKKAAYDVEVQTKNAEAEMCYKLQAA

SEQ ID NO: 33680 - protein, 67 aa, Diabrotica virgifera
  misc_feature: Coding regions on vcDNA: vcDNA=SeqID_13377; Strand=-; Position=1-201
  misc_feature (11)..(42): Xaa can be any naturally occurring amino acid
  misc_feature (45)..(67): Xaa can be any naturally occurring amino acid
KKNSPGLSPRXXXXXXXXXXXXXXXXXXXXXXXXXXXXXXXXPPXXXXXXXXXXXXXXXXXXXXXXX

SEQ ID NO: 33681 - protein, 52 aa, Diabrotica virgifera
  misc_feature: Coding regions on vcDNA: vcDNA=SeqID_13378; Strand=-; Position=1-156
LQISQIFKALRSCGGVLETKPVKYASSQYRTHALTILETVPPIANTVNRAAM

SEQ ID NO: 33682 - protein, 65 aa, Diabrotica virgifera
  misc_feature: Coding regions on vcDNA: vcDNA=SeqID_13379; Strand=+; Position=3-197
  misc_feature (2)..(8): Xaa can be any naturally occurring amino acid
  misc_feature (14)..(38): Xaa can be any naturally occurring amino acid
  misc_feature (45)..(64): Xaa can be any naturally occurring amino acid
NXXXXXXXLEWKGXXXXXXXXXXXXXXXXXXXXXXXXXDERPIEXXXXXXXXXXXXXXXXXXXXP

SEQ ID NO: 33683 - protein, 82 aa, Diabrotica virgifera
  misc_feature: Coding regions on vcDNA: vcDNA=SeqID_13380; Strand=-; Position=1-246
  misc_feature (1)..(7): Xaa can be any naturally occurring amino acid
  misc_feature (14)..(20): Xaa can be any naturally occurring amino acid
  misc_feature (26)..(43): Xaa can be any naturally occurring amino acid
  misc_feature (46)..(68): Xaa can be any naturally occurring amino acid
  misc_feature (74)..(82): Xaa can be any naturally occurring amino acid
XXXXXXXGGYPFKXXXXXXXKKTGFXXXXXXXXXXXXXXXXXXPPXXXXXXXXXXXXXXXXXXXXXXXIGSFSXXXXXXXXX

SEQ ID NO: 33684 - protein, 60 aa, Diabrotica virgifera
  misc_feature: Coding regions on vcDNA: vcDNA=SeqID_13381; Strand=+; Position=1-180
  misc_feature (1)..(35): Xaa can be any naturally occurring amino acid
  misc_feature (37)..(59): Xaa can be any naturally occurring amino acid
XXXXXXXXXXXXXXXXXXXXXXXXXXXXXXXXXXXSXXXXXXXXXXXXXXXXXXXXXXXG

SEQ ID NO: 33685 - protein, 62 aa, Diabrotica virgifera
  misc_feature: Coding regions on vcDNA: vcDNA=SeqID_13382; Strand=+; Position=2-190
  misc_feature (2)..(15): Xaa can be any naturally occurring amino acid
  misc_feature (21)..(34): Xaa can be any naturally occurring amino acid
  misc_feature (37)..(44): Xaa can be any naturally occurring amino acid
NXXXXXXXXXXXXXXRPRCWXXXXXXXXXXXXXXVRXXXXXXXXVYTGVSQVGFYALFISIF

SEQ ID NO: 33686 - protein, 70 aa, Diabrotica virgifera
  misc_feature: Coding regions on vcDNA: vcDNA=SeqID_13383; Strand=-; Position=2-211
  misc_feature (7)..(28): Xaa can be any naturally occurring amino acid
  misc_feature (32)..(70): Xaa can be any naturally occurring amino acid
FLIPPNXXXXXXXXXXXXXXXXXXXXXXYRGXXXXXXXXXXXXXXXXXXXXXXXXXXXXXXXXXXXXXXX

SEQ ID NO: 33687 - protein, 77 aa, Diabrotica virgifera
  misc_feature: Coding regions on vcDNA: vcDNA=SeqID_13384; Strand=+; Position=96-326
  misc_feature (32)..(32): Xaa can be any naturally occurring amino acid
LHRSQLGNRHSCVCKYGGYKLRNPSIEGKTKXDYYVHSATGHSILLRKDIVSNEYGVTAHDVIAKTVISKKTNGIRI

SEQ ID NO: 33688 - protein, 121 aa, Diabrotica virgifera
  misc_feature: Coding regions on vcDNA: vcDNA=SeqID_13385; Strand=+; Position=57-420
  misc_feature: Homolog annotation: Hit_ID=XP_307926.1; Match level="QueryCoverage =90%, HitCoverage=39%, E-value=4e-31, Identity=57%"; Hit description =ENSANGP00000021770 [Anopheles gambiae]
  misc_feature: Gene Ontology Annotation: Cellular component=integral to membrane
  misc_feature: Pfam annotation: Pfam_ID=Tetraspannin; Match level="Score=-40.8, E -value=0.004, Copies=1"; Pfam description=Tetraspanin family
  misc_feature (31)..(31): Xaa can be any naturally occurring amino acid
  misc_feature (65)..(65): Xaa can be any naturally occurring amino acid
  misc_feature (82)..(82): Xaa can be any naturally occurring amino acid
  misc_feature (84)..(84): Xaa can be any naturally occurring amino acid
CILTTIKNKYESTCVIHLIFILNFIFWVFGXLLIDNGLYNFVDKWKLSGWVLVENVYDVILNISXEMVIMGGVVFIDSFGGXYXAHKENTCLIKFYFLWLLIFFLLEMGIAIVGFVFPPFY

SEQ ID NO: 33689 - protein, 67 aa, Diabrotica virgifera; identical to SEQ ID NO: 28735
  misc_feature: Coding regions on vcDNA: vcDNA=SeqID_13386; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 33690 - protein, 199 aa, Diabrotica virgifera
  misc_feature: Coding regions on vcDNA: vcDNA=SeqID_13387; Strand=-; Position=133-732
  misc_feature: Homolog annotation: Hit_ID=AAC97621.1; Match level="QueryCoverage =95%, HitCoverage=33%, E-value=2e-22, Identity=35%"; Hit description =ORF MSV061 putative LINE reverse transcriptase, similar to Caenorhabditis elegans GB:U00063 [Melanoplus sa
  misc_feature: Pfam annotation: Pfam_ID=RVT_1; Match level="Score=11.3, E-value=2.5e- 05, Copies=1"; Pfam description=Reverse transcriptase (RNA-dependent
HCHESTAMKIHEKMLNKKIIGKIDSTLEESQSGFRKGRSTQDHIFTIKQIIEKYQQQEKKMYMACIDLEKAFDTVPRQQLWEILEKRGISNKVIRVIKNIYNNNVNYIISQNRKSKPFITNEGLRQGGGLSPTLFIIYMDEIIKECKVKVKKMHVGYRNLRRVYISEGAFADDVVILAENEKQLQRNIEIWNETLKNME

SEQ ID NO: 33691 - protein, 23 aa, Diabrotica virgifera
  misc_feature: Coding regions on vcDNA: vcDNA=SeqID_13388; Strand=-; Position=1-69
  misc_feature (14)..(22): Xaa can be any naturally occurring amino acid
DLSLNRCEPGWFLXXXXXXXXXR

SEQ ID NO: 33692 - protein, 208 aa, Diabrotica virgifera
  misc_feature: Coding regions on vcDNA: vcDNA=SeqID_13389; Strand=+; Position=3-823
  misc_feature: Homolog annotation: Hit_ID=AAF87759.1; Match level="QueryCoverage =99%, HitCoverage=63%, E-value=1e-81, Identity=63%"; Hit description =cytochrome oxidase subunit I [Diabrotica virgifera virgifera]
  misc_feature: Pfam annotation: Pfam_ID=COX1; Match level="Score=-21.7, E-value=1.7e- 10, Copies=1"; Pfam description=Cytochrome C and Quinol oxidase polyp
  misc_feature (11)..(11): Xaa can be any naturally occurring amino acid
  misc_feature (36)..(44): Xaa can be any naturally occurring amino acid
  misc_feature (71)..(71): Xaa can be any naturally occurring amino acid
  misc_feature (125)..(125): Xaa can be any naturally occurring amino acid
  misc_feature (160)..(160): Xaa can be any naturally occurring amino acid
RIVERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 33693 - protein, 99 aa, Diabrotica virgifera
  misc_feature: Coding regions on vcDNA: vcDNA=SeqID_13390; Strand=+; Position=71-370
  misc_feature: Homolog annotation: Hit_ID=XP_310186.1; Match level="QueryCoverage =97%, HitCoverage=29%, E-value=1e-18, Identity=52%"; Hit description =ENSANGP00000011006 [Anopheles gambiae]
  misc_feature: Gene Ontology Annotation: Molecular function=malic enzyme activity; Cellular component=cytosol
MAQEAVRVIHAAAAAHITYSLLYLIAKEDVLLPKLTLHLRLLCIPAMKGQLKADSRELDDCALPLMRQHMPTAAPSVSLKDVSTAFLCGALPTTNCMEH

SEQ ID NO: 33694 - protein, 63 aa, Diabrotica virgifera
  misc_feature: Coding regions on vcDNA: vcDNA=SeqID_13391; Strand=-; Position=0-188
  misc_feature (39)..(49): Xaa can be any naturally occurring amino acid
  misc_feature (52)..(62): Xaa can be any naturally occurring amino acid
LFIPQFSFVCVNDLGAFLKFCVSFPRPLNLPLLFFLTFXXXXXXXXXXXTTXXXXXXXXXXXP

SEQ ID NO: 33695 - protein, 318 aa, Diabrotica virgifera
  misc_feature: Coding regions on vcDNA: vcDNA=SeqID_13392; Strand=+; Position=2-956
  misc_feature: Homolog annotation: Hit_ID=XP_311710.1; Match level="QueryCoverage =100%, HitCoverage=34%, E-value=1e-138, Identity=80%"; Hit description=ENSANGP00000000768 [Anopheles gambiae]
  misc_feature: Gene Ontology Annotation: Molecular function=cytoskeletal anchoring activity; Cellular component=adherens junction; Biological process =cytoskeletal anchoring
  misc_feature: Pfam annotation: Pfam_ID=Vinculin; Match level="Score=-262.9, E-value= 0.048, Copies=1"; Pfam description=Vinculin family
  misc_feature (34)..(34): Xaa can be any naturally occurring amino acid
  misc_feature (287)..(287): Xaa can be any naturally occurring amino acid
  misc_feature (300)..(300): Xaa can be any naturally occurring amino acid
  misc_feature (303)..(303): Xaa can be any naturally occurring amino acid
  misc_feature (311)..(312): Xaa can be any naturally occurring amino acid
  misc_feature (316)..(316): Xaa can be any naturally occurring amino acid
NHILEDVNKCVLALQEGDSDTLDRTASGIRGRSXVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFRSEKLKFDREVAKWDDTGNDIIVLAKHMCMIMMEMTDFTRGRGPLKTTMDVINAAKKISEAGTKLDKLTRQIAEQCPESSTKKDLLAYLQRIALYCHQMNITSXVKADVQNISGELXCIXGLDSATSXXSAAXNL

SEQ ID NO: 33696 - protein, 261 aa, Diabrotica virgifera
  misc_feature: Coding regions on vcDNA: vcDNA=SeqID_13393; Strand=-; Position=3-785
  misc_feature (16)..(28): Xaa can be any naturally occurring amino acid
  misc_feature (42)..(117): Xaa can be any naturally occurring amino acid
  misc_feature (121)..(195): Xaa can be any naturally occurring amino acid
  misc_feature (198)..(245): Xaa can be any naturally occurring amino acid
  misc_feature (248)..(261): Xaa can be any naturally occurring amino acid
SIVSSRLVTKFKLSSXXXXXXXXXXXXXIVSSTPSWQLSIEXXXXXXXXXXXXXXXXXXXXXXXXXXXXXXXXXXXXXXXXXXXXXXXXXXXXXXXXXXXXXXXXXXXXXXXXXXXXLIDXXXXXXXXXXXXXXXXXXXXXXXXXXXXXXXXXXXXXXXXXXXXXXXXXXXXXXXXXXXXXXXXXXXXXXXXXXXLKXXXXXXXXXXXXXXXXXXXXXXXXXXXXXXXXXXXXXXXXXXXXXXXXFSXXXXXXXXXXXXXX

SEQ ID NO: 33697 - protein, 34 aa, Diabrotica virgifera; identical to SEQ ID NO: 27603
  misc_feature: Coding regions on vcDNA: vcDNA=SeqID_13394; Strand=-; Position=80-184

SEQ ID NO: 33698 - protein, 39 aa, Diabrotica virgifera
  misc_feature: Coding regions on vcDNA: vcDNA=SeqID_13395; Strand=-; Position=1-117
  misc_feature (1)..(7): Xaa can be any naturally occurring amino acid
  misc_feature (12)..(39): Xaa can be any naturally occurring amino acid
XXXXXXXLYRVXXXXXXXXXXXXXXXXXXXXXXXXXXXX

SEQ ID NO: 33699 - protein, 37 aa, Diabrotica virgifera
  misc_feature: Coding regions on vcDNA: vcDNA=SeqID_13396; Strand=-; Position=1-111
  misc_feature (2)..(9): Xaa can be any naturally occurring amino acid
  misc_feature (12)..(36): Xaa can be any naturally occurring amino acid
SXXXXXXXXNNXXXXXXXXXXXXXXXXXXXXXXXXXF

SEQ ID NO: 33700 - protein, 74 aa, Diabrotica virgifera
  misc_feature: Coding regions on vcDNA: vcDNA=SeqID_13397; Strand=+; Position=2-226
PRSRDEFILSCIYILRVITTESLFSCQLINNRMKTSCINIIVQVMMGSCDHKWIISVIIYPSHLKFPSSNCDRI

SEQ ID NO: 33701 - protein, 123 aa, Diabrotica virgifera
  misc_feature: Coding regions on vcDNA: vcDNA=SeqID_13398; Strand=-; Position=80-451
FAAPGGVPFTLQQVLQPGRAAVEGVFSIARREERATSCKPSKPADLEGVPRRPRCETTASEPRLCRPRWPSVRRRMSTHACSVRHERQLKVQDLRITLHLVRAASDICWGGDTVDQARGTQTP

SEQ ID NO: 33702 - protein, 53 aa, Diabrotica virgifera
  misc_feature: Coding regions on vcDNA: vcDNA=SeqID_13399; Strand=+; Position=618-779
TCCFGVYISTFYTIFSIFVCNYFYEHMWFQIRLVFVVRALFTLCILLLTLDTE

SEQ ID NO: 33703 - protein, 307 aa, Diabrotica virgifera
  misc_feature: Coding regions on vcDNA: vcDNA=SeqID_13400; Strand=+; Position=38-958
  misc_feature: Homolog annotation: Hit_ID=EAL41027.1; Match level="QueryCoverage =69%, HitCoverage=95%, E-value=8e-60, Identity=50%"; Hit description =ENSANGP00000029713 [Anopheles gambiae str. PEST] ref|XP_559058.1| ENSANGP00000029713 [Anopheles gambiae st
  misc_feature: Gene Ontology Annotation: Molecular function=molecular_function unknown; Cellular component=cellular_component unknown; Biological process=biological_process unknown
  misc_feature: Pfam annotation: Pfam_ID=DUF858; Match level="Score=337.5, E-value =1.9e-98, Copies=1"; Pfam description=Eukaryotic protein of unknown functio
MSFEFLDNTEEIFYNNAVNYWSEIPATLDGMLGGFGYISQTDIKGSKMLLKQLFNSKDPPGREYALDCGAGIGRISKFLLTEMFEKVDLVEQNAAFLEQAKKYLGPKIAKVPECYSVGLQNFEPEPNKYDVIWIQWVIGHLTNKDLVKFLKSCSKGLKKNGVIILKENITSTDDIEKDDQDSSVTRPMYLFHQLFQKTELNCYRQSKQHNFPKGLFSVYMFVLKPIKDDVPDTTLSTEESPVKEESPPLVELSKEAEKITEPDKDVKNSTEVQQLERDNELEQTRNVETEAVTESEGQVYILSFFRN

SEQ ID NO: 33704 - protein, 146 aa, Diabrotica virgifera
  misc_feature: Coding regions on vcDNA: vcDNA=SeqID_13401; Strand=-; Position=1-438
  misc_feature (4)..(13): Xaa can be any naturally occurring amino acid
  misc_feature (23)..(30): Xaa can be any naturally occurring amino acid
  misc_feature (33)..(39): Xaa can be any naturally occurring amino acid
  misc_feature (92)..(102): Xaa can be any naturally occurring amino acid
  misc_feature (123)..(124): Xaa can be any naturally occurring amino acid
  misc_feature (126)..(129): Xaa can be any naturally occurring amino acid
  misc_feature (137)..(137): Xaa can be any naturally occurring amino acid
  misc_feature (139)..(139): Xaa can be any naturally occurring amino acid
  misc_feature (141)..(141): Xaa can be any naturally occurring amino acid
PFVXXXXXXXXXXTNLAHTGLNXXXXXXXXSNXXXXXXXPPLICFSPASRSRSLFSLCSLPYFFAVVPWVLSSFLPALWLPLFFVRVLFSPXXXXXXXXXXXFFSFSVSLSSSPSFFIRFFCXXFXXXXPLKVGVFXFXFXRPPDG

SEQ ID NO: 33705 - protein, 178 aa, Diabrotica virgifera
  misc_feature: Coding regions on vcDNA: vcDNA=SeqID_13402; Strand=-; Position=68-604
  misc_feature: Homolog annotation: Hit_ID=CAH04311.1; Match level="QueryCoverage =97%, HitCoverage=55%, E-value=1e-54, Identity=65%"; Hit description =acidic p0 ribosomal protein [Biphyllus lunatus]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_60s; Match level="Score=17.5, E -value=0.0019, Copies=1"; Pfam description=60s Acidic ribosomal protein
RADAGVPPKISKGIFEIINDVPIFKPGAKVGASEAPFLTMLTIFPFSYGFQVEQVYDSGPVFAPPFLAINPEDLGGKFLAGVANLAAVCLSLGYPPVVFAPPTIANGFKNLLAFAAVSDVAFKEAKPLKESLKDPPKFVVAAAPVAPPPPPPPPGFKKEGKKGEFEREDGDLGLGFFD

SEQ ID NO: 33706 - protein, 279 aa, Diabrotica virgifera
  misc_feature: Coding regions on vcDNA: vcDNA=SeqID_13403; Strand=+; Position=3-842
  misc_feature: Homolog annotation: Hit_ID=XP_396337.1; Match level="QueryCoverage =99%, HitCoverage=88%, E-value=1e-106, Identity=64%"; Hit description= similar to SP2637 [Apis mellifera]
  misc_feature: Gene Ontology Annotation: Molecular function=protein N-terminal asparagine amidohydrolase activity; Cellular component=nucleus; Biological process=adult locomotory behavior
QLLSIPSKIVGPAGLLYVLQREFAAVNQHDKNVTILGSDDATTCILVILRHSGSGAVALAHFDGLGTHEAASAMVEKIQELAVGYSGGRIELQLVGGFSDRLGYSEELFYNIMDAFHKQLVEIDLTLACIGQLNTTIVNGIPAPIIYGVGVNMRTNEIFPASFPQKGPEEYLRTARHLFGSENCEIINIYDCILGQLKIGPFNYKPLRGANLWLEQNDDFILQQLSTSPEVEPPHFVSNVRGTVKYIQENPFPAVTVFRNNRPLYYKKNEDSGLWVPEY

SEQ ID NO: 33707 - protein, 129 aa, Diabrotica virgifera
  misc_feature: Coding regions on vcDNA: vcDNA=SeqID_13404; Strand=+; Position=484-870
  misc_feature: Homolog annotation: Hit_ID=XP_397038.1; Match level="QueryCoverage =79%, HitCoverage=7%, E-value=1e-09, Identity=38%"; Hit description =similar to receptor tyrosine kinase [Apis mellifera]
MPLRQLFLLFCLCFLCTSLTTVESQVLPKCLDGEEVTPKKYFRSDGQSLTIMLETSSRTTHMLATHIFYIYAKEVLGYPKINISILEDDFQIETVMSRLTSYASIGVEYLRLYQLGVWTVPTTIPSQKI

SEQ ID NO: 33708 - protein, 43 aa, Diabrotica virgifera
  misc_feature: Coding regions on vcDNA: vcDNA=SeqID_13405; Strand=-; Position=0-128
  misc_feature (1)..(40): Xaa can be any naturally occurring amino acid
XXXXXXXXXXXXXXXXXXXXXXXXXXXXXXXXXXXXXXXXVSR

SEQ ID NO: 33709 - protein, 109 aa, Diabrotica virgifera
  misc_feature: Coding regions on vcDNA: vcDNA=SeqID_13406; Strand=-; Position=0-326
  misc_feature (67)..(90): Xaa can be any naturally occurring amino acid
CFLFVNPCCIYLHILSGCPQHPHTSVQILFPISLSSQPPSHQLNPNFFIIHFFSDITPTKSCIFKIXXXXXXXXXXXXXXXXXXXXXXXXSYYKEILLLFSFTIQQPIT

SEQ ID NO: 33710 - protein, 266 aa, Diabrotica virgifera
  misc_feature: Coding regions on vcDNA: vcDNA=SeqID_13407; Strand=-; Position=3-800
  misc_feature (11)..(31): Xaa can be any naturally occurring amino acid
  misc_feature (40)..(55): Xaa can be any naturally occurring amino acid
  misc_feature (59)..(266): Xaa can be any naturally occurring amino acid
YFKNFIGFFVXXXXXXXXXXXXXXXXXXXXXSFFFHPTLXXXXXXXXXXXXXXXXGQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33711 - protein, 129 aa, Diabrotica virgifera
  misc_feature: Coding regions on vcDNA: vcDNA=SeqID_13408; Strand=+; Position=533-922
  misc_feature: Homolog annotation: Hit_ID=XP_393372.1; Match level="QueryCoverage =66%, HitCoverage=8%, E-value=3e-16, Identity=47%"; Hit description =similar to ENSANGP00000008480 [Apis mellifera]
MMSQEVLQVVHEKDPWVEETTISLREHDNSWPNIDEDVPSILDKKGRRKSWHAIKFERKRRKGVIDGSPDGSPVEIRQKRPSWWNIFTNQPWPRSRRASQDVGRVTHKEGFPGNASKSRSVDHGITSPF

SEQ ID NO: 33712 - protein, 35 aa, Diabrotica virgifera
  misc_feature: Coding regions on vcDNA: vcDNA=SeqID_13409; Strand=-; Position=1-105
  misc_feature (1)..(20): Xaa can be any naturally occurring amino acid
  misc_feature (22)..(34): Xaa can be any naturally occurring amino acid
XXXXXXXXXXXXXXXXXXXXKXXXXXXXXXXXXXL

SEQ ID NO: 33713 - protein, 290 aa, Diabrotica virgifera
  misc_feature: Coding regions on vcDNA: vcDNA=SeqID_13410; Strand=+; Position=3-872
  misc_feature: Homolog annotation: Hit_ID=XP_308743.1; Match level="QueryCoverage =99%, HitCoverage=53%, E-value=4e-41, Identity=35%"; Hit description =ENSANGP00000015016 [Anopheles gambiae]
  misc_feature: Gene Ontology Annotation: Biological process=metabolism
DVTMITVFEEKNPPKNGKFRQLVLKEVLNVQYELFANMSNLNDEDSYAAKNPLGMMKIFNMVGLTVTEATLSHPTVQALIKSGEKFDIMILTQYAVEATKALAAHFGAHLVLYNDNAATCWVNHFVGNSGLPSLNPELIFDYPQLMSFKQRLANTLYTIATYVNHNLVQYPAHAELIKKYVSKDMDLTKIQYDVALVLSNSHPSLNNPAPSVPCMKEIAGYHVKEPKPLPADLKKYLDESKNGVIYFSMGSNIYSNSFPKEKRESIMKAFSKRKENILWKFEDTDLPRKA

SEQ ID NO: 33714 - protein, 286 aa, Diabrotica virgifera
  misc_feature: Coding regions on vcDNA: vcDNA=SeqID_13411; Strand=+; Position=94-950
  misc_feature: Homolog annotation: Hit_ID=NP_999781.1; Match level="QueryCoverage =73%, HitCoverage=53%, E-value=2e-29, Identity=35%"; Hit description =DNA-binding protein with twelve Zn fingers [Strongylocentrotus purpuratus] gb|AAA85705.1| SpZ12-1
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=76.8, E-value =5.9e-20, Copies=3"; Pfam description=Zinc finger, C2H2 type
  misc_feature (116)..(123): Xaa can be any naturally occurring amino acid
  misc_feature (153)..(158): Xaa can be any naturally occurring amino acid
  misc_feature (189)..(195): Xaa can be any naturally occurring amino acid
  misc_feature (239)..(239): Xaa can be any naturally occurring amino acid
  misc_feature (248)..(248): Xaa can be any naturally occurring amino acid
MEETCKIEIENSEMDDAVLDSFKCEIQEEEESKREIITHGTYDSLDLKKCPIKTEIEQHGNKLIPFEEHQKTEKGYLQEENKTEIMEKLVEDSAYQGNDMTRHTRGNVGTGKRQYXXXXXXXXCITAINLKRHMRLHTEEKSHKCEICFKQFXXXXXXQDEHKMAIMKTLIQDSSYEANYISQPSEGQXXXXXXXVATVQRLYRCEICFKQFSYKSYLKIHLFSHTEEKPFICEICLKXFSRSGDLKXHLRVHTGEKPYKCEILFKQFSTASQLKRHFRLHTGGKP

SEQ ID NO: 33715 - protein, 66 aa, Diabrotica virgifera; identical to SEQ ID NO: 26808
  misc_feature: Coding regions on vcDNA: vcDNA=SeqID_13412; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33716 - protein, 45 aa, Diabrotica virgifera
  misc_feature: Coding regions on vcDNA: vcDNA=SeqID_13413; Strand=-; Position=1-135
  misc_feature (26)..(45): Xaa can be any naturally occurring amino acid
VRGIFVCEMPKKIGARRFFYFIEIMXXXXXXXXXXXXXXXXXXXX

SEQ ID NO: 33717 - protein, 92 aa, Diabrotica virgifera
  misc_feature: Coding regions on vcDNA: vcDNA=SeqID_13414; Strand=+; Position=117-392
  misc_feature (43)..(53): Xaa can be any naturally occurring amino acid
  misc_feature (83)..(92): Xaa can be any naturally occurring amino acid
TRKIFSRKIGILKSHHNFLIDHENDGTTSYWRHIEKTDRVMSXXXXXXXXXXXSYHVLLTIILDSVLKALILPVNRAESLKSXXXXXXXXXX

SEQ ID NO: 33718 - protein, 273 aa, Diabrotica virgifera
  misc_feature: Coding regions on vcDNA: vcDNA=SeqID_13415; Strand=-; Position=3-821
  misc_feature: Homolog annotation: Hit_ID=AAU04866.1; Match level="QueryCoverage =100%, HitCoverage=79%, E-value=1e-103, Identity=67%"; Hit description=mariner transposase [Mariner transposase delivery vector pFA545]
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=33.1, E -value=2.2e-07, Copies=1"; Pfam description=Transposase
  misc_feature (153)..(173): Xaa can be any naturally occurring amino acid
  misc_feature (192)..(192): Xaa can be any naturally occurring amino acid
SGRPKESVTDENIKKVQKIILDDRKVKLFEIAEALKISKERVGYIVHEYLGIRKLCAKSIKNNNEIDASEKCLKLFNHNRTEFLRRYITMDETWLHHSTPESNRQSAEWTSRDEPTPKREKTQQSAGKVMASVFWDAYGIIFIDYVEKGKTIXXXXXXXXXXXXXXXXXXXXXHLKKEKVLFHQDNALCHKXMKTMAKFHKLGFELLPQPPYSPDLAPSDFHLFADLKRMLAEKKFSTNEEVIAETEAYFEYSFEYKLYYKNGIEKLYDRYNR

SEQ ID NO: 33719 - protein, 299 aa, Diabrotica virgifera
  misc_feature: Coding regions on vcDNA: vcDNA=SeqID_13416; Strand=+; Position=2-898
  misc_feature: Homolog annotation: Hit_ID=AAC47118.1; Match level="QueryCoverage =98%, HitCoverage=50%, E-value=5e-43, Identity=37%"; Hit description =hemomucin
  misc_feature: Gene Ontology Annotation: Molecular function=calcium-dependent phospholipid binding; Cellular component=extracellular space; Biological process=cell proliferation
DNLEKDGRGGFLASLIENNDEENPAPLFLVSRFPLARKFICRVFGIAQLAFETLDRYYPNEFAQKAVHYVGHYNSIAGKLPSKRATVLRLSNNGEIVEALHTSNKNVYLMSEAYPFKDHLYLGSPGNDFIARVPFESMGWPKAKTVAEPKVETKQVPKQEEAPKVRTTSPPPVKQQTTTTTTAKPPTKQTEAPKVKTTPPPPVKQQTTTPPPKPTTTTKPPTPQPTQAPKVKPTQAPKPQTTTPKPQATQAPKAQPTKAPTQQTPQVPKAQPTQAPIKDSKAPPTQQQTTPPSQKTTPP

SEQ ID NO: 33720 - protein, 66 aa, Diabrotica virgifera; identical to SEQ ID NO: 30334
  misc_feature: Coding regions on vcDNA: vcDNA=SeqID_13417; Strand=-; Position=2-199
  misc_feature (3)..(10): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33721 - protein, 198 aa, Diabrotica virgifera
  misc_feature: Coding regions on vcDNA: vcDNA=SeqID_13418; Strand=-; Position=1-594
  misc_feature (1)..(198): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33722 - protein, 69 aa, Diabrotica virgifera
  misc_feature: Coding regions on vcDNA: vcDNA=SeqID_13419; Strand=+; Position=226-435
  misc_feature (36)..(54): Xaa can be any naturally occurring amino acid
  misc_feature (59)..(67): Xaa can be any naturally occurring amino acid
SNIDGRKLYYRFELSYSNYADIPKVILFLYSVKLDXXXXXXXXXXXXXXXXXXXPQLYXXXXXXXXXLN

SEQ ID NO: 33723 - protein, 40 aa, Diabrotica virgifera
  misc_feature: Coding regions on vcDNA: vcDNA=SeqID_13420; Strand=-; Position=0-119
  misc_feature (9)..(39): Xaa can be any naturally occurring amino acid
KNSPLFSLXXXXXXXXXXXXXXXXXXXXXXXXXXXXXXXP

SEQ ID NO: 33724 - protein, 69 aa, Diabrotica virgifera
  misc_feature: Coding regions on vcDNA: vcDNA=SeqID_13421; Strand=+; Position=430-639
TNELPVCATLVKIKILIFMSKMRNNYLPLNTYQILPVCKNNFKIPYFGNEAFANIFVQSNYLSKFAIFI

SEQ ID NO: 33725 - protein, 193 aa, Diabrotica virgifera
  misc_feature: Coding regions on vcDNA: vcDNA=SeqID_13422; Strand=+; Position=68-649
  misc_feature: Homolog annotation: Hit_ID=XP_315346.1; Match level="QueryCoverage =69%, HitCoverage=89%, E-value=9e-16, Identity=35%"; Hit description =ENSANGP00000020938 [Anopheles gambiae]
  misc_feature: Pfam annotation: Pfam_ID=Lectin_C; Match level="Score=25.4, E-value =2.7e-06, Copies=1"; Pfam description=Lectin C-type domain
  misc_feature (73)..(98): Xaa can be any naturally occurring amino acid
MILEPTHCEDYAKEVQELFGLRGTIPTLNLYHRGNKSYYIGNIFKGNLLHAEQFCRYHDMNLVNIETQEENNXXXXXXXXXXXXXXXXXXXXXXXXXXKLWISLTSGKSLKYFNWKNGEPNNVQKEEQCVVVRTENKQLKWYDVFCWNTNYFICEVIWTKMDQKLLQVLKDKLEKQIEAQGNVSMTVGMPTVH

SEQ ID NO: 33726 - protein, 103 aa, Diabrotica virgifera
  misc_feature: Coding regions on vcDNA: vcDNA=SeqID_13423; Strand=-; Position=273-584
  misc_feature (53)..(58): Xaa can be any naturally occurring amino acid
VIGLINKEFDHCLYHISASNVRSGRHLHRLFFKQSIIGLFILSDDGFVQEMNXXXXXXSSVYLTLWFHQQRRAYIISLYIQWLLLAGPSGIMHWNIQCGPTAV

SEQ ID NO: 33727 - protein, 320 aa, Diabrotica virgifera
  misc_feature: Coding regions on vcDNA: vcDNA=SeqID_13424; Strand=-; Position=3-962
  misc_feature (4)..(15): Xaa can be any naturally occurring amino acid
  misc_feature (25)..(33): Xaa can be any naturally occurring amino acid
  misc_feature (35)..(43): Xaa can be any naturally occurring amino acid
  misc_feature (54)..(66): Xaa can be any naturally occurring amino acid
  misc_feature (68)..(320): Xaa can be any naturally occurring amino acid
PFRXXXXXXXXXXXXPTLASHGFNXXXXXXXXXDXXXXXXXXXIINLIQHRGPXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 33728 - protein, 40 aa, Diabrotica virgifera
  misc_feature: Coding regions on vcDNA: vcDNA=SeqID_13425; Strand=-; Position=38-160
  misc_feature (1)..(25): Xaa can be any naturally occurring amino acid
XXXXXXXXXXXXXXXXXXXXXXXXXSSLKKLKLFSLKIES

SEQ ID NO: 33729 - protein, 66 aa, Diabrotica virgifera; identical to SEQ ID NO: 26808
  misc_feature: Coding regions on vcDNA: vcDNA=SeqID_13426; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 33730 - protein, 20 aa, Diabrotica virgifera
  misc_feature: Coding regions on vcDNA: vcDNA=SeqID_13427; Strand=-; Position=1-60
  misc_feature (3)..(3): Xaa can be any naturally occurring amino acid
  misc_feature (13)..(20): Xaa can be any naturally occurring amino acid
LYXGLSSLKKCKXXXXXXXX

SEQ ID NO: 33731 - protein, 17 aa, Diabrotica virgifera
  misc_feature: Coding regions on vcDNA: vcDNA=SeqID_13428; Strand=-; Position=1-51
GRILYYRLELSNKITLL

SEQ ID NO: 33732 - protein, 82 aa, Diabrotica virgifera
  misc_feature: Coding regions on vcDNA: vcDNA=SeqID_13429; Strand=-; Position=615-863
  misc_feature (56)..(62): Xaa can be any naturally occurring amino acid
LKKYRPLKIQNKILDKLNKRQFYFIQPFVPAINEKTNDYGTLSTVKMPRPFELISXXXXXXXDTNTHVSNEQVKKDVDEVRY

SEQ ID NO: 33733 - protein, 129 aa, Diabrotica virgifera
  misc_feature: Coding regions on vcDNA: vcDNA=SeqID_13430; Strand=+; Position=2-391
LSLISLALVACDDSVSTSTDTPVISTEVPAPISTSLREDRVYVDTSNVPDPVYQIDAVEAFKEAKALHPVDGIALLKTFSELFNAKHKVSGGWKVAEKYDYFYNPNINYVYVALGVIDANGDRLVLIFN

SEQ ID NO: 33734 - protein, 183 aa, Diabrotica virgifera
  misc_feature: Coding regions on vcDNA: vcDNA=SeqID_13431; Strand=+; Position=2-553
  misc_feature: Homolog annotation: Hit_ID=XP_394220.1; Match level="QueryCoverage =98%, HitCoverage=29%, E-value=2e-31, Identity=41%"; Hit description =similar to CG9518-PA [Apis mellifera]
SVGIKVLKDLKVGYNLMDHVATGGLTFVIDKPYSIRIDRVITRENLDMYLNHHQGPLTIAGGCEVLIFHDFSNPGNPNGHPEMELLYEAGSVVSDYTFRRSFGITDEIYDAVYTPIQNKDTFMVMPMLMRPKSKGKVMLKDANYKSKPLIYPNYFAFKEDMDILIIGIRLADNITKQTALKGI

SEQ ID NO: 33735 - protein, 76 aa, Diabrotica virgifera
  misc_feature: Coding regions on vcDNA: vcDNA=SeqID_13432; Strand=-; Position=1-228
  misc_feature (11)..(73): Xaa can be any naturally occurring amino acid
KKIFPCFSLRXXXXXXXXXXXXXXXXXXXXXXXXXXXXXXXXXXXXXXXXXXXXXXXXXXXXXXXXXXXXXXXKKL

SEQ ID NO: 33736 - protein, 65 aa, Diabrotica virgifera
  misc_feature: Coding regions on vcDNA: vcDNA=SeqID_13433; Strand=+; Position=146-344
  misc_feature: Homolog annotation: Hit_ID=AAF99020.1; Match level="QueryCoverage =98%, HitCoverage=13%, E-value=1e-17, Identity=68%"; Hit description =cytochrome oxidase subunit I [Phytomyza jucunda]
  misc_feature (16)..(16): Xaa can be any naturally occurring amino acid
  misc_feature (41)..(41): Xaa can be any naturally occurring amino acid
RRSIGIFFDRRPLFVXDGVNTEILLLFSLRVLAGSFTIFLXDRNFNTSYFDPAGGGDPILYELLF

SEQ ID NO: 33737 - protein, 156 aa, Diabrotica virgifera
  misc_feature: Coding regions on vcDNA: vcDNA=SeqID_13434; Strand=+; Position=223-693
  misc_feature: Homolog annotation: Hit_ID=XP_311440.1; Match level="QueryCoverage =82%, HitCoverage=18%, E-value=3e-36, Identity=56%"; Hit description =ENSANGP00000018533 [Anopheles gambiae]
  misc_feature: Gene Ontology Annotation: Molecular function=anion exchanger activity; Cellular component=integral to plasma membrane; Biological process=bicarbonate transport
MGLKDKNFLNFGSNNIMKNEGDKHSALLVERPVYQIEELNRDYEYEKPYHTLKTRCKRACQSLDPCAFLKETIPLLSWLPEYSWKKSFSGDIVSGITVAVMHIPQGMAYAMLGNVPPIIGIYMAIFPVLVYFIFGTSRHVSMGTFAGVCPHDRKRN

SEQ ID NO: 33738 - protein, 39 aa, Diabrotica virgifera
  misc_feature: Coding regions on vcDNA: vcDNA=SeqID_13435; Strand=-; Position=1-117
  misc_feature (2)..(11): Xaa can be any naturally occurring amino acid
  misc_feature (15)..(39): Xaa can be any naturally occurring amino acid
EXXXXXXXXXXLSQXXXXXXXXXXXXXXXXXXXXXXXXX

SEQ ID NO: 33739 - protein, 31 aa, Diabrotica virgifera
  misc_feature: Coding regions on vcDNA: vcDNA=SeqID_13436; Strand=-; Position=0-92
RFYNQNVSLRNRKIKTLFFVPFKQFQPDAWV

SEQ ID NO: 33740 - protein, 138 aa, Diabrotica virgifera
  misc_feature: Coding regions on vcDNA: vcDNA=SeqID_13437; Strand=+; Position=2-415
  misc_feature: Homolog annotation: Hit_ID=XP_314687.1; Match level="QueryCoverage =93%, HitCoverage=18%, E-value=4e-23, Identity=45%"; Hit description =ENSANGP00000013227 [Anopheles gambiae]
ILQATKQLFAQNSYNTSRNYDENLRHLREIMGIMQHHDAITGTEKQHVANDYVRGIHRAITDVEKEMGEVFDELLNTDLKLELASCLLTNVSICKVSQESDKFVVAVYNPLGWSVTHYVRLPVDNGDYMINEGELYDL

SEQ ID NO: 33741 - protein, 133 aa, Diabrotica virgifera
  misc_feature: Coding regions on vcDNA: vcDNA=SeqID_13438; Strand=+; Position=1-398
  misc_feature: Homolog annotation: Hit_ID=NP_001007039.1; Match level="QueryCoverage= 97%, HitCoverage=9%, E-value=1e-20, Identity=44%"; Hit description =ATP-binding cassette, sub-family C (CFTR/MRP), member 4 [Danio rerio] emb|CAD24440.2| novel ABC
  misc_feature: Gene Ontology Annotation: Molecular function=15-hydroxyprostaglandin dehydrogenase (NAD+) activity; Cellular component=cellular_component unknown; Biological process=biological_process unknown
  misc_feature (84)..(84): Xaa can be any naturally occurring amino acid
  misc_feature (95)..(95): Xaa can be any naturally occurring amino acid
  misc_feature (122)..(122): Xaa can be any naturally occurring amino acid
KASSSTIEALCQVGQIDHILLAEGVGTRKINPQTHKSARSRSAQYPVLCSGTLIKISDPFVDNSDQVHWKALVQVCLKHAVKDXPAPLNSNLAVXSSNFTVGQRQMVCRAIAVVRSNMITCXDEATANLYPHT

SEQ ID NO: 33742 - protein, 99 aa, Diabrotica virgifera
  misc_feature: Coding regions on vcDNA: vcDNA=SeqID_13439; Strand=-; Position=78-377
  misc_feature (34)..(41): Xaa can be any naturally occurring amino acid
  misc_feature (51)..(86): Xaa can be any naturally occurring amino acid
YPCFKGSPVEEFLGPFLKAFSYPTWQSLAYPFCXXXXXXXXAPIIVCSLYXXXXXXXXXXXXXXXXXXXXXXXXXXXXXXXXXXXXGKTKLKLRVNNNC

SEQ ID NO: 33743 - protein, 60 aa, Diabrotica virgifera
  misc_feature: Coding regions on vcDNA: vcDNA=SeqID_13440; Strand=+; Position=47-229
  misc_feature (31)..(37): Xaa can be any naturally occurring amino acid
LCVLPISNFLLPSFAAQVPRTPGHMSKYTIXXXXXXXQVPWVILSSNTFDTLCSPLPNYF

SEQ ID NO: 33744 - protein, 64 aa, Diabrotica virgifera
  misc_feature: Coding regions on vcDNA: vcDNA=SeqID_13441; Strand=-; Position=2-193
LNVIKNFQFGTQNEIRFPYVNAYVIRINTILAYIKSVIYHLNKVQHYSDYNCNPYVLLSNRTRG

SEQ ID NO: 33745 - protein, 85 aa, Diabrotica virgifera
  misc_feature: Coding regions on vcDNA: vcDNA=SeqID_13442; Strand=+; Position=129-383
  misc_feature: Homolog annotation: Hit_ID=AAP57194.1; Match level="QueryCoverage =100%, HitCoverage=40%, E-value=1e-21, Identity=55%"; Hit description= ferritin [Leptinotarsa decemlineata]
  misc_feature: Gene Ontology Annotation: Molecular function=ferrous iron binding; Cellular component=ferritin complex; Biological process=iron ion homeostasis
  misc_feature (48)..(58): Xaa can be any naturally occurring amino acid
MKSVAVFVFLACFAGLQAVQLKCAHQELDIPKDWIDMNNVCVKKMRGXXXXXXXXXXXYMAMGAYFARDTVNRPGFADLIFKSAS

SEQ ID NO: 33746 - protein, 69 aa, Diabrotica virgifera
  misc_feature: Coding regions on vcDNA: vcDNA=SeqID_13443; Strand=+; Position=1-210
  misc_feature (62)..(69): Xaa can be any naturally occurring amino acid
NVSPRVRESISYYDTSAFETLITKMYITLILFECVGAKFRSNYRWSKVPEKFYNVYFNKSQXXXXXXXX

SEQ ID NO: 33747 - protein, 48 aa, Diabrotica virgifera
  misc_feature: Coding regions on vcDNA: vcDNA=SeqID_13444; Strand=-; Position=3-146
FNILEGHPRYLAILNRAFQRTSLVSSFCHMSYNPFIINSIQIISTFNR

SEQ ID NO: 33748 - protein, 58 aa, Diabrotica virgifera
  misc_feature: Coding regions on vcDNA: vcDNA=SeqID_13445; Strand=+; Position=2-178
  misc_feature (3)..(45): Xaa can be any naturally occurring amino acid
PKXXXXXXXXXXXXXXXXXXXXXXXXXXXXXXXXXXXXXXXXXXXPKRFKPNLPLNAT

SEQ ID NO: 33749 - protein, 87 aa, Diabrotica virgifera
  misc_feature: Coding regions on vcDNA: vcDNA=SeqID_13446; Strand=+; Position=42-305
  misc_feature (66)..(71): Xaa can be any naturally occurring amino acid
LPYMLVHHRLLRILPTAHRTNNSILAELNIKARITTTFDRNILGYVLLCSVFSLCYEIDRHLIISXXXXXXLIATHENKTNFSKTLQ

SEQ ID NO: 33750 - protein, 77 aa, Diabrotica virgifera
  misc_feature: Coding regions on vcDNA: vcDNA=SeqID_13447; Strand=-; Position=1-231
  misc_feature (1)..(8): Xaa can be any naturally occurring amino acid
  misc_feature (16)..(35): Xaa can be any naturally occurring amino acid
  misc_feature (39)..(49): Xaa can be any naturally occurring amino acid
  misc_feature (52)..(77): Xaa can be any naturally occurring amino acid
XXXXXXXXLKRITISXXXXXXXXXXXXXXXXXXXXLNWXXXXXXXXXXXPGXXXXXXXXXXXXXXXXXXXXXXXXXX

SEQ ID NO: 33751 - protein, 55 aa, Diabrotica virgifera
  misc_feature: Coding regions on vcDNA: vcDNA=SeqID_13448; Strand=+; Position=22-189
NLCSAFRLTDRSVFLYTITVVSCEGSSFGKFKEIFQSCLSVYNPIILYSCILNCV

SEQ ID NO: 33752 - protein, 136 aa, Diabrotica virgifera
  misc_feature: Coding regions on vcDNA: vcDNA=SeqID_13449; Strand=+; Position=1-408
  misc_feature: Homolog annotation: Hit_ID=NP_651679.1; Match level="QueryCoverage =93%, HitCoverage=10%, E-value=8e-18, Identity=37%"; Hit description =CG11898-PA [Drosophila melanogaster] gb|AAF56870.1| CG11898-PA [Drosophila melanogaster]
  misc_feature: Gene Ontology Annotation: Molecular function=15-hydroxyprostaglandin dehydrogenase (NAD+) activity; Cellular component=cellular_component unknown; Biological process=biological_process unknown
SRRVGSKCCHRAFGYYLDVCCTTFIGAINASFIIVGKETGVGDVGLAITQAFMLNGIAQYAIKLWADIENKMTSVQRILEYVGINTEDNDLRDIFKDWSSNNIIQYKYVHFRYDYSQQYILKDITITINEREKVGI

SEQ ID NO: 33753 - protein, 63 aa, Diabrotica virgifera
  misc_feature: Coding regions on vcDNA: vcDNA=SeqID_13450; Strand=-; Position=36-227
SNRCEYNSQCRTILLKRSRSVKSCRVYLLIQSVQIVYNNVKPYNLESTVWIHMKSITAISYVH

SEQ ID NO: 33754 - protein, 113 aa, Diabrotica virgifera
  misc_feature: Coding regions on vcDNA: vcDNA=SeqID_13451; Strand=+; Position=1-342
  misc_feature: Homolog annotation: Hit_ID=XP_316835.1; Match level="QueryCoverage =89%, HitCoverage=51%, E-value=9e-20, Identity=49%"; Hit description =ENSANGP00000017778 [Anopheles gambiae]
  misc_feature (4)..(4): Xaa can be any naturally occurring amino acid
  misc_feature (48)..(59): Xaa can be any naturally occurring amino acid
KNVXVIILEGCSIELAEDDAQFSFKIDFHGTNNRSYILGAESQESMEXXXXXXXXXXXXYMKLMVAELQRQLDDVEETPMPISSPQPVGSPVPPPRTRHNPFNRPENNPHQRS

SEQ ID NO: 33755 - protein, 52 aa, Diabrotica virgifera
  misc_feature: Coding regions on vcDNA: vcDNA=SeqID_13452; Strand=-; Position=1-156
  misc_feature (30)..(36): Xaa can be any naturally occurring amino acid
  misc_feature (43)..(43): Xaa can be any naturally occurring amino acid
LIFPIIYGVNANAKVKEIHFYFGNILSLRXXXXXXXVSIRILXRGYVPATKS

SEQ ID NO: 33756 - protein, 137 aa, Diabrotica virgifera
  misc_feature: Coding regions on vcDNA: vcDNA=SeqID_13453; Strand=+; Position=1-411
  misc_feature: Homolog annotation: Hit_ID=XP_314867.1; Match level="QueryCoverage =95%, HitCoverage=17%, E-value=2e-32, Identity=45%"; Hit description =ENSANGP00000005174 [Anopheles gambiae]
  misc_feature (130)..(130): Xaa can be any naturally occurring amino acid
SKLYEELEREMEKLPREDTILVMGDFNAQIGKEDYINQVAGKHTIHEKTNDNGQRLCNLASSTNMIIVSTKFEHPKYHKVTWISPDQKTWSQIDHILITRRKQTSVTDVRSYRGAHADTDHFMVTAKVRXKVKRTLK

SEQ ID NO: 33757 - protein, 66 aa, Diabrotica virgifera
  misc_feature: Coding regions on vcDNA: vcDNA=SeqID_13454; Strand=+; Position=25-222
LWTHRSRTRVHEISFNDTKYAVNEFTTSNAAIPHKRGHFIDIDEQFNFYKELFDHFMMPSGLLVGL

SEQ ID NO: 33758 - protein, 85 aa, Diabrotica virgifera
  misc_feature: Coding regions on vcDNA: vcDNA=SeqID_13455; Strand=+; Position=80-335
  misc_feature: Homolog annotation: Hit_ID=CAE47499.1; Match level="QueryCoverage =94%, HitCoverage=25%, E-value=3e-12, Identity=50%"; Hit description =cathepsin L-like proteinase [Diabrotica virgifera virgifera]
  misc_feature (12)..(12): Xaa can be any naturally occurring amino acid
QRQYYQVRFQVXFSVFLRIFDFHTAGYHRGDISISLVCFITELSSEDFIAILNSNYIHKPKLESTSRFVHDPHVNVTDSRDWREK

SEQ ID NO: 33759 - protein, 34 aa, Diabrotica virgifera
  misc_feature: Coding regions on vcDNA: vcDNA=SeqID_13456; Strand=+; Position=1-102
KISRIIPKLASSIFVRSITLHTLHWDHTYLNPQL

SEQ ID NO: 33760 - protein, 81 aa, Diabrotica virgifera
  misc_feature: Coding regions on vcDNA: vcDNA=SeqID_13457; Strand=-; Position=21-266
  misc_feature (6)..(13): Xaa can be any naturally occurring amino acid
EMRRMXXXXXXXXFHVCVNYTLYHVNKNKEPLNVVKMSGAQNTPASGYEHNVAQKCIFTLIENKILDLLSKILPQYLLNLK

SEQ ID NO: 33761 - protein, 45 aa, Diabrotica virgifera
  misc_feature: Coding regions on vcDNA: vcDNA=SeqID_13458; Strand=-; Position=17-154
CEIKRQAKLTKDRRIVTKPCRTAHMKKINAYGTQSGSKYREQQRY

SEQ ID NO: 33762 - protein, 57 aa, Diabrotica virgifera
  misc_feature: Coding regions on vcDNA: vcDNA=SeqID_13459; Strand=+; Position=239-409
VKSKLYFPLLLFFKMSCSSVLCISTLSYVKLSTISISSSNSTGRLFPLALACVSFFV

SEQ ID NO: 33763 - protein, 70 aa, Diabrotica virgifera
  misc_feature: Coding regions on vcDNA: vcDNA=SeqID_13460; Strand=+; Position=3-215
ICKYRDTYLVERKKPFNYITKFSIESLQDESTKYLYRKRLEKRINLSPIEITDNINEAWELIKNHITTSA

SEQ ID NO: 33764 - protein, 61 aa, Diabrotica virgifera
  misc_feature: Coding regions on vcDNA: vcDNA=SeqID_13461; Strand=-; Position=65-250
  misc_feature (49)..(61): Xaa can be any naturally occurring amino acid
NHFYILKYFGGKFTGLWTTIKKNITSIMRLFYSVINVELENFSISENFXXXXXXXXXXXXX

SEQ ID NO: 33765 - protein, 83 aa, Diabrotica virgifera
  misc_feature: Coding regions on vcDNA: vcDNA=SeqID_13462; Strand=+; Position=2-253
  misc_feature: Homolog annotation: Hit_ID=XP_313621.1; Match level="QueryCoverage =95%, HitCoverage=17%, E-value=2e-09, Identity=37%"; Hit description =ENSANGP00000024261 [Anopheles gambiae]
GTTKCSDFRRISLMSHTLKIRLRIIQNRVFLLCETRMDNKQFGFRNGEGTREALFCMRVLLQKSCEFRKNVYVCFINFEKAFD

SEQ ID NO: 33766 - protein, 46 aa, Diabrotica virgifera
  misc_feature: Coding regions on vcDNA: vcDNA=SeqID_13463; Strand=-; Position=28-168
ISRTLLYWPDVTSCIPQARAILIVLLFTCLTFQVIFYFVLFLFYQG

SEQ ID NO: 33767 - protein, 86 aa, Diabrotica virgifera
  misc_feature: Coding regions on vcDNA: vcDNA=SeqID_13464; Strand=+; Position=3-263
VSLQHFGCMYRYNCYMYYFGVSNKDNNYEDFRILLKLVIIYGDAIVGPSALCAHGSVCCIHDTHFCMPIVSQYESAISISNLTTYL

SEQ ID NO: 33768 - protein, 105 aa, Diabrotica virgifera
  misc_feature: Coding regions on vcDNA: vcDNA=SeqID_13465; Strand=+; Position=49-363
EEEKMCQVYVASAILILAIVDCGFALQCWDCKSEFDVTCRDYFNVSRIEENNRIYENFNFQQSNSRQFSIGNRNNPRKIHCDGSYVNSYNQKTVCLKTVSRGFSG

SEQ ID NO: 33769 - protein, 80 aa, Diabrotica virgifera
  misc_feature: Coding regions on vcDNA: vcDNA=SeqID_13466; Strand=+; Position=3-242
  misc_feature (20)..(25): Xaa can be any naturally occurring amino acid
QGFRFFFPLFMPFIPFFWVXXXXXXGPFFLIPGGGNPPVFPGIPPFEKTPFFVRGFSLLRGSHFSLFPNFVPLYGILDPP

SEQ ID NO: 33770 - protein, 123 aa, Diabrotica virgifera
  misc_feature: Coding regions on vcDNA: vcDNA=SeqID_13467; Strand=+; Position=3-371
  misc_feature: Pfam annotation: Pfam_ID=RnaseH; Match level="Score=-25.2, E-value =0.036, Copies=1"; Pfam description=RNase H
TDFLTKIDHLQCVQKNWGSYQKLYTDGSKMEGKVGYAIYYPQKSIKINNRLPDKMTIFTAELIAIKEAYKICINQKELNYVIFKDCQSIVKTLKYNVHNFAENYIISDIIAMNSEALSGKNII

SEQ ID NO: 33771 - protein, 98 aa, Diabrotica virgifera
  misc_feature: Coding regions on vcDNA: vcDNA=SeqID_13468; Strand=+; Position=98-391
  misc_feature: Homolog annotation: Hit_ID=NP_572567.1; Match level="QueryCoverage =98%, HitCoverage=31%, E-value=1e-19, Identity=52%"; Hit description =CG32701-PA [Drosophila melanogaster] gb|AAF46502.1| CG32701-PA [Drosophila melanogaster]
  misc_feature: Gene Ontology Annotation: Molecular function=signal sequence binding; Cellular component=integral to membrane; Biological process =cotranslational membrane targeting
  misc_feature: Pfam annotation: Pfam_ID=TRAP_alpha; Match level="Score=-171.3, E -value=0.04, Copies=1"; Pfam description=Translocon-associated protein (TRAP),
GKMVSYAEEDPIEDEVEVEGEVDSDVEATTPDEEVDEDTKSLSSPYADTTLLFVKPESTGASQLEIPAGLPVEFLVGFRNKGDQDFVVDTLEASFRYP

SEQ ID NO: 33772 - protein, 42 aa, Diabrotica virgifera
  misc_feature: Coding regions on vcDNA: vcDNA=SeqID_13469; Strand=-; Position=0-125
  misc_feature (27)..(34): Xaa can be any naturally occurring amino acid
LLLNLSKCLINSGSKAQRISFDQNNYXXXXXXXXQNIGIYFL

SEQ ID NO: 33773 - protein, 57 aa, Diabrotica virgifera
  misc_feature: Coding regions on vcDNA: vcDNA=SeqID_13470; Strand=+; Position=28-201
IYFSAFTTFVAHNVILSTRKFFPDDGLSILKSIPDSSHTCLIILVIDIGYGLTRAST

SEQ ID NO: 33774 - protein, 48 aa, Diabrotica virgifera
  misc_feature: Coding regions on vcDNA: vcDNA=SeqID_13471; Strand=-; Position=168-314
SPRFQPHEMLIWINYSLKRTTITDRLSHFLQCVSIWILRIYSVALWML

SEQ ID NO: 33775 - protein, 39 aa, Diabrotica virgifera
  misc_feature: Coding regions on vcDNA: vcDNA=SeqID_13472; Strand=+; Position=1-120
RPILDRERSPFFCFFVCFNIYLHGAIILDMWAFRTSIQG

SEQ ID NO: 33776 - protein, 57 aa, Diabrotica virgifera
  misc_feature: Coding regions on vcDNA: vcDNA=SeqID_13473; Strand=-; Position=241-414
LSQRQLPYSSDASKSEKLCNVMLIYTFISTTSTSNSFISFYVTMHDAFHPLRYFAGY

SEQ ID NO: 33777 - protein, 44 aa, Diabrotica virgifera
  misc_feature: Coding regions on vcDNA: vcDNA=SeqID_13474; Strand=+; Position=1-135
MGHCTISNHCCRYHLITLRDCPSAYSHSVLDVHKTGFFNIGNDQ

SEQ ID NO: 33778 - protein, 70 aa, Diabrotica virgifera
  misc_feature: Coding regions on vcDNA: vcDNA=SeqID_13475; Strand=+; Position=135-347
  misc_feature: Homolog annotation: Hit_ID=XP_310410.1; Match level="QueryCoverage =88%, HitCoverage=89%, E-value=4e-25, Identity=79%"; Hit description =ENSANGP00000017966 [Anopheles gambiae]
  misc_feature: Pfam annotation: Pfam_ID=DSS1_SEM1; Match level="Score=88.3, E-value =2e-23, Copies=1"; Pfam description=DSS1/SEM1 family
MTDKAKLDLGVLEEDDEFEEFPVEDWSGKEKDEQDISVWEDNWEDDNVEDDFNKQLRAQLEKQKAKPPAK

SEQ ID NO: 33779 - protein, 38 aa, Diabrotica virgifera
  misc_feature: Coding regions on vcDNA: vcDNA=SeqID_13476; Strand=-; Position=161-277
IGKRIECTYLFNWRIVVQSSLVNLTSLNSYCPTKSCNN

SEQ ID NO: 33780 - protein, 43 aa, Diabrotica virgifera
  misc_feature: Coding regions on vcDNA: vcDNA=SeqID_13477; Strand=-; Position=42-173
FTREEKIGILKMYQYNLVFILHIKRYIIRVHIMSFNIYAGVPQ

SEQ ID NO: 33781 - protein, 73 aa, Diabrotica virgifera
  misc_feature: Coding regions on vcDNA: vcDNA=SeqID_13478; Strand=+; Position=2-223
SPPTRPTDPISLLQTYTTDIPNFIYMLTTIKPYFTEKSMKTKCTKLINKIEKMLDDPAYQDSDCSTNSAPEIN

SEQ ID NO: 33782 - protein, 48 aa, Diabrotica virgifera
  misc_feature: Coding regions on vcDNA: vcDNA=SeqID_13479; Strand=+; Position=39-185
  misc_feature (9)..(25): Xaa can be any naturally occurring amino acid
  misc_feature (27)..(35): Xaa can be any naturally occurring amino acid
MYNKFLLRXXXXXXXXXXXXXXXXXCXXXXXXXXXRPLKRCQLVYQGA

SEQ ID NO: 33783 - protein, 57 aa, Diabrotica virgifera
  misc_feature: Coding regions on vcDNA: vcDNA=SeqID_13480; Strand=+; Position=215-385
SELPNVTHTQLPTYFMNTAQSDPGSFFENLSTAKTNAGDFGNISEVVSSPRSAQHVT

SEQ ID NO: 33784 - protein, 48 aa, Diabrotica virgifera
  misc_feature: Coding regions on vcDNA: vcDNA=SeqID_13481; Strand=-; Position=0-143
KPVTLPKPNITTIELTQRKLERLMLGLQLHDRRSNKWIYTHKILSLER

SEQ ID NO: 33785 - protein, 103 aa, Diabrotica virgifera
  misc_feature: Coding regions on vcDNA: vcDNA=SeqID_13482; Strand=+; Position=22-330
  misc_feature: Homolog annotation: Hit_ID=NP_611099.2; Match level="QueryCoverage =86%, HitCoverage=16%, E-value=7e-23, Identity=58%"; Hit description =CG15706-PA [Drosophila melanogaster] gb|AAF58040.2| CG15706-PA [Drosophila melanogaster]
MMQINRKLLPIKGHYFFFMAAMGPILPQLNVIGKELGVSSFVMGIITGNPPMLFLLAKPVFGLILDIFRDYRKSIFIALIVANTVSVWGPEYISQKTGLRIAF

SEQ ID NO: 33786 - protein, 125 aa, Diabrotica virgifera
  misc_feature: Coding regions on vcDNA: vcDNA=SeqID_13483; Strand=-; Position=57-434
  misc_feature (63)..(80): Xaa can be any naturally occurring amino acid
  misc_feature (90)..(99): Xaa can be any naturally occurring amino acid
  misc_feature (109)..(120): Xaa can be any naturally occurring amino acid
LASSWIPDRSLSKGATVLTKATRSSFMHLPTPATKLTRSAMMPFSCSSMQEINFFTESVLSKXXXXXXXXXXXXXXXXXXDLQNFEYRNXXXXXXXXXXLFEFILFQIXXXXXXXXXXXXKFKFF

SEQ ID NO: 33787 - protein, 99 aa, Diabrotica virgifera
  misc_feature: Coding regions on vcDNA: vcDNA=SeqID_13484; Strand=-; Position=94-393
NFDLQRESKLNKNNLIKSCVVCEHLPIAGPEEKDTTQKCISPVICSYLVKLAPKIRYFYQEKCHIDVYFQLRKTFDGFKTFDENESVFIRKTVVFREAP

SEQ ID NO: 33788 - protein, 77 aa, Diabrotica virgifera
  misc_feature: Coding regions on vcDNA: vcDNA=SeqID_13485; Strand=-; Position=178-411
  misc_feature (68)..(68): Xaa can be any naturally occurring amino acid
LMTSENPPVCEHCNSHRLTVEHLLVECSYYSSYRLAHNINGNLKQILSSPNVYSALIDFLKDCKIYHXHCSLKKIIL

SEQ ID NO: 33789 - protein, 122 aa, Diabrotica virgifera
  misc_feature: Coding regions on vcDNA: vcDNA=SeqID_13486; Strand=+; Position=3-368
  misc_feature: Homolog annotation: Hit_ID=NP_997857.1; Match level="QueryCoverage =97%, HitCoverage=17%, E-value=1e-15, Identity=36%"; Hit description =Unknown (protein for MGC:76912) [Danio rerio] gb|AAH66736.1| Unknown (protein for MGC:76912)
  misc_feature: Gene Ontology Annotation: Molecular function=protein binding; Biological process=negative regulation of macrophage differentiation
PLQVQIVAKLKDGPLLTIKFSYLIKLKIITVMSSTNCSACKITGNSAREVLTGENLLSELVEDDNGLESPNPITKFQIKKIGLTSFQSLVPQIGYAYHWAQRVCGRDFLNKKMDSDELGRTN

SEQ ID NO: 33790 - protein, 90 aa, Diabrotica virgifera
  misc_feature: Coding regions on vcDNA: vcDNA=SeqID_13487; Strand=-; Position=0-269
  misc_feature (14)..(23): Xaa can be any naturally occurring amino acid
TLPIKDCRKQDFSXXXXXXXXXXNLKCIKSQNKSKEPENKRFVTLENKFWLQPIYEPSTIYKATDDKWIDMGSLQYALHDTSIYLGKNPT

SEQ ID NO: 33791 - protein, 21 aa, Diabrotica virgifera
  misc_feature: Coding regions on vcDNA: vcDNA=SeqID_13488; Strand=-; Position=2-64
FDDLNHGDLSLGPLEWPPLLC

SEQ ID NO: 33792 - protein, 58 aa, Diabrotica virgifera
  misc_feature: Coding regions on vcDNA: vcDNA=SeqID_13489; Strand=+; Position=29-205
  misc_feature (23)..(29): Xaa can be any naturally occurring amino acid
FLCLFLLQLLINYKISIHIIIIXXXXXXXWKKEIYCNHVDGIPHSLRKKKQFPEGNYQ

SEQ ID NO: 33793 - protein, 41 aa, Diabrotica virgifera
  misc_feature: Coding regions on vcDNA: vcDNA=SeqID_13490; Strand=+; Position=11-136
RSSSCILMSINLHSKISDITRYSTCKYQDSLSCRQSNFISY

SEQ ID NO: 33794 - protein, 91 aa, Diabrotica virgifera
  misc_feature: Coding regions on vcDNA: vcDNA=SeqID_13491; Strand=-; Position=36-311
VVDEYIYLGQIIKANKENQTIEVQRRIRLAWAAFGKLRWILKSIKMQQYLKTRDINKGQHKQNRNNSEKNGKLHVGNTTARQKIKQMDIYT

SEQ ID NO: 33795 - protein, 68 aa, Diabrotica virgifera
  misc_feature: Coding regions on vcDNA: vcDNA=SeqID_13492; Strand=+; Position=94-300
YVYRGYFLTRIHIETESEQSDTGSINPDPGSIIGFRNGPSGKLIGDPCPRAPVAQGHLLEFRGIAALK

SEQ ID NO: 33796 - protein, 31 aa, Diabrotica virgifera
  misc_feature: Coding regions on vcDNA: vcDNA=SeqID_13493; Strand=-; Position=3-95
  misc_feature (9)..(24): Xaa can be any naturally occurring amino acid
  misc_feature (26)..(31): Xaa can be any naturally occurring amino acid
YLIQNDMLXXXXXXXXXXXXXXXXYXXXXXX

SEQ ID NO: 33797 - protein, 44 aa, Diabrotica virgifera
  misc_feature: Coding regions on vcDNA: vcDNA=SeqID_13494; Strand=+; Position=12-146
VVIAGIIILMVLKVDKCGHHVNFYARVFEIQLSQFNIMYHVIPG

SEQ ID NO: 33798 - protein, 26 aa, Diabrotica virgifera
  misc_feature: Coding regions on vcDNA: vcDNA=SeqID_13495; Strand=-; Position=1-78
NSNTLAQYELAITQSKRSTPMLKDIW

SEQ ID NO: 33799 - protein, 68 aa, Diabrotica virgifera
  misc_feature: Coding regions on vcDNA: vcDNA=SeqID_13496; Strand=+; Position=12-215
LISRAYNYHMALGCKCHITFSSVGTFSYYGDQMCYHNFVIKQNRSTIIILSITWHATSHVNNHMDELT

SEQ ID NO: 33800 - protein, 101 aa, Diabrotica virgifera
  misc_feature: Coding regions on vcDNA: vcDNA=SeqID_13497; Strand=+; Position=1-306
  misc_feature: Homolog annotation: Hit_ID=AAG17127.1; Match level="QueryCoverage =100%, HitCoverage=31%, E-value=7e-36, Identity=69%"; Hit description= cathepsin L-like cysteine proteinase CAL1 [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=-27.2, E -value=4.3e-09, Copies=1"; Pfam description=Papain family cysteine protease
EVAANEESLRQAVGTVGPISAAINANPLQFYSSGVFDGQCANSRNDLDHGILVVGYGEENNKPYWIIKNSWGADWGEQGYFRLERNVNMCGLDLVTSYPVL

SEQ ID NO: 33801 - protein, 71 aa, Diabrotica virgifera
  misc_feature: Coding regions on vcDNA: vcDNA=SeqID_13498; Strand=+; Position=8-223
LHTSLVGLKITSYFAIVLNYLMLVYQIFSTIYSSSSKLLLMCCWINTKLLGQFETLAWLYKAHIRSASASS

SEQ ID NO: 33802 - protein, 82 aa, Diabrotica virgifera
  misc_feature: Coding regions on vcDNA: vcDNA=SeqID_13499; Strand=-; Position=3-248
DRLMIIHPFIPAFDISSTDHLTITESIYMAHSNPSAGMSEFLCPTECPLLNSLVENVLRITFIQPADFYYRGICFVNILASA

SEQ ID NO: 33803 - protein, 68 aa, Diabrotica virgifera
  misc_feature: Coding regions on vcDNA: vcDNA=SeqID_13500; Strand=+; Position=156-359
  misc_feature (35)..(47): Xaa can be any naturally occurring amino acid
IVTISAIHSPTNLTILLLNCYLIQCSCIRMSTHSXXXXXXXXXXXXXVTSNTFITRDFYHNTNLHFYG

SEQ ID NO: 33804 - protein, 74 aa, Diabrotica virgifera
  misc_feature: Coding regions on vcDNA: vcDNA=SeqID_13501; Strand=-; Position=4-228
  misc_feature (18)..(48): Xaa can be any naturally occurring amino acid
SIEVYIMFYSCFLYHLSXXXXXXXXXXXXXXXXXXXXXXXXXXXXXXXTRFNRNNIVHVGTYLQELLIQTCRVF

SEQ ID NO: 33805 - protein, 28 aa, Diabrotica virgifera
  misc_feature: Coding regions on vcDNA: vcDNA=SeqID_13502; Strand=-; Position=1-84
  misc_feature (17)..(24): Xaa can be any naturally occurring amino acid
FHCFLKYLNVSSNSFSXXXXXXXXSNLT

SEQ ID NO: 33806 - protein, 87 aa, Diabrotica virgifera
  misc_feature: Coding regions on vcDNA: vcDNA=SeqID_13503; Strand=-; Position=1-261
  misc_feature (4)..(79): Xaa can be any naturally occurring amino acid
  misc_feature (83)..(87): Xaa can be any naturally occurring amino acid
RMVXXXXXXXXXXXXXXXXXXXXXXXXXXXXXXXXXXXXXXXXXXXXXXXXXXXXXXXXXXXXXXXXXXXXXXXXXXXXFIYXXXXX

SEQ ID NO: 33807 - protein, 81 aa, Diabrotica virgifera
  misc_feature: Coding regions on vcDNA: vcDNA=SeqID_13504; Strand=+; Position=132-374
  misc_feature (3)..(9): Xaa can be any naturally occurring amino acid
  misc_feature (15)..(22): Xaa can be any naturally occurring amino acid
  misc_feature (46)..(52): Xaa can be any naturally occurring amino acid
NYXXXXXXXQKYEFXXXXXXXXNSFKSSSSRSILSSSSFEFAGYSXXXXXXXFYKHTPSFLKIKSFSTNDFVGVLKSYQNM

SEQ ID NO: 33808 - protein, 111 aa, Diabrotica virgifera
  misc_feature: Coding regions on vcDNA: vcDNA=SeqID_13505; Strand=-; Position=1-333
  misc_feature (1)..(5): Xaa can be any naturally occurring amino acid
  misc_feature (20)..(27): Xaa can be any naturally occurring amino acid
  misc_feature (35)..(45): Xaa can be any naturally occurring amino acid
  misc_feature (58)..(104): Xaa can be any naturally occurring amino acid
XXXXXLAQVWLKFFPLVVPXXXXXXXXPFFGRANXXXXXXXXXXXFCNFPKNFLYLGXXXXXXXXXXXXXXXXXXXXXXXXXXXXXXXXXXXXXXXXXXXXXXXLAIPRVR

SEQ ID NO: 33809 - protein, 65 aa, Diabrotica virgifera
  misc_feature: Coding regions on vcDNA: vcDNA=SeqID_13506; Strand=-; Position=203-400
  misc_feature (47)..(53): Xaa can be any naturally occurring amino acid
KVFNLICNLPRHNLQSPSNCNGLFCYETEVDVMNNELNKDFELDIAXXXXXXXVMKLFLFIFLSN

SEQ ID NO: 33810 - protein, 106 aa, Diabrotica virgifera
  misc_feature: Coding regions on vcDNA: vcDNA=SeqID_13507; Strand=+; Position=3-319
  misc_feature: Homolog annotation: Hit_ID=AAA73456.2; Match level="QueryCoverage =73%, HitCoverage=69%, E-value=2e-09, Identity=41%"; Hit description =beta-galactosidase alpha peptide [Cloning vector pSport1]
  misc_feature (20)..(20): Xaa can be any naturally occurring amino acid
  misc_feature (40)..(40): Xaa can be any naturally occurring amino acid
KFPTGGPKGSSLTYAARQVXNPSKMATKFNSMGRLLKRPXWENPGGTQLKPPGTKPPFPNRGKNQKGPNHCPSQQLANLKGQWEPPRYRAITPGGCGGNPNRNRKT

SEQ ID NO: 33811 - protein, 61 aa, Diabrotica virgifera
  misc_feature: Coding regions on vcDNA: vcDNA=SeqID_13508; Strand=+; Position=2-187
  misc_feature: Homolog annotation: Hit_ID=EAL34272.1; Match level="QueryCoverage =100%, HitCoverage=19%, E-value=5e-23, Identity=73%"; Hit description= GA21524-PA [Drosophila pseudoobscura]
  misc_feature: Gene Ontology Annotation: Cellular component=membrane; Biological process=meiosis
KHHDFPAVPGSRLPDVKRIAPEFYDNLPQHHSWSAVLYDFVMDPDVGPYARIRRQAKGLST

SEQ ID NO: 33812 - protein, 87 aa, Diabrotica virgifera
  misc_feature: Coding regions on vcDNA: vcDNA=SeqID_13509; Strand=-; Position=2-262
  misc_feature (4)..(17): Xaa can be any naturally occurring amino acid
SSVXXXXXXXXXXXXXXLIVFYDNCLCTYINFFICGYIWYFIICIGLAFSRQSIHVAFSICFGSISSLTPFLNLLLTSYKAPYFLLS

SEQ ID NO: 33813 - protein, 125 aa, Diabrotica virgifera
  misc_feature: Coding regions on vcDNA: vcDNA=SeqID_13510; Strand=+; Position=37-411
  misc_feature: Homolog annotation: Hit_ID=NP_650949.1; Match level="QueryCoverage =92%, HitCoverage=32%, E-value=1e-25, Identity=49%"; Hit description =CG5802-PA [Drosophila melanogaster] gb|AAF55859.1| CG5802-PA [Drosophila melanogaster]
  misc_feature: Gene Ontology Annotation: Molecular function=UDP-galactose transporter activity; Cellular component=microsome; Biological process=transport
KAAVTKVNYRINMHNNNKFFLYAAGIFLSYFYFGIVQEKITRGKYPYELTKEDGTKVVENEKYTYAVTLVLVQCILNYLIAKIAATMWPQGEDTTRTLYYASMSFTYLLAMICSNMALQWVAIPT

SEQ ID NO: 33814 - protein, 45 aa, Diabrotica virgifera
  misc_feature: Coding regions on vcDNA: vcDNA=SeqID_13511; Strand=+; Position=154-291
YLVRASSSYRIQTLLDATSLHSSIILVITARVLLATVLYFRFIHA

SEQ ID NO: 33815 - protein, 59 aa, Diabrotica virgifera
  misc_feature: Coding regions on vcDNA: vcDNA=SeqID_13512; Strand=-; Position=2-178
  misc_feature (51)..(59): Xaa can be any naturally occurring amino acid
CYQSTLERLKLPIFIILLLISHDCRSNSLLWLIFLNASVVKTSKLVVNKQXXXXXXXXX

SEQ ID NO: 33816 - protein, 138 aa, Diabrotica virgifera
  misc_feature: Coding regions on vcDNA: vcDNA=SeqID_13513; Strand=-; Position=1-414
  misc_feature (7)..(30): Xaa can be any naturally occurring amino acid
  misc_feature (33)..(137): Xaa can be any naturally occurring amino acid
GTNFFSXXXXXXXXXXXXXXXXXXXXXXXXVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 33817 - protein, 55 aa, Diabrotica virgifera
  misc_feature: Coding regions on vcDNA: vcDNA=SeqID_13514; Strand=+; Position=1-168
  misc_feature (36)..(50): Xaa can be any naturally occurring amino acid
TISGKFSFYFHSFTKSLKSFYGSVLCQLYIKLAKHXXXXXXXXXXXXXXXQLISD

SEQ ID NO: 33818 - protein, 40 aa, Diabrotica virgifera
  misc_feature: Coding regions on vcDNA: vcDNA=SeqID_13515; Strand=-; Position=1-120
  misc_feature (8)..(24): Xaa can be any naturally occurring amino acid
YEENLFDXXXXXXXXXXXXXXXXXGCYVKYLHSYIGSRPR

SEQ ID NO: 33819 - protein, 139 aa, Diabrotica virgifera
  misc_feature: Coding regions on vcDNA: vcDNA=SeqID_13516; Strand=+; Position=3-419
  misc_feature (20)..(39): Xaa can be any naturally occurring amino acid
EKCDTPYDGKNKHKCKKTPXXXXXXXXXXXXXXXXXXXXEACNRFCFNTECFDNHTEVCKEVFKCPSCNKTCKREHRHECGYSVCKNCKTFVEIATHQCYMVKKPAKGGFCTVSCLCNKKTITVNKGCQIHTKSQTICN

SEQ ID NO: 33820 - protein, 55 aa, Diabrotica virgifera
  misc_feature: Coding regions on vcDNA: vcDNA=SeqID_13517; Strand=+; Position=192-359
  misc_feature (36)..(45): Xaa can be any naturally occurring amino acid
DKLQVSTNLIDGILVNLLNCFTYFDILFINVKQIIXXXXXXXXXXIHRFGYIVCY

SEQ ID NO: 33821 - protein, 144 aa, Diabrotica virgifera
  misc_feature: Coding regions on vcDNA: vcDNA=SeqID_13518; Strand=+; Position=1-432
  misc_feature: Homolog annotation: Hit_ID=XP_310145.1; Match level="QueryCoverage =84%, HitCoverage=31%, E-value=7e-38, Identity=59%"; Hit description =ENSANGP00000019975 [Anopheles gambiae]
  misc_feature: Gene Ontology Annotation: Molecular function=protein binding; Cellular component=nucleus; Biological process=NADH biosynthesis
TIRNGDTGPVKVKLLCGADLLESFGTPGLWANEDLEEIVGRHGLVVITRSNSNPAEFIYNSDLLTKYMANITIVTEWIANEISSTKVRRALRRNESVKYILPDKVIDYIHKNGLYGSQKTIKYLHVPNSVFLTPSPTDIIMDSP

SEQ ID NO: 33822 - protein, 52 aa, Diabrotica virgifera
  misc_feature: Coding regions on vcDNA: vcDNA=SeqID_13519; Strand=+; Position=107-265
YILVSHNGPLIDQLYLDTCILPLQQSSKYSASIIYIFSCLEFILALSNNQLV

SEQ ID NO: 33823 - protein, 98 aa, Diabrotica virgifera
  misc_feature: Coding regions on vcDNA: vcDNA=SeqID_13520; Strand=+; Position=38-333
  misc_feature: Homolog annotation: Hit_ID=AAF13316.1; Match level="QueryCoverage =85%, HitCoverage=52%, E-value=4e-18, Identity=53%"; Hit description =translation initiation factor 5A [Spodoptera frugiperda] gb|AAF13315.1| translation initiation factor 5A [
  misc_feature: Gene Ontology Annotation: Molecular function=translation initiation factor activity; Cellular component=ribosome; Biological process =translational initiation
  misc_feature (61)..(61): Xaa can be any naturally occurring amino acid
  misc_feature (67)..(67): Xaa can be any naturally occurring amino acid
MFVDALIGPFEGNLDNTYFIAGYSGGSASYPTVCTSLRKNCIFMLKSIPCFIVGVSTSRVXKHSHAXFHLDGICIFTGYLIEEICPSIHLMVVPHVNH

SEQ ID NO: 33824 - protein, 34 aa, Diabrotica virgifera
  misc_feature: Coding regions on vcDNA: vcDNA=SeqID_13521; Strand=-; Position=0-101
  misc_feature (2)..(24): Xaa can be any naturally occurring amino acid
VXXXXXXXXXXXXXXXXXXXXXXXRLGDPGRCGP

SEQ ID NO: 33825 - protein, 39 aa, Diabrotica virgifera
  misc_feature: Coding regions on vcDNA: vcDNA=SeqID_13522; Strand=-; Position=100-219
STNIRTHAYFVMGTYYMTAANYETTNGNKFLATNLSTTY

SEQ ID NO: 33826 - protein, 87 aa, Diabrotica virgifera
  misc_feature: Coding regions on vcDNA: vcDNA=SeqID_13523; Strand=+; Position=66-329
  misc_feature (13)..(25): Xaa can be any naturally occurring amino acid
  misc_feature (31)..(41): Xaa can be any naturally occurring amino acid
  misc_feature (69)..(78): Xaa can be any naturally occurring amino acid
DYYVYNLLSLLYXXXXXXXXXXXXXEELFSXXXXXXXXXXXSLWLAILHIIVRVNGNDYILTFSSLRYXXXXXXXXXXLYVLDEIFD

SEQ ID NO: 33827 - protein, 125 aa, Diabrotica virgifera
  misc_feature: Coding regions on vcDNA: vcDNA=SeqID_13524; Strand=+; Position=74-448
CSLTGLPKPLFSDLPVNNNNTYSYDIMENDLRSAEPVVFMPTTIEKPRRLADKLEVLKQLTFYKSLLTVLTTKFSMFIFYTLFPLYVYQEVERLTLREMSVMVGLLSISGLLFTGVSHWINIDKK

SEQ ID NO: 33828 - protein, 78 aa, Diabrotica virgifera
  misc_feature: Coding regions on vcDNA: vcDNA=SeqID_13525; Strand=-; Position=3-236
  misc_feature (50)..(57): Xaa can be any naturally occurring amino acid
GQSKYLKKYLNSKDTKFEKVKSGQDVNWHLCIFVKFISKRKKLHAPKFNXXXXXXXXGMLHILFSHRYMLHFKIKILL

SEQ ID NO: 33829 - protein, 37 aa, Diabrotica virgifera
  misc_feature: Coding regions on vcDNA: vcDNA=SeqID_13526; Strand=-; Position=0-110
  misc_feature (10)..(34): Xaa can be any naturally occurring amino acid
IGIWKRSTCXXXXXXXXXXXXXXXXXXXXXXXXXRVG

SEQ ID NO: 33830 - protein, 67 aa, Diabrotica virgifera
  misc_feature: Coding regions on vcDNA: vcDNA=SeqID_13527; Strand=+; Position=201-404
KRKILANKNKLRRISEARIYIDEDLTLNERYIRQIKHRAPATICAKCAMHTGAILYRRQNPGSQIEK

SEQ ID NO: 33831 - protein, 98 aa, Diabrotica virgifera
  misc_feature: Coding regions on vcDNA: vcDNA=SeqID_13528; Strand=+; Position=3-299
  misc_feature (4)..(46): Xaa can be any naturally occurring amino acid
  misc_feature (55)..(74): Xaa can be any naturally occurring amino acid
  misc_feature (81)..(94): Xaa can be any naturally occurring amino acid
HASXXXXXXXXXXXXXXXXXXXXXXXXXXXXXXXXXXXXXXXXXXXHERVNFCIXXXXXXXXXXXXXXXXXXXXLTNYNVXXXXXXXXXXXXXXCYSF

SEQ ID NO: 33832 - protein, 78 aa, Diabrotica virgifera
  misc_feature: Coding regions on vcDNA: vcDNA=SeqID_13529; Strand=-; Position=162-398
NLLVSIETTQLVNIIKRRKLEYFGHAKIQGKRGSGRSRTSWLKNSKRQWYGKSTSLFRATVQKGTVANLVANIISNYR

SEQ ID NO: 33833 - protein, 40 aa, Diabrotica virgifera
  misc_feature: Coding regions on vcDNA: vcDNA=SeqID_13530; Strand=+; Position=198-320
MIVDILEIYIQMIVSPSLKFTVISVTSTFTFHIGYHRLIM

SEQ ID NO: 33834 - protein, 91 aa, Diabrotica virgifera
  misc_feature: Coding regions on vcDNA: vcDNA=SeqID_13531; Strand=+; Position=51-326
QNIAKAQTLCHSGFTNLHDLRVVLARLRSQVTSLLCAVDIDRDLTCSIQRDLHLHLDLLVLFLPLQCHTVHRHSGLRYTLYRLSSDSLRYL

SEQ ID NO: 33835 - protein, 49 aa, Diabrotica virgifera
  misc_feature: Coding regions on vcDNA: vcDNA=SeqID_13532; Strand=+; Position=1-150
IVHELLQSETGELQIKKSMFTNTSGGIPLHRIDIAKALREGNGTLEVSF

SEQ ID NO: 33836 - protein, 77 aa, Diabrotica virgifera
  misc_feature: Coding regions on vcDNA: vcDNA=SeqID_13533; Strand=+; Position=2-232
  misc_feature: Homolog annotation: Hit_ID=AAS02310.1; Match level="QueryCoverage =98%, HitCoverage=25%, E-value=4e-12, Identity=48%"; Hit description =glyceraldehyde 3-phosphate dehydrogenase [Centruroides sp. SBH266264]
ASRDKGLEILAVNDTFLDVNHMVYLFKFDSIHCLYIGYVNSEYKYLIVDSIHNSVEHYRDSSDIPSCKSRADYVLQF

SEQ ID NO: 33837 - protein, 59 aa, Diabrotica virgifera
  misc_feature: Coding regions on vcDNA: vcDNA=SeqID_13534; Strand=+; Position=31-207
  misc_feature: Homolog annotation: Hit_ID=XP_315642.1; Match level="QueryCoverage =96%, HitCoverage=11%, E-value=1e-12, Identity=57%"; Hit description =ENSANGP00000021830 [Anopheles gambiae]
  misc_feature (50)..(50): Xaa can be any naturally occurring amino acid
YLFMQCDKVCRFWDSGRGIYHFENCSFVVRCNEYHHRRHITMHMGGNLGXVHRFLVTAI

SEQ ID NO: 33838 - protein, 37 aa, Diabrotica virgifera
  misc_feature: Coding regions on vcDNA: vcDNA=SeqID_13535; Strand=+; Position=1-111
  misc_feature (4)..(22): Xaa can be any naturally occurring amino acid
PTRXXXXXXXXXXXXXXXXXXXGRSTRIKNYLLNHKT

SEQ ID NO: 33839 - protein, 148 aa, Diabrotica virgifera
  misc_feature: Coding regions on vcDNA: vcDNA=SeqID_13536; Strand=+; Position=3-449
  misc_feature: Homolog annotation: Hit_ID=XP_318953.1; Match level="QueryCoverage =96%, HitCoverage=16%, E-value=1e-48, Identity=64%"; Hit description =ENSANGP00000015142 [Anopheles gambiae]
  misc_feature: Gene Ontology Annotation: Cellular component=endoplasmic reticulum; Biological process=nonselective vesicle docking
  misc_feature (66)..(72): Xaa can be any naturally occurring amino acid
HASATLLEDRRDACRAIKALSKKNRLEVGAQGLDILRQVLELDRSDCEIVGYCLDTLCNITSKETXXXXXXXLNRQINVGEQFTEMFLKNSENVTLILGFMEEYDFRVRWPAVRLMTSLVASKPKDVQDIILVSPMGVSKLMDLLFRE

SEQ ID NO: 33840 - protein, 105 aa, Diabrotica virgifera
  misc_feature: Coding regions on vcDNA: vcDNA=SeqID_13537; Strand=+; Position=1-315
  misc_feature (1)..(6): Xaa can be any naturally occurring amino acid
XXXXXXSLNQKKGRQFYRQKNMGGPPKVLHLSFSVNLCRYPSYGSPKFYSVGSFLKFANRETLWFSPFFPVVKISLFPQRSSPHLAPPFFPFPHFAPLKLNWYPP

SEQ ID NO: 33841 - protein, 34 aa, Diabrotica virgifera
  misc_feature: Coding regions on vcDNA: vcDNA=SeqID_13538; Strand=+; Position=3-104
QQAHLLKHATIIQLFSFTDQVTSGIQTSEYVHKG

SEQ ID NO: 33842 - protein, 75 aa, Diabrotica virgifera
  misc_feature: Coding regions on vcDNA: vcDNA=SeqID_13539; Strand=+; Position=45-270
  misc_feature: Homolog annotation: Hit_ID=AAM29581.1; Match level="QueryCoverage =98%, HitCoverage=48%, E-value=5e-15, Identity=58%"; Hit description =RH27794p [Drosophila melanogaster] emb|CAA31500.1| unnamed protein product [Drosophila melanogaster] sp|P0
  misc_feature: Gene Ontology Annotation: Molecular function=ATP binding; Cellular component=nucleus; Biological process=negative regulation of cell proliferation
  misc_feature: Pfam annotation: Pfam_ID=NDK; Match level="Score=-21.7, E-value=9.4e -07, Copies=1"; Pfam description=Nucleoside diphosphate kinase
  misc_feature (13)..(13): Xaa can be any naturally occurring amino acid
  misc_feature (33)..(33): Xaa can be any naturally occurring amino acid
  misc_feature (51)..(51): Xaa can be any naturally occurring amino acid
MVAIHYRTFIMNXPDSVQRGHVGKIIKGFEQKXFRQYTLKFKYPSEELLVXHYSELSGIPLFASLVVYIGSGPVE

SEQ ID NO: 33843 - protein, 52 aa, Diabrotica virgifera
  misc_feature: Coding regions on vcDNA: vcDNA=SeqID_13540; Strand=-; Position=2-157
  misc_feature (11)..(23): Xaa can be any naturally occurring amino acid
LLKCSTASKIXXXXXXXXXXXXXHGLHLLGTWPVLVFRLTGRESSFQRVWIF

SEQ ID NO: 33844 - protein, 34 aa, Diabrotica virgifera
  misc_feature: Coding regions on vcDNA: vcDNA=SeqID_13541; Strand=-; Position=12-116
NSHQVKLQRCAIDNLLDEIIYMPKIPVVLYPLPI

SEQ ID NO: 33845 - protein, 135 aa, Diabrotica virgifera
  misc_feature: Coding regions on vcDNA: vcDNA=SeqID_13542; Strand=+; Position=40-444
TKMKTILSLFLCVILVSVNAWVAIIPADPATAHLGDCYTTSHNLGAFTAGEEKRIEGRCAVAVCSASGDISLRGCGVRRAAYPIRVLPGDLSKPYPRCCHRIVGPNNDTDSDNERTPEYGNVVLAGCFLNPMLSR

SEQ ID NO: 33846 - protein, 32 aa, Diabrotica virgifera
  misc_feature: Coding regions on vcDNA: vcDNA=SeqID_13543; Strand=+; Position=1-96
RVTRELSDQLGIRSICRLVHCCCQSLGQFSEG

SEQ ID NO: 33847 - protein, 80 aa, Diabrotica virgifera
  misc_feature: Coding regions on vcDNA: vcDNA=SeqID_13544; Strand=-; Position=3-242
  misc_feature (7)..(18): Xaa can be any naturally occurring amino acid
  misc_feature (36)..(43): Xaa can be any naturally occurring amino acid
  misc_feature (57)..(77): Xaa can be any naturally occurring amino acid
LIFRNLXXXXXXXXXXXXLCPLHSVTGNIEYNILYXXXXXXXXSSTNSANIYYSLIXXXXXXXXXXXXXXXXXXXXXGRV

SEQ ID NO: 33848 - protein, 21 aa, Diabrotica virgifera
  misc_feature: Coding regions on vcDNA: vcDNA=SeqID_13545; Strand=-; Position=3-65
SLKLLQVVKLRTIPRRPSNSR

SEQ ID NO: 33849 - protein, 18 aa, Diabrotica virgifera
  misc_feature: Coding regions on vcDNA: vcDNA=SeqID_13546; Strand=-; Position=1-54
  misc_feature (6)..(17): Xaa can be any naturally occurring amino acid
YPSCAXXXXXXXXXXXXS

SEQ ID NO: 33850 - protein, 74 aa, Diabrotica virgifera
  misc_feature: Coding regions on vcDNA: vcDNA=SeqID_13547; Strand=+; Position=5-226
CCIRMHLRIIRSPIYRISPYVTPIEHVTFMTSVQDDVYWRLLTFAVMLDMAHYAEHDMLMDHQFLLSLNLSILV

SEQ ID NO: 33851 - protein, 48 aa, Diabrotica virgifera
  misc_feature: Coding regions on vcDNA: vcDNA=SeqID_13548; Strand=-; Position=111-257
  misc_feature (17)..(31): Xaa can be any naturally occurring amino acid
FYFYVCWCGVSIFFLVXXXXXXXXXXXXXXXTCTVAELSGYLINSNLP

SEQ ID NO: 33852 - protein, 17 aa, Diabrotica virgifera
  misc_feature: Coding regions on vcDNA: vcDNA=SeqID_13549; Strand=+; Position=2-52
FLSIHLWLGRSFSSARS

SEQ ID NO: 33853 - protein, 89 aa, Diabrotica virgifera
  misc_feature: Coding regions on vcDNA: vcDNA=SeqID_13550; Strand=+; Position=103-369
HRRHFGRERCPNSTYLSYNILLIYSTVTDICYMHSNRSCCFTVAYSTFRESIGSVFTEIPATDVVEAYIKITTAELSTDSTVNLLKSCG

SEQ ID NO: 33854 - protein, 59 aa, Diabrotica virgifera
  misc_feature: Coding regions on vcDNA: vcDNA=SeqID_13551; Strand=+; Position=223-399
  misc_feature (30)..(35): Xaa can be any naturally occurring amino acid
  misc_feature (44)..(44): Xaa can be any naturally occurring amino acid
EAGVDLRRCYVSGRKCISQLKNIINTTENXXXXXXSTAKRVLEXANKMVVEINNGRGNK

SEQ ID NO: 33855 - protein, 135 aa, Diabrotica virgifera
  misc_feature: Coding regions on vcDNA: vcDNA=SeqID_13552; Strand=+; Position=2-406
  misc_feature: Homolog annotation: Hit_ID=AAG35693.1; Match level="QueryCoverage =99%, HitCoverage=36%, E-value=8e-32, Identity=47%"; Hit description =endopolygalacturonase [Sitophilus oryzae]
  misc_feature: Gene Ontology Annotation: Molecular function=polygalacturonase activity; Cellular component=extracellular; Biological process =pseudohyphal growth
WIKGDGITIQGTESHLLNGRGELWWDGHGDHSNKKKPQFMLIQATGNSLLKDIKVKNCPHTCIGISDSHDITLQHWTIDCQDGDTKGGANTDGFDIAKSYKVTIKDTTVRNQDDCICVNQGQHLVFQNMHCIGGH

SEQ ID NO: 33856 - protein, 64 aa, Diabrotica virgifera
  misc_feature: Coding regions on vcDNA: vcDNA=SeqID_13553; Strand=-; Position=146-340
PILETKKLGYKTSILIKKLKYLIDKKNIIPTVYLCIQTLALFKVTVNTPKIILQKSRSLDDNFI

SEQ ID NO: 33857 - protein, 104 aa, Diabrotica virgifera
  misc_feature: Coding regions on vcDNA: vcDNA=SeqID_13554; Strand=-; Position=0-311
KRDHSQLSLSPSRLPLQFFTLTLGLGQIHSLTLGPQLLCRNIFFLVDSVLESLFPELLESQSKEKASTGYKSSFVTRVANFSFVTIKRGAIDDGNPMSLTHYCV

SEQ ID NO: 33858 - protein, 97 aa, Diabrotica virgifera
  misc_feature: Coding regions on vcDNA: vcDNA=SeqID_13555; Strand=+; Position=102-395
  misc_feature (1)..(21): Xaa can be any naturally occurring amino acid
XXXXXXXXXXXXXXXXXXXXXTTQKNKNGTSPYILQHTSPVQSPKYPSQAVTKHHLTGQNPTTTHLKHPAPHPPYASWKKPPLGPTPRFPPQNPPPI

SEQ ID NO: 33859 - protein, 133 aa, Diabrotica virgifera
  misc_feature: Coding regions on vcDNA: vcDNA=SeqID_13556; Strand=+; Position=2-400
  misc_feature: Homolog annotation: Hit_ID=CAF94542.1; Match level="QueryCoverage =96%, HitCoverage=18%, E-value=3e-20, Identity=39%"; Hit description =unnamed protein product [Tetraodon nigroviridis]
  misc_feature (47)..(53): Xaa can be any naturally occurring amino acid
PTRPGVPKIHKANIPLRPICSTISSPCSELSKFLLNIIKPFANNDDXXXXXXXHFVNKLSTIEFNPNNILVSFDINSLFTNVPFDKTLNIIKTKLENDDTLTTRTKLNVSAIMELLTLCTNNTYFQLNNEFYK

SEQ ID NO: 33860 - protein, 46 aa, Diabrotica virgifera
  misc_feature: Coding regions on vcDNA: vcDNA=SeqID_13557; Strand=+; Position=1-141
EFRFISLIIMASHGKAETEKLKQNLENQLDRLVEQLQDLENCKLKF

SEQ ID NO: 33861 - protein, 52 aa, Diabrotica virgifera
  misc_feature: Coding regions on vcDNA: vcDNA=SeqID_13558; Strand=+; Position=143-301
  misc_feature (1)..(11): Xaa can be any naturally occurring amino acid
  misc_feature (28)..(36): Xaa can be any naturally occurring amino acid
XXXXXXXXXXXTHIVSYLLTQCITKSVXXXXXXXXXWVVHKIENATRLLSHC

SEQ ID NO: 33862 - protein, 125 aa, Diabrotica virgifera
  misc_feature: Coding regions on vcDNA: vcDNA=SeqID_13559; Strand=+; Position=13-387
  misc_feature: Homolog annotation: Hit_ID=BAC10547.1; Match level="QueryCoverage =65%, HitCoverage=18%, E-value=1e-13, Identity=47%"; Hit description =acid phosphatase [Drosophila virilis]
  misc_feature: Gene Ontology Annotation: Molecular function=acid phosphatase activity; Cellular component=integral to membrane; Biological process=regulation of cell cycle
MCLVKAIVITCILLIKLDGSDSIQEVNQFDDGGSNILVAVVQIYRHGIRTPYSFYKNDPHFNLSIWEGLGAKQLMNEGKRQHYSLGQFTRQRYADFLPERYDKDVITAYTTDSDRTHMSGQCNLY

SEQ ID NO: 33863 - protein, 39 aa, Diabrotica virgifera
  misc_feature: Coding regions on vcDNA: vcDNA=SeqID_13560; Strand=-; Position=134-253
LKHYLLKATIQFKRKSTYQAIVNLVLKQVHKYMSQLKQC

SEQ ID NO: 33864 - protein, 77 aa, Diabrotica virgifera
  misc_feature: Coding regions on vcDNA: vcDNA=SeqID_13561; Strand=-; Position=115-348
  misc_feature (38)..(49): Xaa can be any naturally occurring amino acid
TRLKIINPLIYALDSTRACPSTCEVGICIKGYKYLNRXXXXXXXXXXXXHLYLFLLPRLCRHCKMIFIYLITCSGNH

SEQ ID NO: 33865 - protein, 107 aa, Diabrotica virgifera
  misc_feature: Coding regions on vcDNA: vcDNA=SeqID_13562; Strand=+; Position=3-326
  misc_feature (2)..(9): Xaa can be any naturally occurring amino acid
  misc_feature (30)..(30): Xaa can be any naturally occurring amino acid
PXXXXXXXXQQPYSSAPGAPPGGHGHQGSXGPYGGFSYTQHSAPQSYAAPRRTQAYSSVLVREADKALDDATRIFKNCKDYTVVKTDQCVRSGNRQIDKIVKSVRHK

SEQ ID NO: 33866 - protein, 87 aa, Diabrotica virgifera
  misc_feature: Coding regions on vcDNA: vcDNA=SeqID_13563; Strand=+; Position=83-346
KFIKANERGITKLNIEIFNNSTVPLTRLSIYQKLKKTSAILLKCLFYSILFMYILFYINILCYLSSFTLYLHKELKVTIKRSVLLLR

SEQ ID NO: 33867 - protein, 94 aa, Diabrotica virgifera
  misc_feature: Coding regions on vcDNA: vcDNA=SeqID_13564; Strand=+; Position=1-285
  misc_feature: Pfam annotation: Pfam_ID=SapB_1; Match level="Score=28.1, E-value =2.6e-05, Copies=1"; Pfam description=Saposin-like type B, region 1
ALAILVCVGLTVSAQKNDFLCDTCVGIVKVVQDYVRKEIPLEEVEKEVKELCQVLPGELEKLCEDKLIPAIDQMYNQMEDTPPRDLCVELEFCN

SEQ ID NO: 33868 - protein, 61 aa, Diabrotica virgifera
  misc_feature: Coding regions on vcDNA: vcDNA=SeqID_13565; Strand=-; Position=0-182
RYVSMYTENCFTRLNYCMEHLVIVKYLRKTNCIKNSGHLPHKPQKIDYPNLKLDSKSDAWV

SEQ ID NO: 33869 - protein, 61 aa, Diabrotica virgifera
  misc_feature: Coding regions on vcDNA: vcDNA=SeqID_13566; Strand=-; Position=58-243
LFIYFAGILICWCVANIFSICIFVLQTLDYILYLLFLIFGLFGKTGTHHKAQSVHNISFYT

SEQ ID NO: 33870 - protein, 65 aa, Diabrotica virgifera
  misc_feature: Coding regions on vcDNA: vcDNA=SeqID_13567; Strand=+; Position=1-198
  misc_feature (45)..(52): Xaa can be any naturally occurring amino acid
NPFKVYSAVIKIMCNIVLNNYTKNKTAIKVINFQESIKRKIMLRXXXXXXXXLSTLNPKTAHQTM

SEQ ID NO: 33871 - protein, 129 aa, Diabrotica virgifera
  misc_feature: Coding regions on vcDNA: vcDNA=SeqID_13568; Strand=-; Position=0-386
  misc_feature (1)..(125): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAWV

SEQ ID NO: 33872 - protein, 32 aa, Diabrotica virgifera
  misc_feature: Coding regions on vcDNA: vcDNA=SeqID_13569; Strand=-; Position=2-97
LALKVVHVSKAHRAALMVTMRAAARMHGIILK

SEQ ID NO: 33873 - protein, 82 aa, Diabrotica virgifera
  misc_feature: Coding regions on vcDNA: vcDNA=SeqID_13570; Strand=+; Position=1-246
  misc_feature (3)..(13): Xaa can be any naturally occurring amino acid
  misc_feature (16)..(57): Xaa can be any naturally occurring amino acid
  misc_feature (59)..(76): Xaa can be any naturally occurring amino acid
PGXXXXXXXXXXXNFXXXXXXXXXXXXXXXXXXXXXXXXXXXXXXXXXXXXXXXXXXHXXXXXXXXXXXXXXXXXXPLKIIF

SEQ ID NO: 33874 - protein, 43 aa, Diabrotica virgifera
  misc_feature: Coding regions on vcDNA: vcDNA=SeqID_13571; Strand=-; Position=2-130
  misc_feature (11)..(17): Xaa can be any naturally occurring amino acid
WRLVLTIRPNXXXXXXXQFQLSAGKVMLTCFFNHEEPLPGRCG

SEQ ID NO: 33875 - protein, 69 aa, Diabrotica virgifera
  misc_feature: Coding regions on vcDNA: vcDNA=SeqID_13572; Strand=-; Position=91-300
  misc_feature (1)..(16): Xaa can be any naturally occurring amino acid
  misc_feature (26)..(34): Xaa can be any naturally occurring amino acid
  misc_feature (37)..(44): Xaa can be any naturally occurring amino acid
XXXXXXXXXXXXXXXXYIVIFLFDMXXXXXXXXXKFXXXXXXXXFLNHGHINLEQPVYNKLLYLILRSD

SEQ ID NO: 33876 - protein, 98 aa, Diabrotica virgifera
  misc_feature: Coding regions on vcDNA: vcDNA=SeqID_13573; Strand=-; Position=0-293
  misc_feature (71)..(77): Xaa can be any naturally occurring amino acid
  misc_feature (85)..(96): Xaa can be any naturally occurring amino acid
FYLTDNKKTQQMASLTQNMKKWRLPPLILHPSYITGVYIGKKICNLIHIPMLEILFRKLVHIKYGKYFCLXXXXXXXMAINKKPXXXXXXXXXXXXVV

SEQ ID NO: 33877 - protein, 57 aa, Diabrotica virgifera
  misc_feature: Coding regions on vcDNA: vcDNA=SeqID_13574; Strand=+; Position=157-330
  misc_feature (8)..(15): Xaa can be any naturally occurring amino acid
  misc_feature (33)..(43): Xaa can be any naturally occurring amino acid
MVCNIFLXXXXXXXXQVALYFTSYLFRLKNLCXXXXXXXXXXXPVLTSSDEEEQIIT

SEQ ID NO: 33878 - protein, 101 aa, Diabrotica virgifera
  misc_feature: Coding regions on vcDNA: vcDNA=SeqID_13575; Strand=+; Position=113-415
  misc_feature (28)..(35): Xaa can be any naturally occurring amino acid
  misc_feature (84)..(90): Xaa can be any naturally occurring amino acid
KRTGRVFYHKLDVEFKNGFSSKYLSGVXXXXXXXXRPLPVGAPMMNTRFLIVCRRMRSGCILELAKFHFRGSTGLGAMNKLAVXXXXXXXPYLGNKAFVDI

SEQ ID NO: 33879 - protein, 104 aa, Diabrotica virgifera
  misc_feature: Coding regions on vcDNA: vcDNA=SeqID_13576; Strand=+; Position=91-402
  misc_feature: Homolog annotation: Hit_ID=XP_321784.1; Match level="QueryCoverage =98%, HitCoverage=16%, E-value=2e-19, Identity=46%"; Hit description =ENSANGP00000009742 [Anopheles gambiae] gb|EAA01086.1| ENSANGP00000009742 [Anopheles gambiae
MESRIAKVIMTDLKNISNSITVCVEDAPILKMCFTADHQAVWVSTSDSSIRCWKLPTEKHFKEEVRMPTNPLSLIQGGAAIKQAVVLNDKRHILTKDAQDNVAI

SEQ ID NO: 33880 - protein, 88 aa, Diabrotica virgifera
  misc_feature: Coding regions on vcDNA: vcDNA=SeqID_13577; Strand=+; Position=1-267
  misc_feature (53)..(58): Xaa can be any naturally occurring amino acid
KFTLFLLAAVFVAVLATKEVSSIDAKVVDVAAAFKDDEPTEAPITDAPAACDXXXXXXHCTDESILDPTKNYDGGVCVDNKCHCVEIV

SEQ ID NO: 33881 - protein, 85 aa, Diabrotica virgifera
  misc_feature: Coding regions on vcDNA: vcDNA=SeqID_13578; Strand=+; Position=137-391
  misc_feature (33)..(43): Xaa can be any naturally occurring amino acid
VCRACEFLEFLIQMEGIMFFYISFRFLHIVLLXXXXXXXXXXXMVLFNALYIALCCLNFLPSSIKSNISSVIHPCFHGRCFVSIS

SEQ ID NO: 33882 - protein, 65 aa, Diabrotica virgifera
  misc_feature: Coding regions on vcDNA: vcDNA=SeqID_13579; Strand=+; Position=100-292
  misc_feature (23)..(23): Xaa can be any naturally occurring amino acid
QCRDWKNPDINHLKHHAAHRPFXATRHVTEDAGNDSPSQHLPSMNIEWHDPCSGSIKYCRSGGDR

SEQ ID NO: 33883 - protein, 73 aa, Diabrotica virgifera
  misc_feature: Coding regions on vcDNA: vcDNA=SeqID_13580; Strand=+; Position=3-221
LECNSKPLQKGPQIQFNGPPFKNSLMGKTRGLPQVTPFKKNPPFKTWLNTKKPPTNPPPKHLPTQNGKWNAPF

SEQ ID NO: 33884 - protein, 73 aa, Diabrotica virgifera
  misc_feature: Coding regions on vcDNA: vcDNA=SeqID_13581; Strand=-; Position=1-219
SPVQGPKISVIHISFKLCVCIPCDMSDKLFLCEIFQSCYVFERLVLKDVTFTLLSLNTSLVYLNTIMVTEEMF

SEQ ID NO: 33885 - protein, 35 aa, Diabrotica virgifera
  misc_feature: Coding regions on vcDNA: vcDNA=SeqID_13582; Strand=+; Position=1-105
  misc_feature (1)..(22): Xaa can be any naturally occurring amino acid
XXXXXXXXXXXXXXXXXXXXXXIFLSVVLYDLSYV

SEQ ID NO: 33886 - protein, 132 aa, Diabrotica virgifera
  misc_feature: Coding regions on vcDNA: vcDNA=SeqID_13583; Strand=-; Position=2-397
  misc_feature (24)..(37): Xaa can be any naturally occurring amino acid
ISSSPDFLINSPQKQTLTLTTLSXXXXXXXXXXXXXXQSFRKCAKSLCHKLTITPVLIRLLNAETTFSHLTLCFSLLSSPIPTCLLKIICLKCLKCPTCVCSFLIVPIGKVRFFITLLQVLICFVKRFTQIS

SEQ ID NO: 33887 - protein, 68 aa, Diabrotica virgifera
  misc_feature: Coding regions on vcDNA: vcDNA=SeqID_13584; Strand=-; Position=164-370
  misc_feature (3)..(9): Xaa can be any naturally occurring amino acid
NTXXXXXXXRDIHELIHLAPMNCYTRMSFLRGEYISQAGLNKIACLQPQYILQHNVFKLFSCKKIIGD

SEQ ID NO: 33888 - protein, 142 aa, Diabrotica virgifera
  misc_feature: Coding regions on vcDNA: vcDNA=SeqID_13585; Strand=+; Position=1-426
  misc_feature (133)..(133): Xaa can be any naturally occurring amino acid
EQHKDIEQHAFNIKREVDSVDDFEHLGHDSSPLQDLLGLQQDKEVTAPETVHEINNTPKTAVSHQAGASKLLHSLQNPLIPEKMNRNLLEDDFLDRGEGKEKLDQFLQDAAIPPATSVFDHGNNKLFSANLIXAEKFNEPEK

SEQ ID NO: 33889 - protein, 63 aa, Diabrotica virgifera
  misc_feature: Coding regions on vcDNA: vcDNA=SeqID_13586; Strand=+; Position=56-244
  misc_feature (35)..(41): Xaa can be any naturally occurring amino acid
FTFTLESFIFCSLCFMDYLLYIRCLIFSSLWVLKXXXXXXXVNILHNFYVLSCYSFGSIPSFL

SEQ ID NO: 33890 - protein, 53 aa, Diabrotica virgifera
  misc_feature: Coding regions on vcDNA: vcDNA=SeqID_13587; Strand=+; Position=18-179
  misc_feature (18)..(29): Xaa can be any naturally occurring amino acid
MGRGHSGRCIDSSLILIXXXXXXXXXXXXHQVMTYALFHSNTLNFHFFKDHIQ

SEQ ID NO: 33891 - protein, 36 aa, Diabrotica virgifera
  misc_feature: Coding regions on vcDNA: vcDNA=SeqID_13588; Strand=+; Position=2-109
FACMRLHIPSMVSRGFTSMAVALNRRDMGNPWTYPT

SEQ ID NO: 33892 - protein, 68 aa, Diabrotica virgifera
  misc_feature: Coding regions on vcDNA: vcDNA=SeqID_13589; Strand=-; Position=156-362
TMQHEDSAKIERKWQNILSSTAKSVFIDVLFNYLLNCIKTICIIKYFPLHKKAKRSCHSGRAIHAGSS

SEQ ID NO: 33893 - protein, 134 aa, Diabrotica virgifera
  misc_feature: Coding regions on vcDNA: vcDNA=SeqID_13590; Strand=+; Position=3-405
  misc_feature: Homolog annotation: Hit_ID=CAE47497.1; Match level="QueryCoverage =99%, HitCoverage=41%, E-value=7e-23, Identity=47%"; Hit description =cathepsin L-like proteinase [Diabrotica virgifera virgifera]
  misc_feature (18)..(18): Xaa can be any naturally occurring amino acid
  misc_feature (63)..(63): Xaa can be any naturally occurring amino acid
LINADAHIVAANANLSAXNTGSIFNAPQHDSYHVIDEQLRFGVFQEKLRKIKYHLTIYELCEXTYYLSVNQVADWSTTHLIAMLDSQMAQRLTLLVADTFDADLYIQGPTEVDWMRWKADLAVRIHGICGSCWA

SEQ ID NO: 33894 - protein, 94 aa, Diabrotica virgifera
  misc_feature: Coding regions on vcDNA: vcDNA=SeqID_13591; Strand=+; Position=35-319
YHHIIRVAMQCSLLLKIVLFVLIFDLLSMCSNTRLNKFVVSASPCFKPLFTVNYLNLRMTKGGKFGLQCMFYLIKSEIFSILNSLFFYLTLISF

SEQ ID NO: 33895 - protein, 37 aa, Diabrotica virgifera
  misc_feature: Coding regions on vcDNA: vcDNA=SeqID_13592; Strand=-; Position=221-334
  misc_feature (13)..(19): Xaa can be any naturally occurring amino acid
SHFIKIGYIHRCXXXXXXXVKLIIREYESSGAILLLD

SEQ ID NO: 33896 - protein, 56 aa, Diabrotica virgifera
  misc_feature: Coding regions on vcDNA: vcDNA=SeqID_13593; Strand=-; Position=2-172
  misc_feature (27)..(34): Xaa can be any naturally occurring amino acid
  misc_feature (41)..(50): Xaa can be any naturally occurring amino acid
CRRIPMLNVHTQTEHTVSVTTHMIILXXXXXXXXLMLLKLXXXXXXXXXXINYYQA

SEQ ID NO: 33897 - protein, 47 aa, Diabrotica virgifera
  misc_feature: Coding regions on vcDNA: vcDNA=SeqID_13594; Strand=+; Position=229-369
RSKLPLSCTKLLFDFTNTSFIQTSYTIYFSTIHLSLTICTSTNTYYF

SEQ ID NO: 33898 - protein, 52 aa, Diabrotica virgifera
  misc_feature: Coding regions on vcDNA: vcDNA=SeqID_13595; Strand=+; Position=91-246
  misc_feature (37)..(45): Xaa can be any naturally occurring amino acid
KRLKCSTMIHCKYMIKNLYISDDFILILFDNLEFMFXXXXXXXXXLNFIFLY

SEQ ID NO: 33899 - protein, 73 aa, Diabrotica virgifera
  misc_feature: Coding regions on vcDNA: vcDNA=SeqID_13596; Strand=-; Position=110-331
IINKPRIPGVNTLSVKIIASPQKWDISNVSYILNLLFDSSAFFLICHSFIPQEYRCNNIADEQTSVIAYRVQQ

SEQ ID NO: 33900 - protein, 60 aa, Diabrotica virgifera
  misc_feature: Coding regions on vcDNA: vcDNA=SeqID_13597; Strand=+; Position=175-357
TCLFWNQCIFPETLANVKYKSMIPQKGLFPFPIALPINLFFLNFLFSISYTFQMSIFFFW

SEQ ID NO: 33901 - protein, 44 aa, Diabrotica virgifera
  misc_feature: Coding regions on vcDNA: vcDNA=SeqID_13598; Strand=-; Position=1-132
STFYFKYLNEIFKYIFTKKTVTICFSTFCFNCLVYENYTQMKFI

SEQ ID NO: 33902 - protein, 44 aa, Diabrotica virgifera
  misc_feature: Coding regions on vcDNA: vcDNA=SeqID_13599; Strand=-; Position=138-272
TYRTYYENSDSTLRLMNCDTVSRVKIISSDYQHVSYSIHLRVYN

SEQ ID NO: 33903 - protein, 110 aa, Diabrotica virgifera
  misc_feature: Coding regions on vcDNA: vcDNA=SeqID_13600; Strand=-; Position=3-332
  misc_feature (9)..(22): Xaa can be any naturally occurring amino acid
  misc_feature (29)..(50): Xaa can be any naturally occurring amino acid
  misc_feature (53)..(64): Xaa can be any naturally occurring amino acid
  misc_feature (70)..(83): Xaa can be any naturally occurring amino acid
  misc_feature (90)..(108): Xaa can be any naturally occurring amino acid
NYLLLIILXXXXXXXXXXXXXXFKTDYHXXXXXXXXXXXXXXXXXXXXXXNLXXXXXXXXXXXXLFPRVXXXXXXXXXXXXXXPFLFTFXXXXXXXXXXXXXXXXXXXLN

SEQ ID NO: 33904 - protein, 110 aa, Diabrotica virgifera
  misc_feature: Coding regions on vcDNA: vcDNA=SeqID_13601; Strand=+; Position=1-333
AHMRDIHPCKNEPIDEFSEPEDLMEGITMVVDTNEPEPYEDDSKAWYREEEIHQTEEDLKELESGNDHICHLCNQPFPLRAILLQHLVTCRATTGNTESAPLAVVNKIII

SEQ ID NO: 33905 - protein, 29 aa, Diabrotica virgifera
  misc_feature: Coding regions on vcDNA: vcDNA=SeqID_13602; Strand=-; Position=2-88
  misc_feature (5)..(11): Xaa can be any naturally occurring amino acid
CTYNXXXXXXXQLFKKEVFYIITKSKYLN

SEQ ID NO: 33906 - protein, 47 aa, Diabrotica virgifera
  misc_feature: Coding regions on vcDNA: vcDNA=SeqID_13603; Strand=-; Position=241-384
  misc_feature (2)..(2): Xaa can be any naturally occurring amino acid
VXTYHSKIKQNNSSVNLKERIRIKIQSKCCRTLQRDIDYQTSINKLN

SEQ ID NO: 33907 - protein, 58 aa, Diabrotica virgifera
  misc_feature: Coding regions on vcDNA: vcDNA=SeqID_13604; Strand=-; Position=79-255
PYDRQVYHAPYEPSKCLRPHAVDSSILIRSSLEICVITHGRYYLCKCKRCYTKCWPSL

SEQ ID NO: 33908 - protein, 70 aa, Diabrotica virgifera
  misc_feature: Coding regions on vcDNA: vcDNA=SeqID_13605; Strand=-; Position=54-266
  misc_feature (1)..(23): Xaa can be any naturally occurring amino acid
  misc_feature (29)..(39): Xaa can be any naturally occurring amino acid
  misc_feature (50)..(63): Xaa can be any naturally occurring amino acid
XXXXXXXXXXXXXXXXXXXXXXXVNFLGXXXXXXXXXXXIIYNPWHPRYXXXXXXXXXXXXXXPLLLTDH

SEQ ID NO: 33909 - protein, 64 aa, Diabrotica virgifera
  misc_feature: Coding regions on vcDNA: vcDNA=SeqID_13606; Strand=+; Position=183-374
  misc_feature (39)..(45): Xaa can be any naturally occurring amino acid
FLCCKINFNYVNFKYNMVLLTSYVIHYHYYKICYLFNFXXXXXXXIKLFKCIYLSLISFMYRLF

SEQ ID NO: 33910 - protein, 70 aa, Diabrotica virgifera
  misc_feature: Coding regions on vcDNA: vcDNA=SeqID_13607; Strand=-; Position=67-279
  misc_feature (6)..(13): Xaa can be any naturally occurring amino acid
  misc_feature (16)..(33): Xaa can be any naturally occurring amino acid
  misc_feature (37)..(47): Xaa can be any naturally occurring amino acid
  misc_feature (54)..(67): Xaa can be any naturally occurring amino acid
PKKLYXXXXXXXXTLXXXXXXXXXXXXXXXXXXLNLXXXXXXXXXXXHSRFSSXXXXXXXXXXXXXXSLN

SEQ ID NO: 33911 - protein, 73 aa, Diabrotica virgifera
  misc_feature: Coding regions on vcDNA: vcDNA=SeqID_13608; Strand=+; Position=104-325
WKYQSLECTNWSPGTNFTQIQVPREKVLLSIEPQYTFFIVLVEKGYKYIDKSKTMLQNFLRIFLYNLLCLDIL

SEQ ID NO: 33912 - protein, 73 aa, Diabrotica virgifera
  misc_feature: Coding regions on vcDNA: vcDNA=SeqID_13609; Strand=+; Position=186-404
DELTDPIETGNRIRQGDSLSPLLFNLIMDEIIKKVRTKKGYQMDGSKRIISQNEDDLQRMLHKFNKIARKFNN

SEQ ID NO: 33913 - protein, 61 aa, Diabrotica virgifera
  misc_feature: Coding regions on vcDNA: vcDNA=SeqID_13610; Strand=+; Position=22-207
TRVFRPRGGVTVTPQVGAADDTDSTLKWSVSGAGIRVFMRFGVAPENYTPKRSFIGLLQRR

SEQ ID NO: 33914 - protein, 70 aa, Diabrotica virgifera
  misc_feature: Coding regions on vcDNA: vcDNA=SeqID_13611; Strand=+; Position=25-237
NINNCFACFSKDRFFFAPPLNELPCIKSQYMVEVHLQGTKIPVWAPLPSWDTRFITAVYASVKTYHDMKF

SEQ ID NO: 33915 - protein, 88 aa, Diabrotica virgifera
  misc_feature: Coding regions on vcDNA: vcDNA=SeqID_13612; Strand=-; Position=1-264
  misc_feature (55)..(69): Xaa can be any naturally occurring amino acid
KLTVNCLKNASMHASTNFSKTGAKFRGLHKYSKSMVRLNGQKSMFSCEIIFCHSXXXXXXXXXXXXXXXKYIKFHSNLESVFWESHRI

SEQ ID NO: 33916 - protein, 56 aa, Diabrotica virgifera
  misc_feature: Coding regions on vcDNA: vcDNA=SeqID_13613; Strand=-; Position=2-169
  misc_feature (15)..(34): Xaa can be any naturally occurring amino acid
  misc_feature (40)..(51): Xaa can be any naturally occurring amino acid
NFGLFIKPDIPFHYXXXXXXXXXXXXXXXXXXXXVLFNSXXXXXXXXXXXXFLCYL

SEQ ID NO: 33917 - protein, 102 aa, Diabrotica virgifera
  misc_feature: Coding regions on vcDNA: vcDNA=SeqID_13614; Strand=+; Position=1-309
SIFKKLTNVLDRIAEDSTAAGKKLAKCFEDSNINSVPVLFVNLTLSCIEDDVIKVAESLGPLVKQLAEVQKKAKAATENIDECGDNITDIGCVLKHFVTCYL

SEQ ID NO: 33918 - protein, 46 aa, Diabrotica virgifera
  misc_feature: Coding regions on vcDNA: vcDNA=SeqID_13615; Strand=+; Position=149-289
HKQTDTNAVLTCILSSSYLFSKCFTLLGLLFYIKPKSKAWMLFCGC

SEQ ID NO: 33919 - protein, 55 aa, Diabrotica virgifera
  misc_feature: Coding regions on vcDNA: vcDNA=SeqID_13616; Strand=-; Position=1-165
  misc_feature (22)..(55): Xaa can be any naturally occurring amino acid
LRRYKYCGQSSSKFENNRYISXXXXXXXXXXXXXXXXXXXXXXXXXXXXXXXXXX

SEQ ID NO: 33920 - protein, 46 aa, Diabrotica virgifera
  misc_feature: Coding regions on vcDNA: vcDNA=SeqID_13617; Strand=-; Position=0-137
DASYPSSIFRLTYDARSVADLIDTFSAWSVKIVKIKLSNHRTELKV

SEQ ID NO: 33921 - protein, 71 aa, Diabrotica virgifera
  misc_feature: Coding regions on vcDNA: vcDNA=SeqID_13618; Strand=+; Position=1-216
RLRPLNANNHIVIERAQLPQLSQYNTMYVFMNLNMYNVCSLCPAERFTYCTYDIGNKILKSTIIVLTRIHI

SEQ ID NO: 33922 - protein, 137 aa, Diabrotica virgifera
  misc_feature: Coding regions on vcDNA: vcDNA=SeqID_13619; Strand=+; Position=3-413
  misc_feature: Homolog annotation: Hit_ID=XP_319210.1; Match level="QueryCoverage =100%, HitCoverage=22%, E-value=1e-47, Identity=62%"; Hit description= ENSANGP00000019251 [Anopheles gambiae]
  misc_feature: Gene Ontology Annotation: Molecular function=beta-N -acetylhexosaminidase activity; Cellular component=extracellular space
  misc_feature: Pfam annotation: Pfam_ID=Glyco_hydro_20; Match level="Score=-58.7, E -value=7.9e-08, Copies=1"; Pfam description=Glycosyl hydrolase family 20, catalyti
  misc_feature (36)..(36): Xaa can be any naturally occurring amino acid
  misc_feature (83)..(83): Xaa can be any naturally occurring amino acid
  misc_feature (134)..(134): Xaa can be any naturally occurring amino acid
VFHWHIVDDQSFPYVSRKFPELSLKGAYTSYYTYSXKDIQNITEYARVRGIRVIPEFDTPGHTRSWGVAHPEILTACEGDLKXKYGPIDPTQNKTYTFLDDFFEEISNTFADAYIHLGGDEVEFECWSSSTIIXNFM

SEQ ID NO: 33923 - protein, 53 aa, Diabrotica virgifera
  misc_feature: Coding regions on vcDNA: vcDNA=SeqID_13620; Strand=-; Position=102-263
  misc_feature (10)..(15): Xaa can be any naturally occurring amino acid
  misc_feature (33)..(39): Xaa can be any naturally occurring amino acid
TYFKSFHSTXXXXXXDYKSSNKIANLTAKMISXXXXXXXPMNHSWLHMNINII

SEQ ID NO: 33924 - protein, 20 aa, Diabrotica virgifera
  misc_feature: Coding regions on vcDNA: vcDNA=SeqID_13621; Strand=-; Position=1-60
  misc_feature (5)..(18): Xaa can be any naturally occurring amino acid
FCASXXXXXXXXXXXXXXDS

SEQ ID NO: 33925 - protein, 82 aa, Diabrotica virgifera
  misc_feature: Coding regions on vcDNA: vcDNA=SeqID_13622; Strand=-; Position=0-245
  misc_feature (6)..(43): Xaa can be any naturally occurring amino acid
  misc_feature (46)..(78): Xaa can be any naturally occurring amino acid
PILKSXXXXXXXXXXXXXXXXXXXXXXXXXXXXXXXXXXXXXXLMXXXXXXXXXXXXXXXXXXXXXXXXXXXXXXXXXPRVL

SEQ ID NO: 33926 - protein, 51 aa, Diabrotica virgifera
  misc_feature: Coding regions on vcDNA: vcDNA=SeqID_13623; Strand=-; Position=154-309
THSIRILSDTVMILHRSFQITNTLSACAVYWKHVLSNVVTLSGVHPIELHH

SEQ ID NO: 33927 - protein, 106 aa, Diabrotica virgifera
  misc_feature: Coding regions on vcDNA: vcDNA=SeqID_13624; Strand=+; Position=62-379
  misc_feature: Homolog annotation: Hit_ID=AAH44001.1; Match level="QueryCoverage =94%, HitCoverage=22%, E-value=3e-14, Identity=44%"; Hit description =MGC53359 protein [Xenopus laevis]
  misc_feature: Gene Ontology Annotation: Molecular function=GTP binding; Cellular component=microtubule; Biological process=microtubule-based process
  misc_feature (43)..(43): Xaa can be any naturally occurring amino acid
  misc_feature (62)..(72): Xaa can be any naturally occurring amino acid
CSSSNSRDCISVYVGLDVVQIGIDCCDLCCQLYGIQHDSHIEXHMTVGRRDDSCNTFFSAFXXXXXXXXXXXVALVVALVPAVLNGIYRRMFHPLYLITGLINGTN

SEQ ID NO: 33928 - protein, 64 aa, Diabrotica virgifera
  misc_feature: Coding regions on vcDNA: vcDNA=SeqID_13625; Strand=+; Position=93-287
  misc_feature (1)..(7): Xaa can be any naturally occurring amino acid
XXXXXXXDVNCPIIAVFLFLNISKQNRTTHSHKNVDITVSQNVLHIYVCILYMPLAYLVYGISY

SEQ ID NO: 33929 - protein, 126 aa, Diabrotica virgifera
  misc_feature: Coding regions on vcDNA: vcDNA=SeqID_13626; Strand=+; Position=22-402
  misc_feature: Homolog annotation: Hit_ID=NP_523934.1; Match level="QueryCoverage =92%, HitCoverage=17%, E-value=1e-10, Identity=31%"; Hit description =CG10642-PA [Drosophila melanogaster] gb|AAF50786.1| CG10642-PA [Drosophila melanogaster]
  misc_feature (89)..(95): Xaa can be any naturally occurring amino acid
  misc_feature (103)..(110): Xaa can be any naturally occurring amino acid
MLLEAREEKLEKKEKKRTKSAVHNNELEDIESEKSTLQNRINIIQKKILVGGENLVEKAQQQMELLEHVDKELQHLDTSHSILKEILLXXXXXXXIVKKEYAXXXXXXXXLDSKLEEVDKLISKAV

SEQ ID NO: 33930 - protein, 76 aa, Diabrotica virgifera
  misc_feature: Coding regions on vcDNA: vcDNA=SeqID_13627; Strand=+; Position=1-228
HGRGSQLVYGCLRLQISAKFLLRVPSLAFHGPPFFQCKPGSFPTFLTFNPLSFSPLCALGLIPLPGLPLLSFPSLC

SEQ ID NO: 33931 - protein, 56 aa, Diabrotica virgifera
  misc_feature: Coding regions on vcDNA: vcDNA=SeqID_13628; Strand=+; Position=1-171
  misc_feature (26)..(26): Xaa can be any naturally occurring amino acid
NVSFSDYRLADSLVGDFSRHYYHAKXHLSGNVAELQKMTAEHGAHVEWLFDNKLQN

SEQ ID NO: 33932 - protein, 127 aa, Diabrotica virgifera
  misc_feature: Coding regions on vcDNA: vcDNA=SeqID_13629; Strand=+; Position=1-381
  misc_feature: Homolog annotation: Hit_ID=AAA51822.1; Match level="QueryCoverage =90%, HitCoverage=19%, E-value=9e-15, Identity=38%"; Hit description =beta-galactosidase precursor (EC 3.2.1.23)
  misc_feature: Gene Ontology Annotation: Molecular function=beta-galactosidase activity; Cellular component=lysosome
RTRGFGFWKLYNSTLSLGNKELQNATLDLVVENFGRCGYGALDQFQQYKGLTDDVFVNGNKLTDWTIIPLEFKTSWNKNLGNWKAVGNTTNTPALYKFSLNIPEEPQDTFVSLRTWVKGITIVNGFV

SEQ ID NO: 33933 - protein, 59 aa, Diabrotica virgifera
  misc_feature: Coding regions on vcDNA: vcDNA=SeqID_13630; Strand=-; Position=4-183
  misc_feature (7)..(14): Xaa can be any naturally occurring amino acid
LIFREAXXXXXXXXQSNISNNTLDPNVKYSESVIAIILPVYSQNYNSNRFFQKKPKMCS

SEQ ID NO: 33934 - protein, 19 aa, Diabrotica virgifera
  misc_feature: Coding regions on vcDNA: vcDNA=SeqID_13631; Strand=-; Position=0-56
  misc_feature (2)..(15): Xaa can be any naturally occurring amino acid
SXXXXXXXXXXXXXXAACV

SEQ ID NO: 33935 - protein, 134 aa, Diabrotica virgifera
  misc_feature: Coding regions on vcDNA: vcDNA=SeqID_13632; Strand=+; Position=2-403
  misc_feature: Homolog annotation: Hit_ID=CAF90243.1; Match level="QueryCoverage =100%, HitCoverage=83%, E-value=3e-27, Identity=41%"; Hit description= unnamed protein product [Tetraodon nigroviridis]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=89.9, E-value =6.7e-24, Copies=4"; Pfam description=Zinc finger, C2H2 type
HRPSLNMHMTTHTGVKPCFACEICNKQYLTNASLTRHMRVKRHLTVNRDVNTEEKHFECQICFKKLTTRFNLKIHMRLHTGEKPFGCQICTKQFSTKQILKSHMRVHTGERPVKCEICAKQFSTNPQLTRHMKV

SEQ ID NO: 33936 - protein, 71 aa, Diabrotica virgifera
  misc_feature: Coding regions on vcDNA: vcDNA=SeqID_13633; Strand=+; Position=77-289
  misc_feature: Homolog annotation: Hit_ID=XP_315271.1; Match level="QueryCoverage =100%, HitCoverage=26%, E-value=2e-23, Identity=74%"; Hit description= ENSANGP00000022307 [Anopheles gambiae]
  misc_feature: Gene Ontology Annotation: Biological process=reproduction
PLIMCDQDVGALLVDNGCGMCKAGFAGDDAPRAVFASLVGRTGHQGVMGGMGHIDSWVGEEAQCLSGILTL

SEQ ID NO: 33937 - protein, 109 aa, Diabrotica virgifera
  misc_feature: Coding regions on vcDNA: vcDNA=SeqID_13634; Strand=+; Position=82-408
  misc_feature: Homolog annotation: Hit_ID=A57694; Match level="QueryCoverage=88%, HitCoverage=42%, E-value=5e-33, Identity=75%"; Hit description =transcription factor IID 30k chain - human
  misc_feature: Gene Ontology Annotation: Molecular function=RNA polymerase II transcription factor activity; Cellular component=transcription factor TFIID complex; Biological process=establishment and/or maintenance of chromatin architecture
  misc_feature: Pfam annotation: Pfam_ID=TFIID_30kDa; Match level="Score=124.0, E -value=3.7e-34, Copies=1"; Pfam description=Transcription initiation factor TFIID
MMIEDNNPTLGQPLSDFLLQLEDYTPTIPDAVTAYYLRSSGLEPKDPRLVRLISIAAQKFISDIANDALQHCKMRSTNSSSHSGSKSKQGTKDRRYCLTMEDLTPALAE

SEQ ID NO: 33938 - protein, 81 aa, Diabrotica virgifera
  misc_feature: Coding regions on vcDNA: vcDNA=SeqID_13635; Strand=+; Position=156-398
  misc_feature (22)..(30): Xaa can be any naturally occurring amino acid
  misc_feature (34)..(40): Xaa can be any naturally occurring amino acid
  misc_feature (75)..(80): Xaa can be any naturally occurring amino acid
MVECSDLQSNSPIIRRLEPQCXXXXXXXXXDCKXXXXXXXPENTYLVKIFGNNYCSEIISLWHFSMCLCVCFILXXXXXXV

SEQ ID NO: 33939 - protein, 18 aa, Diabrotica virgifera
  misc_feature: Coding regions on vcDNA: vcDNA=SeqID_13636; Strand=-; Position=1-54
  misc_feature (6)..(17): Xaa can be any naturally occurring amino acid
QHLFLXXXXXXXXXXXXF

SEQ ID NO: 33940 - protein, 124 aa, Diabrotica virgifera
  misc_feature: Coding regions on vcDNA: vcDNA=SeqID_13637; Strand=+; Position=3-375
  misc_feature: Homolog annotation: Hit_ID=NP_741507.1; Match level="QueryCoverage =95%, HitCoverage=30%, E-value=7e-30, Identity=56%"; Hit description =zn-dependent long chain alcohol dehydrogenase class 3 (41.3 kD) (5B393) [Caenorhabditis elegans]
  misc_feature: Gene Ontology Annotation: Molecular function=alcohol dehydrogenase activity, zinc-dependent; Cellular component=cytoplasm; Biological process=alcohol metabolism
  misc_feature (41)..(41): Xaa can be any naturally occurring amino acid
  misc_feature (65)..(65): Xaa can be any naturally occurring amino acid
  misc_feature (69)..(69): Xaa can be any naturally occurring amino acid
  misc_feature (104)..(104): Xaa can be any naturally occurring amino acid
PRVRDIICKAASAWSRKQDLKIESTDVYPPVAHELRLNVVXTAVSDTDAYTQSCQDPHCLSPMVXGHEXSGIVESVGEGAPVVIPTDHVVPLCVPQCGDSEFSXHSNTNLCQNILITHRHGRMP

SEQ ID NO: 33941 - protein, 52 aa, Diabrotica virgifera
  misc_feature: Coding regions on vcDNA: vcDNA=SeqID_13638; Strand=-; Position=34-192
  misc_feature (43)..(43): Xaa can be any naturally occurring amino acid
VSSYKFEYYMHVLIHYYSMIAHGPLNNRAFIQMIVFSHITKYXPFNENFPYL

SEQ ID NO: 33942 - protein, 60 aa, Diabrotica virgifera
  misc_feature: Coding regions on vcDNA: vcDNA=SeqID_13639; Strand=+; Position=100-282
  misc_feature (10)..(20): Xaa can be any naturally occurring amino acid
IFQLACILYXXXXXXXXXXXVENIYKMIMHTYLLFNSNLVLNHFTIIITNLFLQKERLLI

SEQ ID NO: 33943 - protein, 74 aa, Diabrotica virgifera
  misc_feature: Coding regions on vcDNA: vcDNA=SeqID_13640; Strand=-; Position=9-233
LVIMIVDSKSKLCYKGRVAVKGNHDFTVDFQATLLGISTSPSYFGHIMRNEKYQLLQLILQGKIEGRRGPGRRR

SEQ ID NO: 33944 - protein, 106 aa, Diabrotica virgifera
  misc_feature: Coding regions on vcDNA: vcDNA=SeqID_13641; Strand=+; Position=3-323
  misc_feature: Homolog annotation: Hit_ID=BAB88642.1; Match level="QueryCoverage =96%, HitCoverage=33%, E-value=9e-20, Identity=49%"; Hit description =NADH dehydrogenase subunit 5 [Leptura aethiops]
  misc_feature: Pfam annotation: Pfam_ID=NADH5_C; Match level="Score=-83.8, E-value =0.033, Copies=1"; Pfam description=NADH dehydrogenase subunit 5 C -terminu
  misc_feature (29)..(29): Xaa can be any naturally occurring amino acid
  misc_feature (41)..(48): Xaa can be any naturally occurring amino acid
  misc_feature (57)..(57): Xaa can be any naturally occurring amino acid
  misc_feature (79)..(85): Xaa can be any naturally occurring amino acid
  misc_feature (87)..(87): Xaa can be any naturally occurring amino acid
  misc_feature (105)..(105): Xaa can be any naturally occurring amino acid
QLSETGYLILKGIRGLILFVVFSGRLFSXLVFSTPIFICLXXXXXXXXLIFIIVGVXLGYELAKFKISYNLLRLNNISXXXXXXXIXNIPFLSTLGINYYPIYFXG

SEQ ID NO: 33945 - protein, 96 aa, Diabrotica virgifera
  misc_feature: Coding regions on vcDNA: vcDNA=SeqID_13642; Strand=+; Position=65-352
  misc_feature: Homolog annotation: Hit_ID=XP_319892.1; Match level="QueryCoverage =96%, HitCoverage=76%, E-value=3e-19, Identity=48%"; Hit description =ENSANGP00000010639 [Anopheles gambiae]
  misc_feature: Gene Ontology Annotation: Biological process=positive regulation of growth rate
  misc_feature (30)..(30): Xaa can be any naturally occurring amino acid
  misc_feature (44)..(44): Xaa can be any naturally occurring amino acid
MSASFIHRIILSVRFLSLFHSAYSAAQHRXYLRLNDLDFTHLPXDIFIHALISLFVIMYGVLSIVGKFNEINSTSELENMSCETFREIPSFFTFIH

SEQ ID NO: 33946 - protein, 59 aa, Diabrotica virgifera
  misc_feature: Coding regions on vcDNA: vcDNA=SeqID_13643; Strand=-; Position=86-265
LYDKNKDDDSALTAGHQCITFKTKRNPTVNTLFDLLRNFGYLFFIVILYPNKFNKTMLL

SEQ ID NO: 33947 - protein, 77 aa, Diabrotica virgifera
  misc_feature: Coding regions on vcDNA: vcDNA=SeqID_13644; Strand=+; Position=181-411
  misc_feature: Homolog annotation: Hit_ID=NP_725544.1; Match level="QueryCoverage =94%, HitCoverage=28%, E-value=2e-27, Identity=75%"; Hit description =CG8448-PD, isoform D [Drosophila melanogaster] ref|NP_725543.1| CG8448-PC, isoform C [Drosophila
  misc_feature: Gene Ontology Annotation: Molecular function=co-chaperone activity; Cellular component=cytosol; Biological process=protein folding
  misc_feature: Pfam annotation: Pfam_ID=DnaJ; Match level="Score=112.0, E-value=1.5e- 30, Copies=1"; Pfam description=DnaJ domain
  misc_feature (42)..(49): Xaa can be any naturally occurring amino acid
MVDYYRVLEVPKTATNSEIKKAYRKLALKWHPDKNPDNMDEXXXXXXXXSEAYEVLSDEKKRRVYDEYGKDGLLNGN

SEQ ID NO: 33948 - protein, 132 aa, Diabrotica virgifera
  misc_feature: Coding regions on vcDNA: vcDNA=SeqID_13645; Strand=-; Position=2-397
  misc_feature (1)..(1): Xaa can be any naturally occurring amino acid
  misc_feature (3)..(26): Xaa can be any naturally occurring amino acid
  misc_feature (40)..(53): Xaa can be any naturally occurring amino acid
  misc_feature (56)..(131): Xaa can be any naturally occurring amino acid
XIXXXXXXXXXXXXXXXXXXXXXXXXILKNCILKTITFHXXXXXXXXXXXXXXLFXXXXXXXXXXXXXXXXXXXXXXXXXXXXXXXXXXXXXXXXXXXXXXXXXXXXXXXXXXXXXXXXXXXXXXXXXXXXG

SEQ ID NO: 33949 - protein, 40 aa, Diabrotica virgifera
  misc_feature: Coding regions on vcDNA: vcDNA=SeqID_13646; Strand=-; Position=2-121
  misc_feature (6)..(38): Xaa can be any naturally occurring amino acid
IDFLAXXXXXXXXXXXXXXXXXXXXXXXXXXXXXXXXXCG

SEQ ID NO: 33950 - protein, 88 aa, Diabrotica virgifera
  misc_feature: Coding regions on vcDNA: vcDNA=SeqID_13647; Strand=+; Position=141-404
GFCGVHCPLVKYLPKVVKKFNHEEGLQSQEVDNRESDNDLVIKEHVFIVDNPVVKDLNRLRCVNYSDVSSNLAATGSQFSVPNPQQFS

SEQ ID NO: 33951 - protein, 72 aa, Diabrotica virgifera
  misc_feature: Coding regions on vcDNA: vcDNA=SeqID_13648; Strand=-; Position=90-308
  misc_feature (2)..(7): Xaa can be any naturally occurring amino acid
YXXXXXXYSSRCHFNSQNSGGKLIKGNYKADNRELLPPANKGSFITGYFNKGQIQDGSKKMVLQTQLKNLLF

SEQ ID NO: 33952 - protein, 60 aa, Diabrotica virgifera
  misc_feature: Coding regions on vcDNA: vcDNA=SeqID_13649; Strand=+; Position=2-181
  misc_feature: Homolog annotation: Hit_ID=AAA56734.1; Match level="QueryCoverage =73%, HitCoverage=27%, E-value=1e-09, Identity=68%"; Hit description =non-functional lacZ alpha peptide
  misc_feature (22)..(22): Xaa can be any naturally occurring amino acid
  misc_feature (43)..(49): Xaa can be any naturally occurring amino acid
LECNFIPLQNCHQNSIHWPSFXNFLTGKTLALPNLIPLQKIPXXXXXXXPKRPAPIAFPK

SEQ ID NO: 33953 - protein, 43 aa, Diabrotica virgifera
  misc_feature: Coding regions on vcDNA: vcDNA=SeqID_13650; Strand=+; Position=142-273
LVFSLVPSKNRIYAPKKMKVLREHKSAYSTIPLFLNYILIIFN

SEQ ID NO: 33954 - protein, 130 aa, Diabrotica virgifera
  misc_feature: Coding regions on vcDNA: vcDNA=SeqID_13651; Strand=+; Position=1-390
  misc_feature: Homolog annotation: Hit_ID=XP_392857.1; Match level="QueryCoverage =99%, HitCoverage=38%, E-value=8e-45, Identity=64%"; Hit description =similar to aspartic protease [Apis mellifera]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=-89.5, E-value=8.9e -08, Copies=1"; Pfam description=Eukaryotic aspartyl protease
  misc_feature (19)..(24): Xaa can be any naturally occurring amino acid
KDQLFAEATQEPGLAFLVXXXXXXLGMGYPEISVNGITPVFNSLVEQGAVQEPVFSFYLNRDPDGEVGGELLLGGSDPNYYKGDFTYVDVSAKGYWQVVMDSLNVGSSLKLCSDGCQIIVDTGTSLIAGP

SEQ ID NO: 33955 - protein, 59 aa, Diabrotica virgifera
  misc_feature: Coding regions on vcDNA: vcDNA=SeqID_13652; Strand=-; Position=1-177
  misc_feature (1)..(36): Xaa can be any naturally occurring amino acid
  misc_feature (42)..(55): Xaa can be any naturally occurring amino acid
XXXXXXXXXXXXXXXXXXXXXXXXXXXXXXXXXXXXPCNTRXXXXXXXXXXXXXXSQYY

SEQ ID NO: 33956 - protein, 40 aa, Diabrotica virgifera
  misc_feature: Coding regions on vcDNA: vcDNA=SeqID_13653; Strand=-; Position=3-122
YVGSRPNSHIEFDVVYYLIVTFDIIIMQTSASKVEHRPPL

SEQ ID NO: 33957 - protein, 102 aa, Diabrotica virgifera
  misc_feature: Coding regions on vcDNA: vcDNA=SeqID_13654; Strand=+; Position=67-373
  misc_feature: Homolog annotation: Hit_ID=XP_395019.1; Match level="QueryCoverage =94%, HitCoverage=17%, E-value=1e-20, Identity=56%"; Hit description =similar to ENSANGP00000015633 [Apis mellifera]
  misc_feature: Gene Ontology Annotation: Molecular function=protein phosphatase binding; Cellular component=plasma membrane; Biological process =signal transduction
  misc_feature (21)..(21): Xaa can be any naturally occurring amino acid
TPAELLNIRMEHQQLIKEMPXVEQIPIQERLTLARNRTTFQLRLWLQKEKEHGTRSSKYHKSNIRGICFNDSVVVLEAAARNDIDEIRMLLMKGVSPDSCNE

SEQ ID NO: 33958 - protein, 89 aa, Diabrotica virgifera
  misc_feature: Coding regions on vcDNA: vcDNA=SeqID_13655; Strand=+; Position=89-358
  misc_feature (8)..(8): Xaa can be any naturally occurring amino acid
  misc_feature (15)..(31): Xaa can be any naturally occurring amino acid
  misc_feature (48)..(64): Xaa can be any naturally occurring amino acid
  misc_feature (77)..(89): Xaa can be any naturally occurring amino acid
LVINNLVXNNFYAVXXXXXXXXXXXXXXXXXITFSTITIIINEIYRKXXXXXXXXXXXXXXXXXIRLILCTEIFRIXXXXXXXXXXXXX

SEQ ID NO: 33959 - protein, 87 aa, Diabrotica virgifera
  misc_feature: Coding regions on vcDNA: vcDNA=SeqID_13656; Strand=+; Position=175-438
  misc_feature (54)..(62): Xaa can be any naturally occurring amino acid
TLLINSRMLFIAAIFLVHLTCNMYTSYVIGMYQRRMTYIVRHTSYSHSLCHKKXXXXXXXXXICSRIDMNLIFRFLIILDSLMCSLK

SEQ ID NO: 33960 - protein, 66 aa, Diabrotica virgifera
  misc_feature: Coding regions on vcDNA: vcDNA=SeqID_13657; Strand=-; Position=151-351
FVFHFFKVCDSKWGLFLTIRPNILSVRSYEFQPFAGKVMLTCFFNHEGPLLMACAYQPKTCIQWRS

SEQ ID NO: 33961 - protein, 33 aa, Diabrotica virgifera
  misc_feature: Coding regions on vcDNA: vcDNA=SeqID_13658; Strand=+; Position=3-104
IQKLGRSPHRFKCITKSLWGVIELQFIYLLLIC

SEQ ID NO: 33962 - protein, 51 aa, Diabrotica virgifera
  misc_feature: Coding regions on vcDNA: vcDNA=SeqID_13659; Strand=-; Position=66-221
  misc_feature (3)..(12): Xaa can be any naturally occurring amino acid
  misc_feature (20)..(29): Xaa can be any naturally occurring amino acid
  misc_feature (34)..(45): Xaa can be any naturally occurring amino acid
INXXXXXXXXXXLNLIRIYXXXXXXXXXXDTHGXXXXXXXXXXXXISHIIN

SEQ ID NO: 33963 - protein, 68 aa, Diabrotica virgifera
  misc_feature: Coding regions on vcDNA: vcDNA=SeqID_13660; Strand=+; Position=44-250
  misc_feature (5)..(46): Xaa can be any naturally occurring amino acid
YETKXXXXXXXXXXXXXXXXXXXXXXXXXXXXXXXXXXXXXXXXXXKLSREEPVLKVLLSSYLYYLLL

SEQ ID NO: 33964 - protein, 94 aa, Diabrotica virgifera
  misc_feature: Coding regions on vcDNA: vcDNA=SeqID_13661; Strand=-; Position=83-367
SVSNITQNLIYVQTIITSHHYKSNFMYSQSPLHPTPTLNYSLMILSLDTPNTKKTLANSYTTTIAQLNLNISNKTNQNISTITPQPVHNRPTLV

SEQ ID NO: 33965 - protein, 69 aa, Diabrotica virgifera
  misc_feature: Coding regions on vcDNA: vcDNA=SeqID_13662; Strand=+; Position=27-233
  misc_feature: Homolog annotation: Hit_ID=CAE47501.1; Match level="QueryCoverage =91%, HitCoverage=19%, E-value=1e-10, Identity=52%"; Hit description =cathepsin L-like proteinase [Diabrotica virgifera virgifera]
GMLSDTEYPYERVYETCRFGLSIVPAMISHITYMKTNDESHLTNTIAAKCRITVPNDTSATIQSNGPCI

SEQ ID NO: 33966 - protein, 77 aa, Diabrotica virgifera
  misc_feature: Coding regions on vcDNA: vcDNA=SeqID_13663; Strand=+; Position=143-373
  misc_feature (22)..(22): Xaa can be any naturally occurring amino acid
  misc_feature (37)..(37): Xaa can be any naturally occurring amino acid
  misc_feature (42)..(48): Xaa can be any naturally occurring amino acid
  misc_feature (55)..(64): Xaa can be any naturally occurring amino acid
ADAWVKLNYFDPTSNFNLPINXLRTVLGLLIIPSRFXLIPSXXXXXXXKIIITLXXXXXXXXXXYKSQGRTLIFISL

SEQ ID NO: 33967 - protein, 133 aa, Diabrotica virgifera
  misc_feature: Coding regions on vcDNA: vcDNA=SeqID_13664; Strand=+; Position=2-400
  misc_feature: Homolog annotation: Hit_ID=CAE47501.1; Match level="QueryCoverage =99%, HitCoverage=41%, E-value=2e-35, Identity=57%"; Hit description =cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=61.0, E -value=3.4e-15, Copies=1"; Pfam description=Papain family cysteine protease
AFSTTGTVEGAYFLKTGNLISLSEQNLVDCASDLCNGCSGGWMYKALEYIRKAGGIMSEEDYPYTMKDDVCREDVKMSLGPISGYTHLNATEEALISALATVGPIAVSADATKWSLYGGGVFDDEECGKNINH

SEQ ID NO: 33968 - protein, 94 aa, Diabrotica virgifera
  misc_feature: Coding regions on vcDNA: vcDNA=SeqID_13665; Strand=+; Position=1-284
  misc_feature: Homolog annotation: Hit_ID=NP_966549.1; Match level="QueryCoverage =95%, HitCoverage=45%, E-value=6e-37, Identity=85%"; Hit description =hypothetical protein WD0796 [Wolbachia endosymbiont of Drosophila melanogaster]
  misc_feature: Pfam annotation: Pfam_ID=DUF1013; Match level="Score=-16.0, E-value =7e-07, Copies=1"; Pfam description=Protein of unknown function (DUF1013)
  misc_feature (23)..(23): Xaa can be any naturally occurring amino acid
LASRARLKNKPESINNLLKKFPXLDNNVIAKLISTTNYTVEQVRDGSHHNMQNIKPQDPVLLGLCSQENLEAEVEKAKVEKEKQERLKSIKNSY

SEQ ID NO: 33969 - protein, 77 aa, Diabrotica virgifera
  misc_feature: Coding regions on vcDNA: vcDNA=SeqID_13666; Strand=+; Position=70-303
  misc_feature (65)..(70): Xaa can be any naturally occurring amino acid
RTHILARSSVISLCQEYDRLVNCSKYNFVLKCDNPPHVPQARPIEEFSVELCIIIVGKSKMKIRXXXXXXKNYVRSI

SEQ ID NO: 33970 - protein, 48 aa, Diabrotica virgifera
  misc_feature: Coding regions on vcDNA: vcDNA=SeqID_13667; Strand=+; Position=265-408
  misc_feature (24)..(46): Xaa can be any naturally occurring amino acid
VYMYVILKYKLCIYDKSITFRGYXXXXXXXXXXXXXXXXXXXXXXXGS

SEQ ID NO: 33971 - protein, 18 aa, Diabrotica virgifera
  misc_feature: Coding regions on vcDNA: vcDNA=SeqID_13668; Strand=+; Position=2-55
FIFIKLFYIECVGETFGV

SEQ ID NO: 33972 - protein, 57 aa, Diabrotica virgifera
  misc_feature: Coding regions on vcDNA: vcDNA=SeqID_13669; Strand=+; Position=174-347
  misc_feature (37)..(48): Xaa can be any naturally occurring amino acid
TYSSLTLRLFIFVNSISQRSLCKIKVLPFVISPNLAXXXXXXXXXXXXFQNYILSIL

SEQ ID NO: 33973 - protein, 134 aa, Diabrotica virgifera
  misc_feature: Coding regions on vcDNA: vcDNA=SeqID_13670; Strand=+; Position=1-402
  misc_feature: Homolog annotation: Hit_ID=NP_611329.1; Match level="QueryCoverage =97%, HitCoverage=58%, E-value=9e-33, Identity=51%"; Hit description =CG17531-PA [Drosophila melanogaster] gb|AAF57695.1| CG17531-PA [Drosophila melanogaster]
  misc_feature: Gene Ontology Annotation: Molecular function=glutathione transferase activity; Cellular component=cellular_component unknown; Biological process=glutathione conjugation reaction
  misc_feature: Pfam annotation: Pfam_ID=GST_N; Match level="Score=28.7, E-value=1.7e- 05, Copies=1"; Pfam description=Glutathione S-transferase, N-terminal
PTRPRAVQLLAQELSIPLTLKNVNIPAKEQFAPEFLKINPQHTVPVLDDNGFILIDSHSIMTYFVSKYGKNDSLYPKDLQKRAIVDQRLHFDSNILFARGARIVKRVFYEQKRDVVPEDLAALVEAYEIVEKFL

SEQ ID NO: 33974 - protein, 111 aa, Diabrotica virgifera
  misc_feature: Coding regions on vcDNA: vcDNA=SeqID_13671; Strand=+; Position=63-396
  misc_feature: Homolog annotation: Hit_ID=XP_315359.1; Match level="QueryCoverage =78%, HitCoverage=16%, E-value=2e-20, Identity=56%"; Hit description =ENSANGP00000021039 [Anopheles gambiae]
  misc_feature (60)..(60): Xaa can be any naturally occurring amino acid
  misc_feature (78)..(78): Xaa can be any naturally occurring amino acid
  misc_feature (82)..(82): Xaa can be any naturally occurring amino acid
  misc_feature (90)..(90): Xaa can be any naturally occurring amino acid
MKEYECYHHRMKLNEFRDVEIRVLGIASNKITVTKCLDSLNQYMPMMDEFPIIDSHDWNXHVTSIAILTYRNEVTLIXQTDXSDIHVPPXEKKLKCYFRIARHYGWAHNQI

SEQ ID NO: 33975 - protein, 133 aa, Diabrotica virgifera
  misc_feature: Coding regions on vcDNA: vcDNA=SeqID_13672; Strand=+; Position=2-400
  misc_feature: Homolog annotation: Hit_ID=NP_598786.1; Match level="QueryCoverage =87%, HitCoverage=35%, E-value=1e-19, Identity=40%"; Hit description =peroxisomal biogenesis factor 12 [Mus musculus] emb|CAI25414.1| peroxisomal biogenesis factor 12
  misc_feature: Gene Ontology Annotation: Molecular function=zinc ion binding; Cellular component=integral to membrane
  misc_feature: Pfam annotation: Pfam_ID=Pex2_Pex12; Match level="Score=-16.3, E -value=0.0002, Copies=1"; Pfam description=Pex2 / Pex12 amino terminal region
HAANFTFTYQNRPSILEVIAQHSLNETLHPALQRLALVLSTNIPHKFGWLNKYFEETFVVLNGLLQYHYLAHYDSSFAEHFYGLKRVSSNGDPITKRHRELSLIFLVGIPYFKRKIDEKVAIIRIENAEGSIR

SEQ ID NO: 33976 - protein, 131 aa, Diabrotica virgifera
  misc_feature: Coding regions on vcDNA: vcDNA=SeqID_13673; Strand=+; Position=2-394
  misc_feature: Homolog annotation: Hit_ID=NP_722960.1; Match level="QueryCoverage =96%, HitCoverage=35%, E-value=6e-14, Identity=36%"; Hit description =CG31961-PB, isoform B [Drosophila melanogaster] ref|NP_722959.1| CG31961-PA, isoform A [Drosophila
DPRVRLPDHFNEILKEIVTLQKYVAASSIFIRNYDMQKCQNILQELTVRTKQVEDELLPKKKFSFKNKVKQKAQNSEIKSKSIDDVDFKPKIEPVKNVTGFFNKCNEHLALDNSELLKKDVSIEKLDSCTV

SEQ ID NO: 33977 - protein, 46 aa, Diabrotica virgifera
  misc_feature: Coding regions on vcDNA: vcDNA=SeqID_13674; Strand=-; Position=2-139
PIAHDHMYLPKVLNNALSRNNLAKKSGRIPPRLTHESSTRVRPNAC

SEQ ID NO: 33978 - protein, 48 aa, Diabrotica virgifera
  misc_feature: Coding regions on vcDNA: vcDNA=SeqID_13675; Strand=+; Position=1-147
TVTWCIMRLEIRFIHPNVRFSRSGCKRVAALKDGSFFSLASYVTYSFN

SEQ ID NO: 33979 - protein, 77 aa, Diabrotica virgifera
  misc_feature: Coding regions on vcDNA: vcDNA=SeqID_13676; Strand=+; Position=55-288
AIAYCAIKNISQFWPIEINRLIVHGTGTGFDIRLTWLIGHSHIPRNEEADTLANIGRDLNIPLVMLLDVHDIYNHYV

SEQ ID NO: 33980 - protein, 52 aa, Diabrotica virgifera
  misc_feature: Coding regions on vcDNA: vcDNA=SeqID_13677; Strand=-; Position=0-155
TQKSELSILTSPCTHMIFASVILGSSTCSSSDCRDVIPVDGRTLEAWVGPRV

SEQ ID NO: 33981 - protein, 73 aa, Diabrotica virgifera
  misc_feature: Coding regions on vcDNA: vcDNA=SeqID_13678; Strand=+; Position=34-255
LNGTLYPLNPIFRRAISDDGIYQLTYVHVDIVPDIIRCLNVSAMIKPLLFSKTTYYDVHLISANIIWYSFWEY

SEQ ID NO: 33982 - protein, 48 aa, Diabrotica virgifera
  misc_feature: Coding regions on vcDNA: vcDNA=SeqID_13679; Strand=+; Position=83-229
  misc_feature (33)..(39): Xaa can be any naturally occurring amino acid
LISVVREYLIFIGGPFSLCTSCIREHELSIHYXXXXXXXALADEEFLS

SEQ ID NO: 33983 - protein, 118 aa, Diabrotica virgifera
  misc_feature: Coding regions on vcDNA: vcDNA=SeqID_13680; Strand=+; Position=1-354
  misc_feature: Homolog annotation: Hit_ID=CAE47500.1; Match level="QueryCoverage =88%, HitCoverage=32%, E-value=2e-35, Identity=66%"; Hit description =cathepsin L-like proteinase [Diabrotica virgifera virgifera]
  misc_feature: Gene Ontology Annotation: Molecular function=cathepsin S activity; Cellular component=lysosome; Biological process=proteolysis and peptidolysis
  misc_feature: Pfam annotation: Pfam_ID=Peptidase_C1; Match level="Score=-17.3, E -value=9.3e-10, Copies=1"; Pfam description=Papain family cysteine protease
  misc_feature (105)..(105): Xaa can be any naturally occurring amino acid
SGFTYIKKGDEDDLKNAVYVKGPVSVAIMVTSNFSRYKSGIFDDDACITDYVNHGVLVVGYGTQNGKDYWIVKNSWGDQFGNNGYIWMRRNTDNQCNIASFATYXWIIFATLCSIRFL

SEQ ID NO: 33984 - protein, 74 aa, Diabrotica virgifera
  misc_feature: Coding regions on vcDNA: vcDNA=SeqID_13681; Strand=+; Position=1-225
HTLFFANDRGYLQSIAGVFIIVVSRIPSVLFVLDGVDDVPFLACFCTLRFSLLSARTATCFLNCQIKYLHLTME

SEQ ID NO: 33985 - protein, 65 aa, Diabrotica virgifera
  misc_feature: Coding regions on vcDNA: vcDNA=SeqID_13682; Strand=+; Position=2-199
TEFHINKYFHAGIVKYVASYCFKINLYILFIYFVYYFILVNVLYDNCQMKQSLQRIVYLRFSVTT

SEQ ID NO: 33986 - protein, 100 aa, Diabrotica virgifera
  misc_feature: Coding regions on vcDNA: vcDNA=SeqID_13683; Strand=-; Position=27-329
  misc_feature (20)..(26): Xaa can be any naturally occurring amino acid
  misc_feature (86)..(92): Xaa can be any naturally occurring amino acid
KTTKRCLQFGTNSIIIQTLXXXXXXXRNVNQHFKFSPLTYNNNASQFRDMTSSLILLNGNTVVLTGCAKLYITAKFQISTPYHLQXXXXXXXYEKQAIKQ

SEQ ID NO: 33987 - protein, 126 aa, Diabrotica virgifera
  misc_feature: Coding regions on vcDNA: vcDNA=SeqID_13684; Strand=+; Position=34-411
  misc_feature (4)..(15): Xaa can be any naturally occurring amino acid
  misc_feature (26)..(32): Xaa can be any naturally occurring amino acid
  misc_feature (105)..(105): Xaa can be any naturally occurring amino acid
VYIXXXXXXXXXXXXKYITFFGDSCXXXXXXXLCVLSNTIFLVFFRFFCDAGHLQKLKNCFLRGFWGFERVSLIFTYSKGLSYFKLHITYKDEIYLIYSEVYKIXKIAKNPQKNSFSDFWRGRALR

SEQ ID NO: 33988 - protein, 51 aa, Diabrotica virgifera
  misc_feature: Coding regions on vcDNA: vcDNA=SeqID_13685; Strand=-; Position=135-290
SLIIMYFFREVISQNVEGIWSSHSSDLTPVSGRVKLHVGSKHANKVRIRFN

SEQ ID NO: 33989 - protein, 57 aa, Diabrotica virgifera
  misc_feature: Coding regions on vcDNA: vcDNA=SeqID_13686; Strand=-; Position=142-315
HYRLYYPNQLCAVMFSSVFLEDYVVRYACIEYYAPASNVVGSAERTVQVKSALVILN

SEQ ID NO: 33990 - protein, 61 aa, Diabrotica virgifera
  misc_feature: Coding regions on vcDNA: vcDNA=SeqID_13687; Strand=+; Position=41-226
EWLRISHFVHFRTYFGHIFFHPLQGVKFTPMAKAHIGTLSPFFFDVLAIRVPDFMSIQAVL

SEQ ID NO: 33991 - protein, 60 aa, Diabrotica virgifera
  misc_feature: Coding regions on vcDNA: vcDNA=SeqID_13688; Strand=-; Position=150-332
  misc_feature (23)..(29): Xaa can be any naturally occurring amino acid
  misc_feature (32)..(38): Xaa can be any naturally occurring amino acid
NLLHTSRLKKYPQTFRCKTIFVXXXXXXXCLXXXXXXXTKIFWYITPLYDRYLVILLFTL

SEQ ID NO: 33992 - protein, 48 aa, Diabrotica virgifera
  misc_feature: Coding regions on vcDNA: vcDNA=SeqID_13689; Strand=-; Position=1-144
  misc_feature (19)..(45): Xaa can be any naturally occurring amino acid
HCITAYGSDQSFRTSTLLXXXXXXXXXXXXXXXXXXXXXXXXXXXVSV

SEQ ID NO: 33993 - protein, 139 aa, Diabrotica virgifera
  misc_feature: Coding regions on vcDNA: vcDNA=SeqID_13690; Strand=+; Position=2-418
  misc_feature: Homolog annotation: Hit_ID=XP_397395.1; Match level="QueryCoverage =96%, HitCoverage=10%, E-value=2e-42, Identity=64%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=MMR_HSR1; Match level="Score=-16.3, E-value =0.017, Copies=1"; Pfam description=GTPase of unknown function
PSVRLPGKKPPRNWPEKGRIIFKNTYLKYAPELPPVLKDLNIEVNSGEKIGIVGRTGAGKSTLIASLFRLAPIEGTISIDDVDTAEIGLNDLRLNISIIPQEPILFSASLRYNLDPFEKHGDEVLWKALEDVELKGAIS

SEQ ID NO: 33994 - protein, 77 aa, Diabrotica virgifera
  misc_feature: Coding regions on vcDNA: vcDNA=SeqID_13691; Strand=+; Position=3-236
HKHSHNSSEIKQQFLSTIYRYPYFKIIFTDASKSSNGAAIFEDSTSVTRLAKECSIYWRTASNHQRTKPNVSTIYLI

SEQ ID NO: 33995 - protein, 136 aa, Diabrotica virgifera
  misc_feature: Coding regions on vcDNA: vcDNA=SeqID_13692; Strand=+; Position=3-410
  misc_feature: Homolog annotation: Hit_ID=CAF92654.1; Match level="QueryCoverage =97%, HitCoverage=14%, E-value=1e-42, Identity=65%"; Hit description =unnamed protein product [Tetraodon nigroviridis]
  misc_feature: Gene Ontology Annotation: Molecular function=transporter activity; Cellular component=secretory vesicle; Biological process=ER to Golgi transport
  misc_feature (19)..(24): Xaa can be any naturally occurring amino acid
VEMCYQRTKSFEKLSFLYXXXXXXDKLRKMMKIAEIRKAKSSQYHAALLLGDLEERVKILKASNQLSLAYLTAATHGMVDEAEQLKEQIGEKKGFPDVDPNAKFLKPPPPIQQAESNWPLLTVSRGFFENTAAVAT

SEQ ID NO: 33996 - protein, 139 aa, Diabrotica virgifera
  misc_feature: Coding regions on vcDNA: vcDNA=SeqID_13693; Strand=+; Position=2-418
  misc_feature: Homolog annotation: Hit_ID=XP_314743.1; Match level="QueryCoverage =94%, HitCoverage=13%, E-value=3e-55, Identity=78%"; Hit description =ENSANGP00000013023 [Anopheles gambiae]
  misc_feature: Gene Ontology Annotation: Molecular function=3',5'-cGMP binding; Cellular component=cellular_component unknown; Biological process =cGMP catabolism
TGYRTKSLLCMPIKDTNGDVIGVAQVINKVGEQPFTKTDEEVFSKYLQFCGIGLRNAHLYEKSQLEIKRNQVLLDLARMIFQEQSTLEHVVYRILLHAQSLIQCQRVQILLTHQDSSASFSRVFDFEENDINIIEAGES

SEQ ID NO: 33997 - protein, 47 aa, Diabrotica virgifera
  misc_feature: Coding regions on vcDNA: vcDNA=SeqID_13694; Strand=+; Position=2-142
KLSLPFDVNFLRSMDWDQSVLQATISNSIPGRWYGRADWDISAKQIN

SEQ ID NO: 33998 - protein, 110 aa, Diabrotica virgifera
  misc_feature: Coding regions on vcDNA: vcDNA=SeqID_13695; Strand=+; Position=2-331
PKRQANGVRREVRFTGRSDMPERWTEPLPSGPSFPRHEDARGRTGYAAIAVSDADGFQTGADQTSHRTMERDIPATTAKTCCAKTDYATSTGNTISPIPTTTTREQIFNA

SEQ ID NO: 33999 - protein, 48 aa, Diabrotica virgifera
  misc_feature: Coding regions on vcDNA: vcDNA=SeqID_13696; Strand=-; Position=18-164
KMIIYNLNIYLKFRTYSICIIKHYPLKCLIPIMSNYCHLRLLLVSRYN

SEQ ID NO: 34000 - protein, 78 aa, Diabrotica virgifera
  misc_feature: Coding regions on vcDNA: vcDNA=SeqID_13697; Strand=+; Position=76-312
  misc_feature (18)..(24): Xaa can be any naturally occurring amino acid
IMINIPITWKWFLLHVRXXXXXXXSIQSFIFYILQLCVRSVLRCLSHNGFPVISWTIFFSHVSISLFVLVVSDLVSAV

SEQ ID NO: 34001 - protein, 44 aa, Diabrotica virgifera
  misc_feature: Coding regions on vcDNA: vcDNA=SeqID_13698; Strand=+; Position=175-309
QLYCNLHMLNHFFVMTCYSFLTTSNFLGNKSNLVITNIFITKYF

SEQ ID NO: 34002 - protein, 48 aa, Diabrotica virgifera
  misc_feature: Coding regions on vcDNA: vcDNA=SeqID_13699; Strand=+; Position=51-197
QLIPSFLIFHSKIIPIRDILHLIKLQNLLFSLFLKISEKLRKQNVHKT

SEQ ID NO: 34003 - protein, 64 aa, Diabrotica virgifera
  misc_feature: Coding regions on vcDNA: vcDNA=SeqID_13700; Strand=-; Position=3-194
  misc_feature (48)..(54): Xaa can be any naturally occurring amino acid
LRHWPYLATLPYLFVLTIGSFLTLPITPTFHSGLGPAVVTTVSFLYVXXXXXXXPVCIHSWTKT

SEQ ID NO: 34004 - protein, 47 aa, Diabrotica virgifera
  misc_feature: Coding regions on vcDNA: vcDNA=SeqID_13701; Strand=-; Position=30-173
  misc_feature (15)..(23): Xaa can be any naturally occurring amino acid
  misc_feature (41)..(46): Xaa can be any naturally occurring amino acid
ATLSPCLYYAVPILXXXXXXXXXVCYLINGGFFPESVLYAXXXXXXK

SEQ ID NO: 34005 - protein, 78 aa, Diabrotica virgifera
  misc_feature: Coding regions on vcDNA: vcDNA=SeqID_13702; Strand=+; Position=1-237
KLTSYKNSVVRADAYILFCGMGNLETFKRLLNSLHTMVHTGVINRVDWGVVRIWDHYGIQCDSVIVSRLKILWLWQLH

SEQ ID NO: 34006 - protein, 57 aa, Diabrotica virgifera
  misc_feature: Coding regions on vcDNA: vcDNA=SeqID_13703; Strand=-; Position=177-350
HCTSNIVSNCFIVISSDILYIQWNPDKSAPDNPEVRLTRTDFHQINILIFNILYFSI

SEQ ID NO: 34007 - protein, 75 aa, Diabrotica virgifera
  misc_feature: Coding regions on vcDNA: vcDNA=SeqID_13704; Strand=+; Position=71-298
HVKSFMFISNKGSERENLGGVLSFGLLKCTSTLDRSVQFDLTYYIISRLLKFFSNIEYFCEKPKYFYNPQYQEVI

SEQ ID NO: 34008 - protein, 64 aa, Diabrotica virgifera
  misc_feature: Coding regions on vcDNA: vcDNA=SeqID_13705; Strand=-; Position=228-422
NYVLYIKLATICKSFKFLQCKNTIFYHFSVKIVFLFRQLININNFFIVYCFRECICLQIFSHLH

SEQ ID NO: 34009 - protein, 84 aa, Diabrotica virgifera
  misc_feature: Coding regions on vcDNA: vcDNA=SeqID_13706; Strand=+; Position=1-255
SRRVRTRCQRTREQRAVHQSTGDNEYTYDLHYISVRRRARHIVNYTVTLKSIIRDHDLRLDVISRNLSTADQNLEIYKVCKFTV

SEQ ID NO: 34010 - protein, 34 aa, Diabrotica virgifera
  misc_feature: Coding regions on vcDNA: vcDNA=SeqID_13707; Strand=+; Position=2-106
  misc_feature (25)..(34): Xaa can be any naturally occurring amino acid
HASARESRLGSILKLITKFYYDRDXXXXXXXXXX

SEQ ID NO: 34011 - protein, 58 aa, Diabrotica virgifera
  misc_feature: Coding regions on vcDNA: vcDNA=SeqID_13708; Strand=-; Position=218-394
PLYKALDILHLRFRLWNKIFLWKNVCDFNNLSEQIKKGTKLNYYKNQILLLLPKVTNT

SEQ ID NO: 34012 - protein, 102 aa, Diabrotica virgifera
  misc_feature: Coding regions on vcDNA: vcDNA=SeqID_13709; Strand=-; Position=100-408
  misc_feature (2)..(19): Xaa can be any naturally occurring amino acid
  misc_feature (28)..(34): Xaa can be any naturally occurring amino acid
  misc_feature (47)..(62): Xaa can be any naturally occurring amino acid
  misc_feature (65)..(78): Xaa can be any naturally occurring amino acid
  misc_feature (81)..(101): Xaa can be any naturally occurring amino acid
IXXXXXXXXXXXXXXXXXXKFHIYIIFXXXXXXXYKLKILVKLNYKXXXXXXXXXXXXXXXXLYXXXXXXXXXXXXXXIEXXXXXXXXXXXXXXXXXXXXXS

SEQ ID NO: 34013 - protein, 47 aa, Diabrotica virgifera
  misc_feature: Coding regions on vcDNA: vcDNA=SeqID_13710; Strand=+; Position=249-389
  misc_feature (12)..(17): Xaa can be any naturally occurring amino acid
CLDLNKIILKNXXXXXXSQTVFDMLTSLCFGMNVLYHLIVSNESFVL

SEQ ID NO: 34014 - protein, 80 aa, Diabrotica virgifera
  misc_feature: Coding regions on vcDNA: vcDNA=SeqID_13711; Strand=+; Position=42-284
SSYFQSTVGTCNITVLNASMASSGDWNRCTCIDIVNFMIVMKSLGPGLGYTVNGLTFRCFKVPKTLLYFWQCADLHCPDV

SEQ ID NO: 34015 - protein, 123 aa, Diabrotica virgifera
  misc_feature: Coding regions on vcDNA: vcDNA=SeqID_13712; Strand=+; Position=59-430
  misc_feature: Pfam annotation: Pfam_ID=CBM_14; Match level="Score=55.7, E-value =1.4e-13, Copies=1"; Pfam description=Chitin binding Peritrophin-A domain
MKVTGTLVILSVYFVLSIVDSATARQVPRRQLLSENKSDIEEDCKNGLQNYYNYPYDCQKYYTCREGKLYLSTCQDDLYWNSELRSCDIQANVNCSKIIPLPHPVCTDSRTTFYIYPYNWQKI

SEQ ID NO: 34016 - protein, 48 aa, Diabrotica virgifera
  misc_feature: Coding regions on vcDNA: vcDNA=SeqID_13713; Strand=-; Position=58-204
KNEVYRPSKRKVAANEKFLLYVKFEIEYFNMKQPKNQILFVENSLEPS

SEQ ID NO: 34017 - protein, 61 aa, Diabrotica virgifera
  misc_feature: Coding regions on vcDNA: vcDNA=SeqID_13714; Strand=-; Position=0-182
  misc_feature (5)..(15): Xaa can be any naturally occurring amino acid
  misc_feature (22)..(33): Xaa can be any naturally occurring amino acid
  misc_feature (35)..(60): Xaa can be any naturally occurring amino acid
LLIRXXXXXXXXXXXPCNTGSXXXXXXXXXXXXFXXXXXXXXXXXXXXXXXXXXXXXXXXL

SEQ ID NO: 34018 - protein, 29 aa, Diabrotica virgifera
  misc_feature: Coding regions on vcDNA: vcDNA=SeqID_13715; Strand=-; Position=1-87
  misc_feature (6)..(26): Xaa can be any naturally occurring amino acid
IVLLTXXXXXXXXXXXXXXXXXXXXXIYF

SEQ ID NO: 34019 - protein, 71 aa, Diabrotica virgifera
  misc_feature: Coding regions on vcDNA: vcDNA=SeqID_13716; Strand=-; Position=20-235
RKECLIHNQHGHSQNTSTVTTLILSEQKVLNAMASQSQIDTTNTDLSKSSDRVDHNMLLGKLNAFGFSHQS

SEQ ID NO: 34020 - protein, 60 aa, Diabrotica virgifera
  misc_feature: Coding regions on vcDNA: vcDNA=SeqID_13717; Strand=-; Position=214-396
  misc_feature (37)..(43): Xaa can be any naturally occurring amino acid
TEFHVFPHLVSWFLLFYCLMKCIGVICCLLQRYAIYXXXXXXXPCYPAISLNKCDITIFY

SEQ ID NO: 34021 - protein, 56 aa, Diabrotica virgifera
  misc_feature: Coding regions on vcDNA: vcDNA=SeqID_13718; Strand=-; Position=42-212
ITTRFKNIFQYASLDDLTEQKEIENKSCQNFERVFPKTAPKGLTFNSKLFANPLEF

SEQ ID NO: 34022 - protein, 88 aa, Diabrotica virgifera
  misc_feature: Coding regions on vcDNA: vcDNA=SeqID_13719; Strand=+; Position=3-269
  misc_feature: Homolog annotation: Hit_ID=NP_573176.1; Match level="QueryCoverage =98%, HitCoverage=46%, E-value=7e-41, Identity=93%"; Hit description =CG9099-PA [Drosophila melanogaster] gb|AAF48679.3| CG9099-PA [Drosophila melanogaster]
  misc_feature: Pfam annotation: Pfam_ID=SUI1; Match level="Score=97.5, E-value=3.4e -26, Copies=1"; Pfam description=Translation initiation factor SUI1
GPKQVCVSRAPRGKKKSVTVVTGLSSFDIDLKVAAKFFGTKFACGSSVTGDDEIVIQGDVKDDLFDVIPEKWPEIDEDLIEDLGDQKR

SEQ ID NO: 34023 - protein, 77 aa, Diabrotica virgifera
  misc_feature: Coding regions on vcDNA: vcDNA=SeqID_13720; Strand=+; Position=62-295
  misc_feature (11)..(21): Xaa can be any naturally occurring amino acid
  misc_feature (72)..(77): Xaa can be any naturally occurring amino acid
VRKRFERGPFXXXXXXXXXXXMYQLHWGVLLHVNFYLTRWYTANLRVLSRFIFGKFNVCDYIFLNHCTEEIXXXXXX

SEQ ID NO: 34024 - protein, 46 aa, Diabrotica virgifera
  misc_feature: Coding regions on vcDNA: vcDNA=SeqID_13721; Strand=+; Position=2-139
  misc_feature (9)..(15): Xaa can be any naturally occurring amino acid
  misc_feature (39)..(45): Xaa can be any naturally occurring amino acid
TEMLFSRHXXXXXXXIISTNACHIYVLHLYLFLCYVQTXXXXXXXG

SEQ ID NO: 34025 - protein, 38 aa, Diabrotica virgifera
  misc_feature: Coding regions on vcDNA: vcDNA=SeqID_13722; Strand=+; Position=34-150
  misc_feature (12)..(20): Xaa can be any naturally occurring amino acid
  misc_feature (23)..(30): Xaa can be any naturally occurring amino acid
REILFRLILNYXXXXXXXXXKTXXXXXXXXVQGLLIDN

SEQ ID NO: 34026 - protein, 26 aa, Diabrotica virgifera
  misc_feature: Coding regions on vcDNA: vcDNA=SeqID_13723; Strand=-; Position=1-78
LKLVMPDHASPILELTLATSNLVISL

SEQ ID NO: 34027 - protein, 26 aa, Diabrotica virgifera
  misc_feature: Coding regions on vcDNA: vcDNA=SeqID_13724; Strand=-; Position=0-77
  misc_feature (7)..(14): Xaa can be any naturally occurring amino acid
  misc_feature (17)..(23): Xaa can be any naturally occurring amino acid
LFFLSFXXXXXXXXQTXXXXXXXGVV

SEQ ID NO: 34028 - protein, 67 aa, Diabrotica virgifera
  misc_feature: Coding regions on vcDNA: vcDNA=SeqID_13725; Strand=-; Position=13-216
SSLSRAIAPTTDHVNTARRDNTIRLEFEGTINNKALLLIIVWINSTYICTCPACYSLLCESRKFSLQ

SEQ ID NO: 34029 - protein, 88 aa, Diabrotica virgifera
  misc_feature: Coding regions on vcDNA: vcDNA=SeqID_13726; Strand=+; Position=2-265
  misc_feature: Homolog annotation: Hit_ID=CAE47497.1; Match level="QueryCoverage =100%, HitCoverage=27%, E-value=4e-22, Identity=62%"; Hit description= cathepsin L-like proteinase [Diabrotica virgifera virgifera]
  misc_feature (21)..(21): Xaa can be any naturally occurring amino acid
  misc_feature (33)..(33): Xaa can be any naturally occurring amino acid
  misc_feature (60)..(60): Xaa can be any naturally occurring amino acid
LFILAAALIVVTCADLSAVVXWTIFKAAHNRSXNVSCEDFIIAVFQDNLLIFNVHNAKYXCGYGTYYMAVNRFAMWSSVEFQAILGRQ

SEQ ID NO: 34030 - protein, 45 aa, Diabrotica virgifera
  misc_feature: Coding regions on vcDNA: vcDNA=SeqID_13727; Strand=+; Position=68-205
VRVDLSLRIRLYSSFLDILYACCAAICCSFLIVSHCLRNGIIVSY

SEQ ID NO: 34031 - protein, 33 aa, Diabrotica virgifera
  misc_feature: Coding regions on vcDNA: vcDNA=SeqID_13728; Strand=-; Position=9-110
HMFPPLNPPSHQIHYSRPNTNSLAPPKTTLAAS

SEQ ID NO: 34032 - protein, 64 aa, Diabrotica virgifera
  misc_feature: Coding regions on vcDNA: vcDNA=SeqID_13729; Strand=+; Position=72-266
  misc_feature: Homolog annotation: Hit_ID=NP_573176.1; Match level="QueryCoverage =95%, HitCoverage=32%, E-value=2e-17, Identity=72%"; Hit description =CG9099-PA [Drosophila melanogaster] gb|AAF48679.3| CG9099-PA [Drosophila melanogaster]
  misc_feature: Pfam annotation: Pfam_ID=SUI1; Match level="Score=-16.0, E-value =0.027, Copies=1"; Pfam description=Translation initiation factor SUI1
  misc_feature (47)..(47): Xaa can be any naturally occurring amino acid
NILDIDLKVAAKVPGITCTSGSSVTGDDELVIQRDVNDDLIDVIPDXWPEIDEDLIQDLGDQNR

SEQ ID NO: 34033 - protein, 56 aa, Diabrotica virgifera
  misc_feature: Coding regions on vcDNA: vcDNA=SeqID_13730; Strand=+; Position=1-171
  misc_feature (2)..(11): Xaa can be any naturally occurring amino acid
  misc_feature (16)..(26): Xaa can be any naturally occurring amino acid
  misc_feature (35)..(43): Xaa can be any naturally occurring amino acid
EXXXXXXXXXXSIMRXXXXXXXXXXXGSLTIMYQXXXXXXXXXTIFNFHISKYVNS

SEQ ID NO: 34034 - protein, 43 aa, Diabrotica virgifera
  misc_feature: Coding regions on vcDNA: vcDNA=SeqID_13731; Strand=+; Position=12-143
  misc_feature (27)..(37): Xaa can be any naturally occurring amino acid
NVICFNQYLYFCEIYLFDLSGINSWLXXXXXXXXXXXTDELSN

SEQ ID NO: 34035 - protein, 48 aa, Diabrotica virgifera
  misc_feature: Coding regions on vcDNA: vcDNA=SeqID_13732; Strand=+; Position=1-147
  misc_feature (13)..(19): Xaa can be any naturally occurring amino acid
LQHPEVSRIKPRXXXXXXXHYIYKCMSYLSAPSLFISLVCACLDKYIF

SEQ ID NO: 34036 - protein, 61 aa, Diabrotica virgifera
  misc_feature: Coding regions on vcDNA: vcDNA=SeqID_13733; Strand=-; Position=110-295
PYITLQENRHSAHGTRNVLIHIATLDLPRLVETLPRPNNSQNHTLSTTNVDLSQLYYTNNN

SEQ ID NO: 34037 - protein, 73 aa, Diabrotica virgifera
  misc_feature: Coding regions on vcDNA: vcDNA=SeqID_13734; Strand=+; Position=109-330
  misc_feature: Homolog annotation: Hit_ID=BAB88642.1; Match level="QueryCoverage =98%, HitCoverage=23%, E-value=2e-09, Identity=44%"; Hit description =NADH dehydrogenase subunit 5 [Leptura aethiops]
  misc_feature (12)..(19): Xaa can be any naturally occurring amino acid
  misc_feature (28)..(28): Xaa can be any naturally occurring amino acid
  misc_feature (50)..(56): Xaa can be any naturally occurring amino acid
  misc_feature (58)..(58): Xaa can be any naturally occurring amino acid
LVFSTPNFICLXXXXXXXXLIFIIVGVXLCYELAKFNISYDLLWLHNISXXXXXXXIXNIPFLSTLGINYYPV

SEQ ID NO: 34038 - protein, 70 aa, Diabrotica virgifera
  misc_feature: Coding regions on vcDNA: vcDNA=SeqID_13735; Strand=-; Position=1-210
  misc_feature (43)..(51): Xaa can be any naturally occurring amino acid
KCMYVYFLHISIGYWQIQKSKLHIYRCLHNKSEYFIQIAIGTXXXXXXXXXSNYVFKNLFRANKVPPTLP

SEQ ID NO: 34039 - protein, 77 aa, Diabrotica virgifera
  misc_feature: Coding regions on vcDNA: vcDNA=SeqID_13736; Strand=+; Position=131-364
TIPFCNLIPLTCLVLLTVIRLFIYFCKNTKLFLIIHLNSIRMFVSKNRNLFLYVQNFIYLSNFLILENTRRLFCDKS

SEQ ID NO: 34040 - protein, 144 aa, Diabrotica virgifera
  misc_feature: Coding regions on vcDNA: vcDNA=SeqID_13737; Strand=+; Position=3-434
  misc_feature: Homolog annotation: Hit_ID=XP_392524.1; Match level="QueryCoverage =93%, HitCoverage=4%, E-value=8e-27, Identity=43%"; Hit description =similar to ENSANGP00000010415 [Apis mellifera]
  misc_feature: Gene Ontology Annotation: Molecular function=transmembrane receptor activity; Cellular component=integral to membrane; Biological process=intracellular protein transport
NTRLPTRPDYFNSEVNYKYCGGMGCAPDSISTQIFMAKLQPDLTRIATQANSWLDDFKDWSETESCCKYFKDTNYFCPHSYSSEDCDPCYFTLINKTTGLSQYNYYRKYLPHFLNDNPNPSCAKAGHPAYANGITYLSDENGYT

SEQ ID NO: 34041 - protein, 67 aa, Diabrotica virgifera
  misc_feature: Coding regions on vcDNA: vcDNA=SeqID_13738; Strand=+; Position=29-229
HTLESLPICLLHSHQSPFFWSPFYVTTLVLPYLIVLPHSFCSKFVLLAFWLSPLPLHIPFTSYLETG

SEQ ID NO: 34042 - protein, 88 aa, Diabrotica virgifera
  misc_feature: Coding regions on vcDNA: vcDNA=SeqID_13739; Strand=-; Position=110-376
YPVTSNGHSWISTTGEMLSGNKSILSKLVGDDIKSFPVLLVLKYEVNDENLSLDFLFEFLLNSAPSINVVVLFCYNIKQSFRYNGDFS

SEQ ID NO: 34043 - protein, 70 aa, Diabrotica virgifera
  misc_feature: Coding regions on vcDNA: vcDNA=SeqID_13740; Strand=+; Position=35-247
  misc_feature: Homolog annotation: Hit_ID=AAM44043.1; Match level="QueryCoverage =65%, HitCoverage=21%, E-value=2e-09, Identity=60%"; Hit description =ferritin 1 [Apriona germari]
MLDSFILPQADHVMSSKFAQYGSIFNDVYLVDYLTGDFVVEQYYGQLDLTGKVSNLQKTMGEHGPLGDRL

SEQ ID NO: 34044 - protein, 22 aa, Diabrotica virgifera
  misc_feature: Coding regions on vcDNA: vcDNA=SeqID_13741; Strand=-; Position=49-117
SSYIYNNTKSQLHITIIKHIYF

SEQ ID NO: 34045 - protein, 20 aa, Diabrotica virgifera
  misc_feature: Coding regions on vcDNA: vcDNA=SeqID_13742; Strand=+; Position=2-61
KSVSKHQEEHRTVAAANMAV

SEQ ID NO: 34046 - protein, 128 aa, Diabrotica virgifera
  misc_feature: Coding regions on vcDNA: vcDNA=SeqID_13743; Strand=+; Position=2-385
  misc_feature: Homolog annotation: Hit_ID=CAA77014.1; Match level="QueryCoverage =91%, HitCoverage=28%, E-value=6e-38, Identity=63%"; Hit description =chitinase [Phaedon cochleariae]
  misc_feature: Gene Ontology Annotation: Molecular function=extracellular matrix structural constituent; Cellular component=extracellular matrix; Biological process=response to bacteria
  misc_feature: Pfam annotation: Pfam_ID=Glyco_hydro_18; Match level="Score=-15.5, E -value=4.7e-05, Copies=1"; Pfam description=Glycosyl hydrolases family 18
AIFCTAPTFGSGKNIVCYFSSWTVYRHGGDGAGSFDVRNIDPSLCTHINFAFIGLNTDASIHILDPWESNDAGGPEGFKNLVALKESNPNLKIIVSMGGWNEGSEVYSEVAANAMLRKILANNVAYFQ

SEQ ID NO: 34047 - protein, 130 aa, Diabrotica virgifera
  misc_feature: Coding regions on vcDNA: vcDNA=SeqID_13744; Strand=+; Position=3-392
  misc_feature: Homolog annotation: Hit_ID=CAG08644.1; Match level="QueryCoverage =84%, HitCoverage=12%, E-value=3e-22, Identity=46%"; Hit description =unnamed protein product [Tetraodon nigroviridis]
  misc_feature: Gene Ontology Annotation: Molecular function=magnesium ion binding; Cellular component=intracellular; Biological process=germ-cell development
VFVDEVAQACEPEVCIALGMVKHGQQIVLAGDPKQLGPSLTSDSAIRYGLGISLLERIMQTELYHQHNQRCITMLIQNFRNHPKILTLPNELFYGDQLQAQSQRSLLDPLATTCVFQKLQEMYSVAGKKN

SEQ ID NO: 34048 - protein, 24 aa, Diabrotica virgifera
  misc_feature: Coding regions on vcDNA: vcDNA=SeqID_13745; Strand=-; Position=0-71
LSVFLFCSLVFIQLCKSLPKLIFV

SEQ ID NO: 34049 - protein, 53 aa, Diabrotica virgifera
  misc_feature: Coding regions on vcDNA: vcDNA=SeqID_13746; Strand=+; Position=125-286
IKSDKMTPHQNAVCSIIELEQTSKNYRPIGTRVEGFNKFCSHYHNYCNNRPYD

SEQ ID NO: 34050 - protein, 81 aa, Diabrotica virgifera
  misc_feature: Coding regions on vcDNA: vcDNA=SeqID_13747; Strand=+; Position=19-264
  misc_feature (1)..(8): Xaa can be any naturally occurring amino acid
  misc_feature (23)..(29): Xaa can be any naturally occurring amino acid
  misc_feature (31)..(43): Xaa can be any naturally occurring amino acid
  misc_feature (58)..(68): Xaa can be any naturally occurring amino acid
XXXXXXXXRRFNFCYLCITDYYXXXXXXXVXXXXXXXXXXXXXHITILNNFLVMICDXXXXXXXXXXXTLYLFSNTIFRLK

SEQ ID NO: 34051 - protein, 119 aa, Diabrotica virgifera
  misc_feature: Coding regions on vcDNA: vcDNA=SeqID_13748; Strand=+; Position=3-362
NMKTALVLTLLFCVGLTVNAKTANMPEKPTHHPATPEPEPDPEEFQCDACITFATVIDELVEERLPLDEVERDASLICRILPGTLGEFCEQHLLPKVDKIYEECHKHEPQDVCDRLDFC

SEQ ID NO: 34052 - protein, 71 aa, Diabrotica virgifera
  misc_feature: Coding regions on vcDNA: vcDNA=SeqID_13749; Strand=+; Position=32-247
VMQIHTILVRISSRTTAITSNNGSIVIRRGCGINTNMTIQNFHKILDKMVPISCYQLSLKLGTHGELYHNI

SEQ ID NO: 34053 - protein, 62 aa, Diabrotica virgifera
  misc_feature: Coding regions on vcDNA: vcDNA=SeqID_13750; Strand=+; Position=3-191
ISISLYISSSYISTSIISSAVFTLLIYLSTSSVFPKSNSMFTSSMVISLNSVSIPTILFIRN

SEQ ID NO: 34054 - protein, 48 aa, Diabrotica virgifera
  misc_feature: Coding regions on vcDNA: vcDNA=SeqID_13751; Strand=-; Position=2-145
  misc_feature (2)..(10): Xaa can be any naturally occurring amino acid
  misc_feature (42)..(48): Xaa can be any naturally occurring amino acid
LXXXXXXXXXWYKNLSFSYDKTKIFSHISNKLSLSKIFLYFXXXXXXX

SEQ ID NO: 34055 - protein, 63 aa, Diabrotica virgifera
  misc_feature: Coding regions on vcDNA: vcDNA=SeqID_13752; Strand=+; Position=140-328
  misc_feature (6)..(17): Xaa can be any naturally occurring amino acid
ISFLYXXXXXXXXXXXXQWFLTELFYISHLRSKSVITQKNLKSVLLHQQFNKTINSYLTKVSR

SEQ ID NO: 34056 - protein, 101 aa, Diabrotica virgifera
  misc_feature: Coding regions on vcDNA: vcDNA=SeqID_13753; Strand=+; Position=44-349
  misc_feature (1)..(48): Xaa can be any naturally occurring amino acid
XXXXXXXXXXXXXXXXXXXXXXXXXXXXXXXXXXXXXXXXXXXXXXXXMMLKLTLDKITQVTIPVVGAHMSYVKQVFDQLRNKEHLKPDLMILGNVRVEIN

SEQ ID NO: 34057 - protein, 16 aa, Diabrotica virgifera
  misc_feature: Coding regions on vcDNA: vcDNA=SeqID_13754; Strand=-; Position=2-49
LKFCFTWTKKDLMILN

SEQ ID NO: 34058 - protein, 85 aa, Diabrotica virgifera
  misc_feature: Coding regions on vcDNA: vcDNA=SeqID_13755; Strand=-; Position=90-347
  misc_feature (68)..(83): Xaa can be any naturally occurring amino acid
KTHNSSFLLNSLQKFYTFTRKSGKFGSKMNMYVYSATMTLFSYSLTFDVNVSLSITRTVAFREMPYVXXXXXXXXXXXXXXXXIT

SEQ ID NO: 34059 - protein, 139 aa, Diabrotica virgifera
  misc_feature: Coding regions on vcDNA: vcDNA=SeqID_13756; Strand=+; Position=1-417
  misc_feature: Homolog annotation: Hit_ID=XP_321605.1; Match level="QueryCoverage =99%, HitCoverage=6%, E-value=6e-57, Identity=76%"; Hit description =ENSANGP00000009625 [Anopheles gambiae]
  misc_feature: Gene Ontology Annotation: Molecular function=ATP dependent RNA helicase activity; Cellular component=spliceosome complex; Biological process=RNA splicing
  misc_feature: Pfam annotation: Pfam_ID=DEAD; Match level="Score=-19.8, E-value =0.00093, Copies=1"; Pfam description=DEAD/DEAH box helicase
  misc_feature (93)..(93): Xaa can be any naturally occurring amino acid
TETQLPVSFRHLILPEKNFPPTELLDLQPLPITALRNEQFESLYADKFPQFNPIQTQVFNSVYNGDDNIFIGAPTGSGKTTIAKFAILRLFDXNPEGRCVYLVPKDALAELIFADWHNKFGQALAKKVVLLTGETGTDL

SEQ ID NO: 34060 - protein, 54 aa, Diabrotica virgifera
  misc_feature: Coding regions on vcDNA: vcDNA=SeqID_13757; Strand=+; Position=195-359
VVFRGNKMVLTKYLETKCQQHIVGDDHFNESDYWNSSAILFPEDDYTENATTTI

SEQ ID NO: 34061 - protein, 127 aa, Diabrotica virgifera
  misc_feature: Coding regions on vcDNA: vcDNA=SeqID_13758; Strand=+; Position=28-408
  misc_feature: Homolog annotation: Hit_ID=XP_312666.1; Match level="QueryCoverage =99%, HitCoverage=56%, E-value=6e-54, Identity=78%"; Hit description =ENSANGP00000020666 [Anopheles gambiae]
  misc_feature: Pfam annotation: Pfam_ID=BCAS2; Match level="Score=122.5, E-value=1e -33, Copies=1"; Pfam description=Breast carcinoma amplified sequence 2
MAGEVIVDALPYIDQGYDEPGVREAAFAMVEEECRRFRPTKNYLEHLPPLNISSFETPIMHNEFERLQNRLPMETLSMKRYELPPPPSGKLNEVGAWNECVDNSQAQLEHQAVRILNLHLMLDYCCP

SEQ ID NO: 34062 - protein, 95 aa, Diabrotica virgifera
  misc_feature: Coding regions on vcDNA: vcDNA=SeqID_13759; Strand=-; Position=66-353
NFRVYSDFHINLSHISLKLCIFLQASRPQIGGICSRLLDSVYSCINLQVDLVMHCTPPLLFLQVRPMASLVVSGHGSLLSMLRRYHTGRRSLGGR

SEQ ID NO: 34063 - protein, 20 aa, Diabrotica virgifera
  misc_feature: Coding regions on vcDNA: vcDNA=SeqID_13760; Strand=-; Position=3-62
MTLDTIDDFFMYFYVFFNLS

SEQ ID NO: 34064 - protein, 99 aa, Diabrotica virgifera
  misc_feature: Coding regions on vcDNA: vcDNA=SeqID_13761; Strand=+; Position=67-363
  misc_feature: Homolog annotation: Hit_ID=XP_395537.1; Match level="QueryCoverage =100%, HitCoverage=35%, E-value=7e-20, Identity=48%"; Hit description= similar to ENSANGP00000007187 [Apis mellifera]
  misc_feature: Gene Ontology Annotation: Cellular component=mitochondrion
MLANITSKFRNCTCSVRKYSVVSLSSTENRINVEPRELAFPPKYQEPRQVWLESLDTIDDKKLGILELHPDVFATNPRIDIIHQNVRWQSLYRYVSYAH

SEQ ID NO: 34065 - protein, 50 aa, Diabrotica virgifera
  misc_feature: Coding regions on vcDNA: vcDNA=SeqID_13762; Strand=-; Position=198-350
TVRPVVPNLLCLATHLLTFFYIRDPSLTHDDIYVCYSATVRATPRPTSGS

SEQ ID NO: 34066 - protein, 136 aa, Diabrotica virgifera
  misc_feature: Coding regions on vcDNA: vcDNA=SeqID_13763; Strand=+; Position=13-420
  misc_feature: Homolog annotation: Hit_ID=XP_312426.1; Match level="QueryCoverage =100%, HitCoverage=51%, E-value=1e-37, Identity=53%"; Hit description= ENSANGP00000021872 [Anopheles gambiae]
  misc_feature: Gene Ontology Annotation: Biological process=pathogenesis
  misc_feature: Pfam annotation: Pfam_ID=FRG1; Match level="Score=-27.0, E-value=1.2e- 06, Copies=1"; Pfam description=FRG1-like family
  misc_feature (15)..(22): Xaa can be any naturally occurring amino acid
  misc_feature (117)..(117): Xaa can be any naturally occurring amino acid
KMSEYDKVRIGKLVXXXXXXXXKKRKHKPKQQEEETPKVDVDSAKHGNWWSIQKKDEMVGPIAIEFGAHTYVRALDNGLFTLGAPHRDGQGPSPEEILTAIPINERKIAFKSGLHKXLRVEKNGSVTGRSDAIGAM

SEQ ID NO: 34067 - protein, 50 aa, Diabrotica virgifera
  misc_feature: Coding regions on vcDNA: vcDNA=SeqID_13764; Strand=+; Position=111-263
GGIRHRDTASVYQREALTGNVLQKWVRNIIHGEDIFSSMVFQTRDDLDRE

SEQ ID NO: 34068 - protein, 138 aa, Diabrotica virgifera
  misc_feature: Coding regions on vcDNA: vcDNA=SeqID_13765; Strand=+; Position=1-414
  misc_feature: Homolog annotation: Hit_ID=XP_319864.1; Match level="QueryCoverage =79%, HitCoverage=23%, E-value=3e-11, Identity=31%"; Hit description =ENSANGP00000010645 [Anopheles gambiae]
RLSVVTLLTQIDTEKEQTLFFVGSMIFATMLNCFTGLALASLYELITKFPCSYYASLQSGNNICGILSAVLQIILLSFRLRPNENGAIQFSVGCFILIFTTIYYFVVFKNSYFIYRIDTNHEDQRNLSTAEWMQIIPK

SEQ ID NO: 34069 - protein, 92 aa, Diabrotica virgifera
  misc_feature: Coding regions on vcDNA: vcDNA=SeqID_13766; Strand=+; Position=42-317
  misc_feature (5)..(11): Xaa can be any naturally occurring amino acid
  misc_feature (16)..(24): Xaa can be any naturally occurring amino acid
  misc_feature (27)..(48): Xaa can be any naturally occurring amino acid
  misc_feature (57)..(74): Xaa can be any naturally occurring amino acid
SAALXXXXXXXLGAFXXXXXXXXXHNXXXXXXXXXXXXXXXXXXXXXXEEHNAKYEXXXXXXXXXXXXXXXXXXAEFQAMLARQMANKPKQS

SEQ ID NO: 34070 - protein, 55 aa, Diabrotica virgifera
  misc_feature: Coding regions on vcDNA: vcDNA=SeqID_13767; Strand=+; Position=37-204
MNLFILAAATSVAISAFLCSINLLATYNVSYNVAEDIIHVAVIYAVLRDIDVHIA

SEQ ID NO: 34071 - protein, 91 aa, Diabrotica virgifera
  misc_feature: Coding regions on vcDNA: vcDNA=SeqID_13768; Strand=-; Position=1-273
  misc_feature (1)..(15): Xaa can be any naturally occurring amino acid
  misc_feature (19)..(88): Xaa can be any naturally occurring amino acid
XXXXXXXXXXXXXXXLLNXXXXXXXXXXXXXXXXXXXXXXXXXXXXXXXXXXXXXXXXXXXXXXXXXXXXXXXXXXXXXXXXXXXXXXGYS

SEQ ID NO: 34072 - protein, 37 aa, Diabrotica virgifera
  misc_feature: Coding regions on vcDNA: vcDNA=SeqID_13769; Strand=+; Position=31-144
LSPQLIFYFMIPIILLHLFMMNELQELYWLLHRDIYD

SEQ ID NO: 34073 - protein, 111 aa, Diabrotica virgifera
  misc_feature: Coding regions on vcDNA: vcDNA=SeqID_13770; Strand=-; Position=2-337
  misc_feature (8)..(18): Xaa can be any naturally occurring amino acid
  misc_feature (22)..(110): Xaa can be any naturally occurring amino acid
YLNRNLIXXXXXXXXXXXVILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 34074 - protein, 59 aa, Diabrotica virgifera
  misc_feature: Coding regions on vcDNA: vcDNA=SeqID_13771; Strand=+; Position=166-345
FSMVVIAISSCGFLLIFYMYQQYYCLGILISFQYLHKCQFKDHALHGQPNNIEAYFCCS

SEQ ID NO: 34075 - protein, 66 aa, Diabrotica virgifera
  misc_feature: Coding regions on vcDNA: vcDNA=SeqID_13772; Strand=-; Position=126-326
  misc_feature (9)..(17): Xaa can be any naturally occurring amino acid
  misc_feature (37)..(49): Xaa can be any naturally occurring amino acid
KPKTWQENXXXXXXXXXNLLFITCGKKNINECFSTIXXXXXXXXXXXXXRINSSGNHNHSTSLRQL

SEQ ID NO: 34076 - protein, 122 aa, Diabrotica virgifera
  misc_feature: Coding regions on vcDNA: vcDNA=SeqID_13773; Strand=+; Position=27-395
  misc_feature: Homolog annotation: Hit_ID=EAL28752.1; Match level="QueryCoverage =90%, HitCoverage=20%, E-value=9e-26, Identity=46%"; Hit description =GA13146-PA [Drosophila pseudoobscura]
  misc_feature: Pfam annotation: Pfam_ID=5-FTHF_cyc-lig; Match level="Score=-21.1, E -value=0.00053, Copies=1"; Pfam description=5-formyltetrahydrofolate cyclo-ligase
  misc_feature (97)..(97): Xaa can be any naturally occurring amino acid
IVGEKVEVTGDIKFDIFVLGSVAVSKDGYRIGKGGGFVDLEFAIYKEMKAITEDTIIITIVHDSQVFDTLPQELFKTHDIPVDVIITPTRVITGGKXIVKPSGIIWNEMTGAQIRSRKICRL

SEQ ID NO: 34077 - protein, 45 aa, Diabrotica virgifera
  misc_feature: Coding regions on vcDNA: vcDNA=SeqID_13774; Strand=-; Position=0-134
  misc_feature (1)..(32): Xaa can be any naturally occurring amino acid
  misc_feature (35)..(44): Xaa can be any naturally occurring amino acid
XXXXXXXXXXXXXXXXXXXXXXXXXXXXXXXXVTXXXXXXXXXXT

SEQ ID NO: 34078 - protein, 59 aa, Diabrotica virgifera
  misc_feature: Coding regions on vcDNA: vcDNA=SeqID_13775; Strand=-; Position=172-351
KTQIIVVLYIKTTNKDNSQSDCQTIEFLFITNLRQYDRSSTVMSEPSTNSLLLSLIFNI

SEQ ID NO: 34079 - protein, 58 aa, Diabrotica virgifera
  misc_feature: Coding regions on vcDNA: vcDNA=SeqID_13776; Strand=+; Position=214-387
  misc_feature (29)..(29): Xaa can be any naturally occurring amino acid
  misc_feature (31)..(31): Xaa can be any naturally occurring amino acid
IRVRYIYLSDYETRYALFRINIHSFLSKXCXMSPLSTLWRVSIHHSPLVGFWGNIGFI

SEQ ID NO: 34080 - protein, 61 aa, Diabrotica virgifera
  misc_feature: Coding regions on vcDNA: vcDNA=SeqID_13777; Strand=+; Position=1-186
  misc_feature (10)..(17): Xaa can be any naturally occurring amino acid
  misc_feature (47)..(54): Xaa can be any naturally occurring amino acid
TSEFNLLVYXXXXXXXXFIYRNVSNNVRYNGDFINYCTMCCTEYNMXXXXXXXXILFSLLN

SEQ ID NO: 34081 - protein, 81 aa, Diabrotica virgifera
  misc_feature: Coding regions on vcDNA: vcDNA=SeqID_13778; Strand=-; Position=167-412
TSTIPYLEISENFSGAVSPTSGYEVEQNIRLSKFSSQASASSSSKLSSVKSDIGEPMLLDSTWIISSYIFVLSSPYYKSNS

SEQ ID NO: 34082 - protein, 17 aa, Diabrotica virgifera
  misc_feature: Coding regions on vcDNA: vcDNA=SeqID_13779; Strand=-; Position=1-51
FLSFVIVFLCIIRLTLE

SEQ ID NO: 34083 - protein, 23 aa, Diabrotica virgifera
  misc_feature: Coding regions on vcDNA: vcDNA=SeqID_13780; Strand=-; Position=1-69
SADVGKWICSVLDEGIIHIWMFV

SEQ ID NO: 34084 - protein, 76 aa, Diabrotica virgifera
  misc_feature: Coding regions on vcDNA: vcDNA=SeqID_13781; Strand=-; Position=171-401
  misc_feature (8)..(15): Xaa can be any naturally occurring amino acid
  misc_feature (18)..(18): Xaa can be any naturally occurring amino acid
  misc_feature (22)..(23): Xaa can be any naturally occurring amino acid
  misc_feature (40)..(40): Xaa can be any naturally occurring amino acid
  misc_feature (61)..(67): Xaa can be any naturally occurring amino acid
FQNTCYCXXXXXXXXYSXSNVXXCEIHMRIVNYSWTKKMXPFINQLKETDFRIPILLMYYXXXXXXXLGTYLVRNS

SEQ ID NO: 34085 - protein, 39 aa, Diabrotica virgifera
  misc_feature: Coding regions on vcDNA: vcDNA=SeqID_13782; Strand=+; Position=113-232
TATLKTNQNLDLLKYDIIVLHSLMDSDIKCRTIMSYFKG

SEQ ID NO: 34086 - protein, 51 aa, Diabrotica virgifera
  misc_feature: Coding regions on vcDNA: vcDNA=SeqID_13783; Strand=+; Position=1-156
NCLCTFLSMRYSLYLHVCYSVILLLHAPLKVRRITRFIQSLRASFILLFTH

SEQ ID NO: 34087 - protein, 78 aa, Diabrotica virgifera
  misc_feature: Coding regions on vcDNA: vcDNA=SeqID_13784; Strand=+; Position=3-236
  misc_feature (1)..(2): Xaa can be any naturally occurring amino acid
XXAGRAVSRAAARPGRAVRPPARHFIALGGGLRTSVRRTGFSPVLTGNALSLLHPERLASHPPFSSWLTRQHDLTYRP

SEQ ID NO: 34088 - protein, 118 aa, Diabrotica virgifera
  misc_feature: Coding regions on vcDNA: vcDNA=SeqID_13785; Strand=+; Position=66-419
LFSSKFHLIYSCHLLLFLTIRTADGTRWFFFLMIDMCLYFIVFWKETTFLPPGVSTTLKSPAIQQRGPCHQGCNHITKTATTNIRRPGGIQHLQPQSPLQNQQQYHTTSRRYHQLPKA

SEQ ID NO: 34089 - protein, 47 aa, Diabrotica virgifera
  misc_feature: Coding regions on vcDNA: vcDNA=SeqID_13786; Strand=-; Position=143-286
INSIYFFRNWFYVKTINSSLQKSYLKDLCYIKNFNCVALLNSKVVNM

SEQ ID NO: 34090 - protein, 143 aa, Diabrotica virgifera
  misc_feature: Coding regions on vcDNA: vcDNA=SeqID_13787; Strand=+; Position=1-429
  misc_feature: Homolog annotation: Hit_ID=BAA02502.1; Match level="QueryCoverage =95%, HitCoverage=10%, E-value=2e-46, Identity=64%"; Hit description =xanthine dehydrogenase [Gallus gallus] ref|NP_990458.1| xanthine dehydrogenase [Gallus gallus]
  misc_feature: Gene Ontology Annotation: Molecular function=electron carrier activity; Biological process=reproduction
TTHPINLYNEGDATNFNKVLENCTLDKCWRECKESSNYLSRREAVKEFNRLNKYKKRGLNIVPTKYGIAFGVTFLNQAGALVLIYSDGSVLISHGGIEMGQRLYTKMIQVASKALGIPVEKIHTMESSTDKVPNTSTTAASTG

SEQ ID NO: 34091 - protein, 68 aa, Diabrotica virgifera
  misc_feature: Coding regions on vcDNA: vcDNA=SeqID_13788; Strand=-; Position=103-309
  misc_feature (6)..(22): Xaa can be any naturally occurring amino acid
VKLCRXXXXXXXXXXXXXXXXXTLYELILARYWALSFMYHQFPVYAIRSSKNSYLRIPVYLCSVVTQT

SEQ ID NO: 34092 - protein, 66 aa, Diabrotica virgifera
  misc_feature: Coding regions on vcDNA: vcDNA=SeqID_13789; Strand=+; Position=3-203
  misc_feature (10)..(10): Xaa can be any naturally occurring amino acid
DRHWMDVNVXSAPAHPILDSLAYLTNSRFAVSNMLLTSCHYCTYFFLSSTLLHCANGTETTVSCFT

SEQ ID NO: 34093 - protein, 57 aa, Diabrotica virgifera
  misc_feature: Coding regions on vcDNA: vcDNA=SeqID_13790; Strand=+; Position=2-175
  misc_feature: Homolog annotation: Hit_ID=EAL27769.1; Match level="QueryCoverage =100%, HitCoverage=38%, E-value=1e-15, Identity=70%"; Hit description= GA14430-PA [Drosophila pseudoobscura]
RNTGKIPASQLRDLLQNWGKSLSPKEVYRIFREANVTANSMVRYEDFVKISCAPVPD

SEQ ID NO: 34094 - protein, 68 aa, Diabrotica virgifera
  misc_feature: Coding regions on vcDNA: vcDNA=SeqID_13791; Strand=-; Position=1-204
  misc_feature (10)..(10): Xaa can be any naturally occurring amino acid
  misc_feature (30)..(30): Xaa can be any naturally occurring amino acid
RTETHNTPDXDREKPGSGARSRGQRRPGTXTRQTNSPRPEKARHEETAAGTRTRARKQEAERTHRRTR

SEQ ID NO: 34095 - protein, 68 aa, Diabrotica virgifera
  misc_feature: Coding regions on vcDNA: vcDNA=SeqID_13792; Strand=+; Position=9-215
VSIFPFAQETKYAFFFYFIDYYTSTELSETAKVRSKTFVTRRCQINRSLKVFRFLFVTCFTVKLITIL

SEQ ID NO: 34096 - protein, 19 aa, Diabrotica virgifera
  misc_feature: Coding regions on vcDNA: vcDNA=SeqID_13793; Strand=-; Position=0-56
  misc_feature (2)..(15): Xaa can be any naturally occurring amino acid
RXXXXXXXXXXXXXXTYFV

SEQ ID NO: 34097 - protein, 115 aa, Diabrotica virgifera
  misc_feature: Coding regions on vcDNA: vcDNA=SeqID_13794; Strand=+; Position=36-380
  misc_feature: Homolog annotation: Hit_ID=XP_319361.1; Match level="QueryCoverage =60%, HitCoverage=7%, E-value=9e-12, Identity=47%"; Hit description =ENSANGP00000006164 [Anopheles gambiae]
MEETICDKYNTSLVLYRYNNNAFYFEQNVKIIQMVTKYLLKPSRKRHMLVNWCLSEINEKNSISKEINFQELKILVIQFCTHLLAAGVLKQLPDKEVPMYNIFKPDLIYFWTHTE

SEQ ID NO: 34098 - protein, 147 aa, Diabrotica virgifera
  misc_feature: Coding regions on vcDNA: vcDNA=SeqID_13795; Strand=-; Position=0-440
  misc_feature (2)..(143): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLIV

SEQ ID NO: 34099 - protein, 91 aa, Diabrotica virgifera
  misc_feature: Coding regions on vcDNA: vcDNA=SeqID_13796; Strand=+; Position=3-275
  misc_feature: Homolog annotation: Hit_ID=XP_316626.1; Match level="QueryCoverage =98%, HitCoverage=7%, E-value=1e-20, Identity=54%"; Hit description =ENSANGP00000011480 [Anopheles gambiae]
  misc_feature: Gene Ontology Annotation: Molecular function=chromatin binding; Cellular component=dosage compensation complex (sensu Drosophila); Biological process=dosage compensation, by hyperactivation of X chromosome
  misc_feature (29)..(29): Xaa can be any naturally occurring amino acid
  misc_feature (62)..(62): Xaa can be any naturally occurring amino acid
NFRPDTMAIFPMVTVGPDPRLDVVMSLMXYGLYPNVCFHNDTRKVLASQGIAALMHKTSVNXSNQDQGFPYSIVVFGELISTRAVTCKQMT

SEQ ID NO: 34100 - protein, 18 aa, Diabrotica virgifera
  misc_feature: Coding regions on vcDNA: vcDNA=SeqID_13797; Strand=+; Position=2-55
GRPLYRVVSFLLMHHPSS

SEQ ID NO: 34101 - protein, 52 aa, Diabrotica virgifera
  misc_feature: Coding regions on vcDNA: vcDNA=SeqID_13798; Strand=-; Position=1-156
  misc_feature (21)..(21): Xaa can be any naturally occurring amino acid
  misc_feature (47)..(47): Xaa can be any naturally occurring amino acid
KSVAHLPSFYFKSQTQRGIAXYKPHCKNPSKPHPVVGLSVHYLTYHXYIFPL

SEQ ID NO: 34102 - protein, 54 aa, Diabrotica virgifera
  misc_feature: Coding regions on vcDNA: vcDNA=SeqID_13799; Strand=-; Position=12-176
MLGRNKILHTYLIFGSERTNFNRIKSSEKICLCIEKIFIKRKIPLLRASISTAT

SEQ ID NO: 34103 - protein, 93 aa, Diabrotica virgifera
  misc_feature: Coding regions on vcDNA: vcDNA=SeqID_13800; Strand=-; Position=56-337
  misc_feature: Homolog annotation: Hit_ID=BAA22288.1; Match level="QueryCoverage =98%, HitCoverage=7%, E-value=6e-21, Identity=56%"; Hit description =polyprotein [Oryza australiensis]
  misc_feature (28)..(28): Xaa can be any naturally occurring amino acid
  misc_feature (41)..(41): Xaa can be any naturally occurring amino acid
  misc_feature (47)..(47): Xaa can be any naturally occurring amino acid
AYASAIGSIKYDMLCTRPIVYPALCLAXEYNSDLGVDHWTXVKIILXWNKDMFLDYGGDKRFIVKGYIDASFDTDPDDSKTQSGYILKVGAIS

SEQ ID NO: 34104 - protein, 107 aa, Diabrotica virgifera
  misc_feature: Coding regions on vcDNA: vcDNA=SeqID_13801; Strand=+; Position=2-321
  misc_feature: Homolog annotation: Hit_ID=XP_479634.1; Match level="QueryCoverage =97%, HitCoverage=10%, E-value=2e-49, Identity=86%"; Hit description =putative 2-oxoglutarate dehydrogenase, E1 subunit [Oryza sativa (japonica
  misc_feature: Gene Ontology Annotation: Cellular component=mitochondrion; Biological process=embryogenesis and morphogenesis
  misc_feature (20)..(20): Xaa can be any naturally occurring amino acid
SKFVVMSPKNLLRHKDCKSXLSEFDDLAGHPEFDKQGTRFKRLIKDRNDHKDLEEGIRRLVLCSGKVYYELDEERNKSDSNDVAICRVEQLCPFPYDLIQRELKRYP

SEQ ID NO: 34105 - protein, 45 aa, Diabrotica virgifera
  misc_feature: Coding regions on vcDNA: vcDNA=SeqID_13802; Strand=+; Position=166-303
  misc_feature (10)..(17): Xaa can be any naturally occurring amino acid
NSNHFAYELXXXXXXXXIVEQDYNYSSYKHSQCCIGVDRRYPRIL

SEQ ID NO: 34106 - protein, 35 aa, Diabrotica virgifera
  misc_feature: Coding regions on vcDNA: vcDNA=SeqID_13803; Strand=+; Position=2-109
NNTCAIIVNSTNYTINLIIVVTRHENEINCIVSRI

SEQ ID NO: 34107 - protein, 84 aa, Diabrotica virgifera
  misc_feature: Coding regions on vcDNA: vcDNA=SeqID_13804; Strand=+; Position=105-356
KLPWSNYRPSITEPNTNSYRPWSIPEFLSFANIVSIRQHHSFKSGISPLTLRQHQDDRILSLVDPHNLPMTHGEQHDYRIAPLV

SEQ ID NO: 34108 - protein, 78 aa, Diabrotica virgifera
  misc_feature: Coding regions on vcDNA: vcDNA=SeqID_13805; Strand=-; Position=3-236
NILPTSGYGYYGFAQSPLNVFISAIEYFRLFTTRSGYFASANVRIKCSLRDVGNSLCSHREVSKNFRQSQYRGVCRPA

SEQ ID NO: 34109 - protein, 54 aa, Diabrotica virgifera
  misc_feature: Coding regions on vcDNA: vcDNA=SeqID_13806; Strand=+; Position=78-242
  misc_feature (1)..(7): Xaa can be any naturally occurring amino acid
  misc_feature (18)..(24): Xaa can be any naturally occurring amino acid
  misc_feature (46)..(51): Xaa can be any naturally occurring amino acid
XXXXXXXPKIPVDALSCXXXXXXXVYISILEMYFLFYIFFKVLTIXXXXXXSTI

SEQ ID NO: 34110 - protein, 45 aa, Diabrotica virgifera
  misc_feature: Coding regions on vcDNA: vcDNA=SeqID_13807; Strand=+; Position=16-150
RNCLTLSTRSDSRTVQLRGNKCHSGNGADRCRAVWMQGHGLRASL

SEQ ID NO: 34111 - protein, 104 aa, Diabrotica virgifera
  misc_feature: Coding regions on vcDNA: vcDNA=SeqID_13808; Strand=-; Position=123-437
  misc_feature (45)..(51): Xaa can be any naturally occurring amino acid
HTIHFPSDSTLMRYMGSLSAKCLLCGSPGYKDSQTKSYPDQCRLXXXXXXXIVYLVTYRSVLLAQDRIPAPGLVSLNLKRRVLLKIVFIFRFRITFHNTQLSTI

SEQ ID NO: 34112 - protein, 113 aa, Diabrotica virgifera
  misc_feature: Coding regions on vcDNA: vcDNA=SeqID_13809; Strand=+; Position=3-344
  misc_feature: Homolog annotation: Hit_ID=AAT38514.1; Match level="QueryCoverage =97%, HitCoverage=21%, E-value=2e-23, Identity=46%"; Hit description =antennae-rich cytochrome P450 [Phyllopertha diversa]
  misc_feature: Gene Ontology Annotation: Molecular function=cytochrome P450 activity; Cellular component=extracellular space; Biological process= blood coagulation
DLVIEKGTAVYIPYFAMFRDPKYFPNPLKFNPERFADNTFNSDGYTFFPFGEGPRACIGKRLGLLAIAACVSNIVLKFNIEKCEATPDAIEFEPKSLALQSKDGLKIKLIARE

SEQ ID NO: 34113 - protein, 70 aa, Diabrotica virgifera
  misc_feature: Coding regions on vcDNA: vcDNA=SeqID_13810; Strand=-; Position=2-211
  misc_feature (2)..(21): Xaa can be any naturally occurring amino acid
  misc_feature (26)..(35): Xaa can be any naturally occurring amino acid
  misc_feature (42)..(54): Xaa can be any naturally occurring amino acid
  misc_feature (62)..(68): Xaa can be any naturally occurring amino acid
EXXXXXXXXXXXXXXXXXXXXLFNSXXXXXXXXXXSLIPRFXXXXXXXXXXXXXLPLLFTYXXXXXXXTF

SEQ ID NO: 34114 - protein, 55 aa, Diabrotica virgifera
  misc_feature: Coding regions on vcDNA: vcDNA=SeqID_13811; Strand=+; Position=148-315
RRRLSLFRCVWSIPNSFGKGYISNSLHFNQTTWVLNYVLCQCSSFFMVPFFTLTL

SEQ ID NO: 34115 - protein, 145 aa, Diabrotica virgifera
  misc_feature: Coding regions on vcDNA: vcDNA=SeqID_13812; Strand=+; Position=2-436
SNPIQMKCLCFIFICVILGISQNQYGVHGECRPVTGRVTRSAFVEMGLHFVELLKLRIISNCVANGFYIEDELKESFKDLGVCLNKEKLYVSPREDFLKNLKECNVEPIKLVKSCLTREQSYFPDFLYNMAKAQIDLIYDNRDVI

SEQ ID NO: 34116 - protein, 147 aa, Diabrotica virgifera
  misc_feature: Coding regions on vcDNA: vcDNA=SeqID_13813; Strand=+; Position=2-442
NFKHGWWKTMQGKGRHQVNPENPNLAQNRQQLEAQPFEPELKVVATFGELLNSEFYTQNENLLTPLINYFEDVWIGRLDRRQQRRPPMFPRNLWNCFEFIEEDLPRTNNAVEGWHNSFPSILNAAHPNLWKFITGLKKEESLNRLKV

SEQ ID NO: 34117 - protein, 104 aa, Diabrotica virgifera
  misc_feature: Coding regions on vcDNA: vcDNA=SeqID_13814; Strand=+; Position=1-315
  misc_feature (76)..(82): Xaa can be any naturally occurring amino acid
KSKTNDMTRTICRMGFNHCLTPSYIFKLNIADSPQCICGQFGNLQHKILTCSLISNKVNMFLNSLYSLTDVNHPIXXXXXXXLENNELVYRLLYKHILDIKLKL

SEQ ID NO: 34118 - protein, 101 aa, Diabrotica virgifera
  misc_feature: Coding regions on vcDNA: vcDNA=SeqID_13815; Strand=+; Position=135-437
  misc_feature (14)..(36): Xaa can be any naturally occurring amino acid
  misc_feature (43)..(55): Xaa can be any naturally occurring amino acid
  misc_feature (59)..(76): Xaa can be any naturally occurring amino acid
  misc_feature (81)..(88): Xaa can be any naturally occurring amino acid
GILILFIYITRIAXXXXXXXXXXXXXXXXXXXXXXXILRFILXXXXXXXXXXXXXMNNXXXXXXXXXXXXXXXXXXYKLIXXXXXXXXLITLIAVVKITKF

SEQ ID NO: 34119 - protein, 81 aa, Diabrotica virgifera
  misc_feature: Coding regions on vcDNA: vcDNA=SeqID_13816; Strand=+; Position=34-279
HECARWKSRFRFTSMAYRREHTEDTFLSVFFAVSVVTDTCSGRVSFFYIIRLWVAHVSPTVINTTNFTRNFDTRIMKKNLH

SEQ ID NO: 34120 - protein, 39 aa, Diabrotica virgifera
  misc_feature: Coding regions on vcDNA: vcDNA=SeqID_13817; Strand=-; Position=3-119
INLHDKVYHAKTLIQQWKSRSPAEFTYIEAEATMNSWNL

SEQ ID NO: 34121 - protein, 94 aa, Diabrotica virgifera
  misc_feature: Coding regions on vcDNA: vcDNA=SeqID_13818; Strand=-; Position=1-282
  misc_feature (3)..(16): Xaa can be any naturally occurring amino acid
  misc_feature (25)..(46): Xaa can be any naturally occurring amino acid
  misc_feature (52)..(64): Xaa can be any naturally occurring amino acid
  misc_feature (69)..(82): Xaa can be any naturally occurring amino acid
  misc_feature (84)..(94): Xaa can be any naturally occurring amino acid
FNXXXXXXXXXXXXXXKIRCTFKTXXXXXXXXXXXXXXXXXXXXXXGLLNLXXXXXXXXXXXXXYTRYXXXXXXXXXXXXXXPXXXXXXXXXXX

SEQ ID NO: 34122 - protein, 106 aa, Diabrotica virgifera
  misc_feature: Coding regions on vcDNA: vcDNA=SeqID_13819; Strand=+; Position=66-383
  misc_feature: Homolog annotation: Hit_ID=AAW48898.1; Match level="QueryCoverage =72%, HitCoverage=21%, E-value=1e-10, Identity=51%"; Hit description =lark-PA [Bombyx mori]
TIQFLILLISTGSLLIAVDGYDGYYDRRFEDSRDMYERRYSGMPSSRDVGMRGAASARDFMPPPLPPRREPLPPMPSIGLRGGPSSGMGGSLRDSGFSRSASDYGM

SEQ ID NO: 34123 - protein, 138 aa, Diabrotica virgifera
  misc_feature: Coding regions on vcDNA: vcDNA=SeqID_13820; Strand=-; Position=1-414
  misc_feature (4)..(137): Xaa can be any naturally occurring amino acid
IYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 34124 - protein, 68 aa, Diabrotica virgifera
  misc_feature: Coding regions on vcDNA: vcDNA=SeqID_13821; Strand=+; Position=2-205
  misc_feature: Homolog annotation: Hit_ID=XP_392346.1; Match level="QueryCoverage =100%, HitCoverage=6%, E-value=4e-20, Identity=63%"; Hit description =similar to Probable DNA mismatch repair protein MSH6 [Apis mellifera]
  misc_feature: Gene Ontology Annotation: Molecular function=damaged DNA binding; Cellular component=nucleus; Biological process=mismatch repair
  misc_feature (62)..(62): Xaa can be any naturally occurring amino acid
FLKPENIRDINKRKPDHPEYDCRTLYVPEKYLTTLTRVMKQWWELKSRHMDTVLFFKVGKFXELYHMD

SEQ ID NO: 34125 - protein, 62 aa, Diabrotica virgifera
  misc_feature: Coding regions on vcDNA: vcDNA=SeqID_13822; Strand=-; Position=0-185
  misc_feature (6)..(60): Xaa can be any naturally occurring amino acid
IIIIIXXXXXXXXXXXXXXXXXXXXXXXXXXXXXXXXXXXXXXXXXXXXXXXXXXXXXXXLS

SEQ ID NO: 34126 - protein, 94 aa, Diabrotica virgifera
  misc_feature: Coding regions on vcDNA: vcDNA=SeqID_13823; Strand=+; Position=160-441
  misc_feature (81)..(81): Xaa can be any naturally occurring amino acid
INMLSFLQDLDFVAVGEGIHTFAVSFLFFSLYFNKGSLGVSAKTQILFLVSIIAKSWYVIQLGHYEPIYWWLQFSHIAFTXGTLLFYLYRGLLT

SEQ ID NO: 34127 - protein, 43 aa, Diabrotica virgifera
  misc_feature: Coding regions on vcDNA: vcDNA=SeqID_13824; Strand=-; Position=119-250
  misc_feature (3)..(13): Xaa can be any naturally occurring amino acid
  misc_feature (31)..(39): Xaa can be any naturally occurring amino acid
SHXXXXXXXXXXXVITSSFHHLEAFNTFENXXXXXXXXXNLVN

SEQ ID NO: 34128 - protein, 89 aa, Diabrotica virgifera
  misc_feature: Coding regions on vcDNA: vcDNA=SeqID_13825; Strand=+; Position=2-271
SAHFQSSVLSVISTRQTDDAVIKAGRRHVNDDLDDLFITIDENAKSALPRTPTSLARFNLVTSSSVTALMYDPNDVSLSNSQKFTVTNY

SEQ ID NO: 34129 - protein, 106 aa, Diabrotica virgifera
  misc_feature: Coding regions on vcDNA: vcDNA=SeqID_13826; Strand=+; Position=37-354
  misc_feature: Homolog annotation: Hit_ID=XP_396943.1; Match level="QueryCoverage =75%, HitCoverage=14%, E-value=1e-15, Identity=50%"; Hit description =similar to MGC69122 protein [Apis mellifera]
  misc_feature: Pfam annotation: Pfam_ID=APC8; Match level="Score=-24.5, E-value =0.00023, Copies=1"; Pfam description=Anaphase promoting complex subunit 8 /
PTRPQFVICESEVQQIDIRLDFNSMKIDLVKAIHACAQRGLYHSVKWLSEINFSLKHIQLSKEDTVDISDDLDEEVDAYLVAKSNFDLKEYDRCSQFWLRLYENPN

SEQ ID NO: 34130 - protein, 53 aa, Diabrotica virgifera
  misc_feature: Coding regions on vcDNA: vcDNA=SeqID_13827; Strand=+; Position=2-160
  misc_feature (24)..(38): Xaa can be any naturally occurring amino acid
  misc_feature (47)..(53): Xaa can be any naturally occurring amino acid
TDLSVVCFLYNSNEHIRKGVLICXXXXXXXXXXXXXXXLYHHATHKXXXXXXX

SEQ ID NO: 34131 - protein, 55 aa, Diabrotica virgifera
  misc_feature: Coding regions on vcDNA: vcDNA=SeqID_13828; Strand=+; Position=2-166
  misc_feature: Homolog annotation: Hit_ID=NP_476739.1; Match level="QueryCoverage =94%, HitCoverage=2%, E-value=2e-13, Identity=69%"; Hit description =CG1977-PA [Drosophila melanogaster] gb|AAF47569.1| CG1977-PA [Drosophila melanogaster]
  misc_feature: Gene Ontology Annotation: Molecular function=actin binding; Cellular component=plasma membrane; Biological process=neuromuscular synaptic transmission
PRVRKVDAGLTASQQNLLDSNSISARQNQINQQYDRLLQLANERRTKLEETVKAK

SEQ ID NO: 34132 - protein, 49 aa, Diabrotica virgifera
  misc_feature: Coding regions on vcDNA: vcDNA=SeqID_13829; Strand=-; Position=1-147
  misc_feature (17)..(25): Xaa can be any naturally occurring amino acid
TVEGKTARGASFPANPXXXXXXXXXTTRAATSSSHMLSFVVDHCSLDSK

SEQ ID NO: 34133 - protein, 38 aa, Diabrotica virgifera
  misc_feature: Coding regions on vcDNA: vcDNA=SeqID_13830; Strand=-; Position=194-310
LPLDYMYSYLHFLINYYFKKHQLLYTIRYRCSIGVELV

SEQ ID NO: 34134 - protein, 18 aa, Diabrotica virgifera
  misc_feature: Coding regions on vcDNA: vcDNA=SeqID_13831; Strand=-; Position=57-113
MVLKLRTAIQRFCEAIWN

SEQ ID NO: 34135 - protein, 63 aa, Diabrotica virgifera
  misc_feature: Coding regions on vcDNA: vcDNA=SeqID_13832; Strand=-; Position=101-292
SINTINNCLPVNCLRIQTHQINLLQLKISLFNNRHFCRVLINFLRIISPNLINKYCLYKNYYT

SEQ ID NO: 34136 - protein, 92 aa, Diabrotica virgifera
  misc_feature: Coding regions on vcDNA: vcDNA=SeqID_13833; Strand=-; Position=1-276
RLLRPCLPLRQWPLLIPHLNPHRLNLHHYLFGPLNWGLLFCPLPLDSFLVSLLCHLYFFRCVICRVQYRYCLWNSHCLYFDCDRFHLYRSML

SEQ ID NO: 34137 - protein, 52 aa, Diabrotica virgifera
  misc_feature: Coding regions on vcDNA: vcDNA=SeqID_13834; Strand=-; Position=209-367
GRCTLVLSNCDPCVHMQPIADGVSLTCLFINVGAYYRIADFSIWQPEPAKPC

SEQ ID NO: 34138 - protein, 136 aa, Diabrotica virgifera
  misc_feature: Coding regions on vcDNA: vcDNA=SeqID_13835; Strand=+; Position=1-408
  misc_feature (98)..(105): Xaa can be any naturally occurring amino acid
QETLHLTSSFKLDYTKEMTGNGSFLADLINYTTLEENNDNFGDDSDSYEDVYTFYGPFSKVVNIFKDIILSLFILVLDCILLYLFCSFSKIRKKYNVXXXXXXXXDAFAQIKSIIDFLFIYTLSVNQYYKFSYVIF

SEQ ID NO: 34139 - protein, 56 aa, Diabrotica virgifera
  misc_feature: Coding regions on vcDNA: vcDNA=SeqID_13836; Strand=+; Position=4-175
  misc_feature (42)..(42): Xaa can be any naturally occurring amino acid
MLKGTLLALALGGIAAIARKALMTGLISHLLSVIIGLKAITXTNVATTYEIISKPV

SEQ ID NO: 34140 - protein, 38 aa, Diabrotica virgifera
  misc_feature: Coding regions on vcDNA: vcDNA=SeqID_13837; Strand=+; Position=52-168
TVSRSVRKHYRVKQKMTRKLFHKKKGLNALLENSTQAL

SEQ ID NO: 34141 - protein, 50 aa, Diabrotica virgifera
  misc_feature: Coding regions on vcDNA: vcDNA=SeqID_13838; Strand=+; Position=150-299
  misc_feature (1)..(1): Xaa can be any naturally occurring amino acid
  misc_feature (34)..(39): Xaa can be any naturally occurring amino acid
XNYRIIHTKMSTMDDSADKEASEVLHTLLAVQRXXXXXXVVENHTYQTST

SEQ ID NO: 34142 - protein, 133 aa, Diabrotica virgifera
  misc_feature: Coding regions on vcDNA: vcDNA=SeqID_13839; Strand=+; Position=2-400
  misc_feature (18)..(24): Xaa can be any naturally occurring amino acid
  misc_feature (59)..(68): Xaa can be any naturally occurring amino acid
  misc_feature (105)..(105): Xaa can be any naturally occurring amino acid
  misc_feature (112)..(112): Xaa can be any naturally occurring amino acid
QGLLTQQQYLPQQYLSGXXXXXXXMNTNQILSQIYRQQLGQSPLNRYLVNMRLVNGEQXXXXXXXXXXVQLLEKLFAKQELINQELTEITERRQQVTEDVHYQQXMINEQIXKLIEQLAYHQNLITREVEQYI

SEQ ID NO: 34143 - protein, 126 aa, Diabrotica virgifera
  misc_feature: Coding regions on vcDNA: vcDNA=SeqID_13840; Strand=+; Position=2-379
  misc_feature: Homolog annotation: Hit_ID=XP_316463.1; Match level="QueryCoverage =95%, HitCoverage=9%, E-value=4e-24, Identity=50%"; Hit description =ENSANGP00000004277 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
PTSPAVRSPMLGHLNSSLDGLSTIRAFKAEDTISTEFDRHQDLYTSANYASECCQRAFGYYLDVCCTRFIGAIIAAFIIVGKETAVGDVGLAITQAFMLNGIAHYAITLWADIENIMTSVEWILEY

SEQ ID NO: 34144 - protein, 51 aa, Diabrotica virgifera
  misc_feature: Coding regions on vcDNA: vcDNA=SeqID_13841; Strand=+; Position=69-224
SLISMVRGYFIFTHVTLYFSYLVYHGFLLNSYTFMIFRLQSRYSINTCIVL

SEQ ID NO: 34145 - protein, 35 aa, Diabrotica virgifera
  misc_feature: Coding regions on vcDNA: vcDNA=SeqID_13842; Strand=-; Position=206-313
TLSFSAAIKWQLNICKTNRHNQIYLEHTAFKIMTN

SEQ ID NO: 34146 - protein, 113 aa, Diabrotica virgifera
  misc_feature: Coding regions on vcDNA: vcDNA=SeqID_13843; Strand=+; Position=34-372
  misc_feature: Homolog annotation: Hit_ID=XP_424651.1; Match level="QueryCoverage =86%, HitCoverage=34%, E-value=3e-12, Identity=38%"; Hit description =PREDICTED: similar to PRUNEM1, partial [Gallus gallus]
MESFIEYLQFVKKSLENLDSFGEIHIVLGNESCDIDSSVSATALAYLLHISRPKHISKEALVVAVQNVPAENFLFRTDNCFLYREIQLPLDYLVCRDQIDFDYLVKSKKVTTT

SEQ ID NO: 34147 - protein, 109 aa, Diabrotica virgifera
  misc_feature: Coding regions on vcDNA: vcDNA=SeqID_13844; Strand=+; Position=1-327
THKSAATSNGPVSLPQVSPAGQNSQTNQFNDMLKQNRIPPSPSSFVQHTQSMSQSNQQNVAQNSTSRIPTTSSDSVATPLATSAGPKSVSSSKGASPAPATPVQPSHQL

SEQ ID NO: 34148 - protein, 46 aa, Diabrotica virgifera
  misc_feature: Coding regions on vcDNA: vcDNA=SeqID_13845; Strand=+; Position=2-142
  misc_feature (4)..(15): Xaa can be any naturally occurring amino acid
  misc_feature (20)..(40): Xaa can be any naturally occurring amino acid
LVNXXXXXXXXXXXXQYLIXXXXXXXXXXXXXXXXXXXXXHIPKYI

SEQ ID NO: 34149 - protein, 119 aa, Diabrotica virgifera
  misc_feature: Coding regions on vcDNA: vcDNA=SeqID_13846; Strand=+; Position=1-357
  misc_feature (2)..(22): Xaa can be any naturally occurring amino acid
  misc_feature (24)..(40): Xaa can be any naturally occurring amino acid
  misc_feature (44)..(116): Xaa can be any naturally occurring amino acid
LXXXXXXXXXXXXXXXXXXXXXMXXXXXXXXXXXXXXXXXVSRXXXXXXXXXXXXXXXXXXXXXXXXXXXXXXXXXXXXXXXXXXXXXXXXXXXXXXXXXXXXXXXXXXXXXXXXXDEL

SEQ ID NO: 34150 - protein, 92 aa, Diabrotica virgifera
  misc_feature: Coding regions on vcDNA: vcDNA=SeqID_13847; Strand=+; Position=97-375
  misc_feature: Homolog annotation: Hit_ID=XP_395606.1; Match level="QueryCoverage =86%, HitCoverage=49%, E-value=7e-14, Identity=54%"; Hit description =similar to CG13623-PA [Apis mellifera]
  misc_feature: Gene Ontology Annotation: Molecular function=molecular_function unknown
  misc_feature: Pfam annotation: Pfam_ID=HesB; Match level="Score=-35.1, E-value =0.025, Copies=1"; Pfam description=HesB-like domain
MFPRLVRRVLVQRSYYSSQVNSNVQMNPNIKPLENIKADLNITDSCVKRLKKITSDTNEVLRVSVEGGGCSGFQYKFDLDTKIEAEWCDSGG

SEQ ID NO: 34151 - protein, 70 aa, Diabrotica virgifera
  misc_feature: Coding regions on vcDNA: vcDNA=SeqID_13848; Strand=-; Position=188-400
  misc_feature (3)..(3): Xaa can be any naturally occurring amino acid
QIXMFQYIYSTSYYYLSLYQDIDQGASVKLLVHFDVESDSTLFCRNCLKITQTTIFELSSVSKMSGTLFK

SEQ ID NO: 34152 - protein, 53 aa, Diabrotica virgifera
  misc_feature: Coding regions on vcDNA: vcDNA=SeqID_13849; Strand=+; Position=1-159
NGAWGRRPRCVCPSRFCWSGRRCSASWSGVAVWCPGNLSLLSSVCCRLMLFSG

SEQ ID NO: 34153 - protein, 39 aa, Diabrotica virgifera
  misc_feature: Coding regions on vcDNA: vcDNA=SeqID_13850; Strand=-; Position=145-264
AVFPSSLLVDVHFALNIIPILVQSRLKLHSYGCCADIRQ

SEQ ID NO: 34154 - protein, 52 aa, Diabrotica virgifera
  misc_feature: Coding regions on vcDNA: vcDNA=SeqID_13851; Strand=+; Position=78-236
  misc_feature (7)..(13): Xaa can be any naturally occurring amino acid
  misc_feature (42)..(49): Xaa can be any naturally occurring amino acid
ARLFNQXXXXXXXFVVLHLFKFHLIVFVNHNGTFLNNNVIFXXXXXXXXFLK

SEQ ID NO: 34155 - protein, 49 aa, Diabrotica virgifera
  misc_feature: Coding regions on vcDNA: vcDNA=SeqID_13852; Strand=+; Position=2-148
  misc_feature (23)..(28): Xaa can be any naturally occurring amino acid
TMLPSITTSLVSVRTWFLWCHLXXXXXXGVNGRGDGGNYCVLCIMAYYI

SEQ ID NO: 34156 - protein, 44 aa, Diabrotica virgifera
  misc_feature: Coding regions on vcDNA: vcDNA=SeqID_13853; Strand=-; Position=133-267
  misc_feature (33)..(39): Xaa can be any naturally occurring amino acid
FSLFFKYHNIVPIVTVLCVVQSYIIIRFRLLTXXXXXXXVFLVI

SEQ ID NO: 34157 - protein, 20 aa, Diabrotica virgifera
  misc_feature: Coding regions on vcDNA: vcDNA=SeqID_13854; Strand=-; Position=3-62
RGHPRSSHRSRPRRTIINER

SEQ ID NO: 34158 - protein, 52 aa, Diabrotica virgifera
  misc_feature: Coding regions on vcDNA: vcDNA=SeqID_13855; Strand=+; Position=60-215
  misc_feature: Homolog annotation: Hit_ID=CAC44155.1; Match level="QueryCoverage =100%, HitCoverage=36%, E-value=1e-15, Identity=73%"; Hit description= putative ribosomal protein L4B protein [Oncorhynchus mykiss]
  misc_feature: Gene Ontology Annotation: Molecular function=structural constituent of ribosome; Cellular component=cytosolic large ribosomal subunit (sensu Eukarya); Biological process=protein biosynthesis
SIGGSAGHQRSAESWGTGRTVARVRHVAGGGTHRSGQGAFRTTCRRGRMFAP

SEQ ID NO: 34159 - protein, 113 aa, Diabrotica virgifera
  misc_feature: Coding regions on vcDNA: vcDNA=SeqID_13856; Strand=+; Position=1-339
  misc_feature: Homolog annotation: Hit_ID=XP_314268.1; Match level="QueryCoverage =99%, HitCoverage=5%, E-value=1e-44, Identity=73%"; Hit description =ENSANGP00000000964 [Anopheles gambiae]
  misc_feature: Gene Ontology Annotation: Molecular function=protein tyrosine/serine/threonine phosphatase activity; Cellular component =integral to membrane; Biological process=protein amino acid dephosphorylation
  misc_feature: Pfam annotation: Pfam_ID=PH; Match level="Score=54.0, E-value=4.2e -13, Copies=1"; Pfam description=PH domain
QTSSQQYYDQFSSNVAEDRTHEGYLYKRGALLKGWKQRWFVLDSIKHQLRYYDAMEDSHCKGYIDLAEVISVNPAPPAPGPPKKTDDKSFFDLRTSRRTYNFCATDATSAQEW

SEQ ID NO: 34160 - protein, 38 aa, Diabrotica virgifera
  misc_feature: Coding regions on vcDNA: vcDNA=SeqID_13857; Strand=+; Position=106-222
LLQANRYKVLTEPISKAVLNHLELSAIFIVTIYAVHFY

SEQ ID NO: 34161 - protein, 59 aa, Diabrotica virgifera
  misc_feature: Coding regions on vcDNA: vcDNA=SeqID_13858; Strand=+; Position=149-328
CRIIRFELIYTSIQLTFFLLNLKVPQTSNCLLILTPFNIVNFIKVTSSHNVDVPLKVRI

SEQ ID NO: 34162 - protein, 87 aa, Diabrotica virgifera
  misc_feature: Coding regions on vcDNA: vcDNA=SeqID_13859; Strand=+; Position=130-391
  misc_feature: Homolog annotation: Hit_ID=XP_308411.1; Match level="QueryCoverage =88%, HitCoverage=8%, E-value=3e-09, Identity=45%"; Hit description =ENSANGP00000009455 [Anopheles gambiae]
  misc_feature (26)..(26): Xaa can be any naturally occurring amino acid
DRRITFTKSHWCEIPEVVKSTVLSTXALNRFKLQEAKFESNTSEASYIHSLNVLADHFDKKFIHSIIVYEIEFEIICGSIKSVRACS

SEQ ID NO: 34163 - protein, 47 aa, Diabrotica virgifera
  misc_feature: Coding regions on vcDNA: vcDNA=SeqID_13860; Strand=-; Position=58-201
AVKDSATAIVVANAIKYAANAKNYAFFVILSATRAFSIKTSNYSLVT

SEQ ID NO: 34164 - protein, 84 aa, Diabrotica virgifera
  misc_feature: Coding regions on vcDNA: vcDNA=SeqID_13861; Strand=+; Position=81-335
SILDLLVSFFANYHELCLLCVYIESILLTVIRGFTSFTKITILWIHHLHIWCYLAGTCLVDCLFWLRVNLLILTYSMCSRLGKI

SEQ ID NO: 34165 - protein, 114 aa, Diabrotica virgifera
  misc_feature: Coding regions on vcDNA: vcDNA=SeqID_13862; Strand=+; Position=60-401
  misc_feature (94)..(100): Xaa can be any naturally occurring amino acid
MNMNSVTLVFVLLQLFSYMYIITSDINVELSRVWGPGLTPEKIVMPARYFFVELVDVNNRRIISDDIELNAIVDGGTKTNKPCRIWTNLLNRKXXXXXXXYKLYETCSYVKISV

SEQ ID NO: 34166 - protein, 139 aa, Diabrotica virgifera
  misc_feature: Coding regions on vcDNA: vcDNA=SeqID_13863; Strand=+; Position=1-417
  misc_feature: Homolog annotation: Hit_ID=XP_315949.1; Match level="QueryCoverage =94%, HitCoverage=29%, E-value=7e-55, Identity=81%"; Hit description =ENSANGP00000013589 [Anopheles gambiae]
  misc_feature: Gene Ontology Annotation: Molecular function=zinc ion transporter activity; Cellular component=plasma membrane; Biological process =zinc ion transport
  misc_feature (14)..(24): Xaa can be any naturally occurring amino acid
  misc_feature (101)..(101): Xaa can be any naturally occurring amino acid
TLGSVIVIVSALVXXXXXXXXXXXIDSALSVLLVLLILNSVWPLLRDSALILLQTVPTHIQVDAIQSRLLSKVDGVLAVHEFHVWQLAGDRIIASAHIRCXNLSEYMKIAEKVKEFFHNEGIHSTTIQPEFIDYTDIPT

SEQ ID NO: 34167 - protein, 18 aa, Diabrotica virgifera
  misc_feature: Coding regions on vcDNA: vcDNA=SeqID_13864; Strand=-; Position=1-54
ASTFMVDNEAIYYVCRCL

SEQ ID NO: 34168 - protein, 51 aa, Diabrotica virgifera
  misc_feature: Coding regions on vcDNA: vcDNA=SeqID_13865; Strand=-; Position=3-155
  misc_feature (45)..(51): Xaa can be any naturally occurring amino acid
APLNRSPIPSSTSAPSATLATGPPCNVCFRRVDHINLFEINLSTXXXXXXX

SEQ ID NO: 34169 - protein, 110 aa, Diabrotica virgifera
  misc_feature: Coding regions on vcDNA: vcDNA=SeqID_13866; Strand=+; Position=59-391
  misc_feature (4)..(18): Xaa can be any naturally occurring amino acid
  misc_feature (47)..(47): Xaa can be any naturally occurring amino acid
  misc_feature (73)..(83): Xaa can be any naturally occurring amino acid
  misc_feature (87)..(94): Xaa can be any naturally occurring amino acid
  misc_feature (104)..(109): Xaa can be any naturally occurring amino acid
RQIXXXXXXXXXXXXXXXLITEKFILCTLCIMDSHLISTYLLFSNLXELRDYNFYCTTNILPNFFAMKCYSLXXXXXXXXXXXTLLXXXXXXXXYLYIINSKSXXXXXXP

SEQ ID NO: 34170 - protein, 58 aa, Diabrotica virgifera
  misc_feature: Coding regions on vcDNA: vcDNA=SeqID_13867; Strand=+; Position=3-179
ATLLSSIFCIILATQTFLTILFFILFNFLSFRLWLWTFIFLSLELNLKYSLLYFILTL

SEQ ID NO: 34171 - protein, 65 aa, Diabrotica virgifera
  misc_feature: Coding regions on vcDNA: vcDNA=SeqID_13868; Strand=-; Position=208-405
  misc_feature (16)..(23): Xaa can be any naturally occurring amino acid
MYSKKIYCRDSCQNFXXXXXXXXLSLQPRTIQTNRTLRMITNYYELAGLQLRHDFRMCNILSCYL

SEQ ID NO: 34172 - protein, 73 aa, Diabrotica virgifera
  misc_feature: Coding regions on vcDNA: vcDNA=SeqID_13869; Strand=+; Position=163-381
  misc_feature: Homolog annotation: Hit_ID=AAV34816.1; Match level="QueryCoverage =100%, HitCoverage=27%, E-value=2e-20, Identity=64%"; Hit description= ribosomal protein L7 [Bombyx mori]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L30; Match level="Score=8.3, E -value=0.0085, Copies=1"; Pfam description=Ribosomal protein L30p/L7e
  misc_feature (17)..(17): Xaa can be any naturally occurring amino acid
  misc_feature (31)..(31): Xaa can be any naturally occurring amino acid
DIFKRAEQYVNEYRLKXRDEVMLVRQSKTRXDFHVPAEAKQASVVRIQGITKVTAKVRKVLQLFRIHQISNGV

SEQ ID NO: 34173 - protein, 123 aa, Diabrotica virgifera
  misc_feature: Coding regions on vcDNA: vcDNA=SeqID_13870; Strand=+; Position=17-384
  misc_feature: Homolog annotation: Hit_ID=XP_391936.1; Match level="QueryCoverage =93%, HitCoverage=31%, E-value=5e-31, Identity=53%"; Hit description =similar to putative alpha-tubulin [Apis mellifera]
  misc_feature: Gene Ontology Annotation: Molecular function=GTP binding; Cellular component=microtubule; Biological process=microtubule-based process
  misc_feature (36)..(36): Xaa can be any naturally occurring amino acid
  misc_feature (58)..(58): Xaa can be any naturally occurring amino acid
SAGQSSFCINCGDNSLNTSLKILACISVHVGQAGVXIGNACWELSCPQHGIEPGSQIXSYITVGGRDDSFITFFNETGARIHVPKSVLVHLELRVLDEVRTGKYRQLFQSDYLITGNQHDGNY

SEQ ID NO: 34174 - protein, 140 aa, Diabrotica virgifera
  misc_feature: Coding regions on vcDNA: vcDNA=SeqID_13871; Strand=+; Position=3-422
  misc_feature (22)..(22): Xaa can be any naturally occurring amino acid
LEKKENNNKQESVTTRSISAFXKDRKVKFVQEVDNSLNESQESHNQTLHSTKVVKNVNSESITKPEPNLHHLKIEDLNVIEKINPIISTAKDVKNSVNDTKKLIENNELNTSFKCPKNAVQFYTSWKNFRTTEEKYTYLK

SEQ ID NO: 34175 - protein, 59 aa, Diabrotica virgifera
  misc_feature: Coding regions on vcDNA: vcDNA=SeqID_13872; Strand=-; Position=107-286
LTRWLVLLWSLEYAKVIPEGGFINLQSYDWSILTHECDLDSSWNLQISTNGSPGTLRVD

SEQ ID NO: 34176 - protein, 95 aa, Diabrotica virgifera
  misc_feature: Coding regions on vcDNA: vcDNA=SeqID_13873; Strand=-; Position=1-285
  misc_feature (3)..(95): Xaa can be any naturally occurring amino acid
KRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34177 - protein, 91 aa, Diabrotica virgifera
  misc_feature: Coding regions on vcDNA: vcDNA=SeqID_13874; Strand=+; Position=3-275
  misc_feature (2)..(7): Xaa can be any naturally occurring amino acid
TXXXXXXELTLSIASGSKTINFIKKVYRAFFALGECFYQLLLSRCNGGFPPPRWGGNHPHGGGAFRRRMDFDPWTVHCLFSDFRANRFILV

SEQ ID NO: 34178 - protein, 98 aa, Diabrotica virgifera
  misc_feature: Coding regions on vcDNA: vcDNA=SeqID_13875; Strand=+; Position=112-408
  misc_feature: Homolog annotation: Hit_ID=XP_392782.1; Match level="QueryCoverage =89%, HitCoverage=17%, E-value=6e-21, Identity=54%"; Hit description =similar to putative glycerol kinase [Apis mellifera]
  misc_feature: Gene Ontology Annotation: Molecular function=glycerol kinase activity; Cellular component=mitochondrial outer membrane; Biological process=glycerol metabolism
MSQDEDLEQNLIGVIDAGTRTVQFCVFRTEHTKEIAKHTVDITTAVPQEGWSEQDPREILRAVETCMENVAKSLGSEASENIVTIGIYQQRETTIVWE

SEQ ID NO: 34179 - protein, 102 aa, Diabrotica virgifera
  misc_feature: Coding regions on vcDNA: vcDNA=SeqID_13876; Strand=+; Position=3-398
  misc_feature: Homolog annotation: Hit_ID=XP_392839.1; Match level="QueryCoverage =96%, HitCoverage=5%, E-value=2e-11, Identity=45%"; Hit description =similar to ENSANGP00000009824 [Apis mellifera]
ITSSTAPAPVSGGYQIENQNSQDSQASSQPFTTLPPILNINEIFQNLVASGLVKSSPPSKPVEEPPKKTVLSLKPVTFNRPETLRVRQNSLYAMLYSGMQCS

SEQ ID NO: 34180 - protein, 70 aa, Diabrotica virgifera
  misc_feature: Coding regions on vcDNA: vcDNA=SeqID_13877; Strand=-; Position=32-244
KTLFHRQFMSLRSFQRLSLQRIISWTILGTHVFTHLNCHVLNLLHNLSQILLERMIYVHAVEEIPDVTCF

SEQ ID NO: 34181 - protein, 136 aa, Diabrotica virgifera
  misc_feature: Coding regions on vcDNA: vcDNA=SeqID_13878; Strand=+; Position=3-410
  misc_feature: Homolog annotation: Hit_ID=AAC24982.2; Match level="QueryCoverage =75%, HitCoverage=10%, E-value=1e-09, Identity=37%"; Hit description =reverse transcriptase [synthetic construct]
HASVEIDGISIEQVMEVKYLGITLSSYGDLDKEVRNQVQKANRLAGLNHTIWRNRHINTEMKSRIYKTSVRQIIAYASETRPDTATTQRLLKTAEMRLLRRITGNTLRDRGSEDIRRQCNVQCKNEWTSNPHTRMV

SEQ ID NO: 34182 - protein, 70 aa, Diabrotica virgifera
  misc_feature: Coding regions on vcDNA: vcDNA=SeqID_13879; Strand=-; Position=0-209
RGVTRDNYFYVILDKITDACRGYIIHLLIGALEDLGSGNSFLISSKQLEKANNLTATRCIQDTLTNFFFL

SEQ ID NO: 34183 - protein, 93 aa, Diabrotica virgifera
  misc_feature: Coding regions on vcDNA: vcDNA=SeqID_13880; Strand=+; Position=2-283
RDNAGLINPPSNNPSSNSVFSLVQSDPMPSFAGLGTAPLSRISPGKPWPSMPVNYANFSSVTTTDNQIVNIRPEIPGRINPSFITPSSNSVPS

SEQ ID NO: 34184 - protein, 69 aa, Diabrotica virgifera
  misc_feature: Coding regions on vcDNA: vcDNA=SeqID_13881; Strand=-; Position=2-208
  misc_feature (20)..(26): Xaa can be any naturally occurring amino acid
  misc_feature (28)..(60): Xaa can be any naturally occurring amino acid
IFYSGYYIFDYIYEISLKNXXXXXXXFXXXXXXXXXXXXXXXXXXXXXXXXXXXXXXXXXHASAHASLD

SEQ ID NO: 34185 - protein, 131 aa, Diabrotica virgifera
  misc_feature: Coding regions on vcDNA: vcDNA=SeqID_13882; Strand=-; Position=0-392
  misc_feature (1)..(130): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 34186 - protein, 79 aa, Diabrotica virgifera
  misc_feature: Coding regions on vcDNA: vcDNA=SeqID_13883; Strand=-; Position=51-290
  misc_feature (20)..(27): Xaa can be any naturally occurring amino acid
  misc_feature (34)..(43): Xaa can be any naturally occurring amino acid
  misc_feature (52)..(64): Xaa can be any naturally occurring amino acid
IQIQLKNISLPSRKTNMYLXXXXXXXXCTMLVNXXXXXXXXXXNKVKNKASXXXXXXXXXXXXXYSKNWIGSFHNIFIS

SEQ ID NO: 34187 - protein, 54 aa, Diabrotica virgifera
  misc_feature: Coding regions on vcDNA: vcDNA=SeqID_13884; Strand=+; Position=63-227
  misc_feature (33)..(39): Xaa can be any naturally occurring amino acid
IYALYVYLYELFAKTSFLQERNLLKFQGLQFRXXXXXXXRTANEVICGPKFLPI

SEQ ID NO: 34188 - protein, 59 aa, Diabrotica virgifera
  misc_feature: Coding regions on vcDNA: vcDNA=SeqID_13885; Strand=-; Position=37-216
RVSRHIDFKGEPLMLNTSTIFNFFALLLIIYNSSQVARLFNALYLNLRSISVQMGYRYR

SEQ ID NO: 34189 - protein, 100 aa, Diabrotica virgifera
  misc_feature: Coding regions on vcDNA: vcDNA=SeqID_13886; Strand=+; Position=99-398
MEPMTLGSAPSSPASPAANRNFLPGFLIGGDNQIPSGNPSISPGRNKTPGTGGKTPANEPNGFRQKLFNHQLNESAGYTPAPEKGGPPKLRLLGNLKHKE

SEQ ID NO: 34190 - protein, 49 aa, Diabrotica virgifera
  misc_feature: Coding regions on vcDNA: vcDNA=SeqID_13887; Strand=-; Position=60-209
  misc_feature (1)..(42): Xaa can be any naturally occurring amino acid
XXXXXXXXXXXXXXXXXXXXXXXXXXXXXXXXXXXXXXXXXXKRPIKLN

SEQ ID NO: 34191 - protein, 137 aa, Diabrotica virgifera
  misc_feature: Coding regions on vcDNA: vcDNA=SeqID_13888; Strand=+; Position=30-440
  misc_feature: Homolog annotation: Hit_ID=XP_310947.1; Match level="QueryCoverage =84%, HitCoverage=30%, E-value=8e-34, Identity=57%"; Hit description =ENSANGP00000019345 [Anopheles gambiae]
  misc_feature: Gene Ontology Annotation: Molecular function=uridine phosphorylase activity; Biological process=nucleobase, nucleoside, nucleotide and nucleic acid metabolism
MKCKCACLNPNSDENEGKPTKNPHLSKMQNDYLYHIALDTETMNLVDAFQDTKFVCMGGSPTRMYAFAKLIAHEIGHELPFGTKLMDISEKADRFAMFKVGPVISVSHGMGCPSIGILLNELIKLMYYAKCKNPVFF

SEQ ID NO: 34192 - protein, 125 aa, Diabrotica virgifera
  misc_feature: Coding regions on vcDNA: vcDNA=SeqID_13889; Strand=+; Position=58-432
  misc_feature (1)..(7): Xaa can be any naturally occurring amino acid
XXXXXXXSLYFMLTMEFKAEVKEEFVFVECNQIDIESQPEPSTSISIEQEHKNEPEEWNSGLLYKAIYCDSAMEVKPEIKKEFDQNDQGYVEPLLLTSIELRELKKEIDEDKPGFSHNGMEIMNS

SEQ ID NO: 34193 - protein, 25 aa, Diabrotica virgifera
  misc_feature: Coding regions on vcDNA: vcDNA=SeqID_13890; Strand=-; Position=0-74
QCSLMVASVFRQSKRPMAWPKGRST

SEQ ID NO: 34194 - protein, 29 aa, Diabrotica virgifera
  misc_feature: Coding regions on vcDNA: vcDNA=SeqID_13891; Strand=-; Position=1-87
  misc_feature (11)..(27): Xaa can be any naturally occurring amino acid
QGTQNKCVLYXXXXXXXXXXXXXXXXXLF

SEQ ID NO: 34195 - protein, 55 aa, Diabrotica virgifera
  misc_feature: Coding regions on vcDNA: vcDNA=SeqID_13892; Strand=+; Position=2-169
  misc_feature (2)..(11): Xaa can be any naturally occurring amino acid
RXXXXXXXXXXIYIYCTNVKIIYIVIFPTLDNIYATLQCEITFTMDGDTALFILA

SEQ ID NO: 34196 - protein, 51 aa, Diabrotica virgifera
  misc_feature: Coding regions on vcDNA: vcDNA=SeqID_13893; Strand=+; Position=92-247
IQLCSRGIILSAFNIHIIDIGTSCSQRLIVSNLMYLKALIRESLRTFIGYQ

SEQ ID NO: 34197 - protein, 61 aa, Diabrotica virgifera
  misc_feature: Coding regions on vcDNA: vcDNA=SeqID_13894; Strand=-; Position=75-260
IHWVVSIGPPVTSWVYLAVLGLFTDVQGPCRISPLGLILSIVSFRLIRKVTHPLIQEGVID

SEQ ID NO: 34198 - protein, 60 aa, Diabrotica virgifera
  misc_feature: Coding regions on vcDNA: vcDNA=SeqID_13895; Strand=-; Position=52-234
QLLESLLLPLLHSIGLWLKSIRGSKSPVSLIECSWLPSPSVFNFQSLHFHFQRVHQTFTF

SEQ ID NO: 34199 - protein, 84 aa, Diabrotica virgifera
  misc_feature: Coding regions on vcDNA: vcDNA=SeqID_13896; Strand=-; Position=1-252
IVVCPKTLHWRWNCSFVIRPRFRNCHYSCNISNQVDSLSMWISLFRSSSTKDFFRVINCDIVPVLDNKSALILCISVAFSLMSA

SEQ ID NO: 34200 - protein, 40 aa, Diabrotica virgifera
  misc_feature: Coding regions on vcDNA: vcDNA=SeqID_13897; Strand=+; Position=13-135
MQWHARLVTFRRGSGVRDFTVTFPSIFDFNKLAFHSRDLR

SEQ ID NO: 34201 - protein, 82 aa, Diabrotica virgifera
  misc_feature: Coding regions on vcDNA: vcDNA=SeqID_13898; Strand=+; Position=93-341
  misc_feature (15)..(15): Xaa can be any naturally occurring amino acid
  misc_feature (36)..(45): Xaa can be any naturally occurring amino acid
ITFQMSCHTTHILIXKNYRLRHYAQMEDVTSMIYMXXXXXXXXXXDLIRNLSPESPVLEKTNLFNSNVLTVPITSEAYILKP

SEQ ID NO: 34202 - protein, 105 aa, Diabrotica virgifera
  misc_feature: Coding regions on vcDNA: vcDNA=SeqID_13899; Strand=+; Position=4-321
  misc_feature: Homolog annotation: Hit_ID=BAB88642.1; Match level="QueryCoverage =54%, HitCoverage=18%, E-value=7e-10, Identity=54%"; Hit description =NADH dehydrogenase subunit 5 [Leptura aethiops]
  misc_feature (40)..(47): Xaa can be any naturally occurring amino acid
  misc_feature (56)..(56): Xaa can be any naturally occurring amino acid
  misc_feature (86)..(86): Xaa can be any naturally occurring amino acid
GYELANQTPTIIKIKVIIFTRIGRQIKIGVENTNHENKLXXXXXXXXLIFIIVGVXLGYELAKVKIAYNLLRLNNISRVLFLRIIXNIPFLSTLGINYYPIYFGG

SEQ ID NO: 34203 - protein, 48 aa, Diabrotica virgifera
  misc_feature: Coding regions on vcDNA: vcDNA=SeqID_13900; Strand=-; Position=37-183
VQDTSGIYTMWAKLYFIMIYLYNVVIYHYVKLLKSCNVIRLKERETAL

SEQ ID NO: 34204 - protein, 25 aa, Diabrotica virgifera
  misc_feature: Coding regions on vcDNA: vcDNA=SeqID_13901; Strand=-; Position=1-75
ATFHPVNTNTKLFYTKGESKKSMFM

SEQ ID NO: 34205 - protein, 65 aa, Diabrotica virgifera
  misc_feature: Coding regions on vcDNA: vcDNA=SeqID_13902; Strand=-; Position=2-196
PTDCNHPCIFRSPTVIRSDICAVQRNNLRSMSHVPEKRRITSVCFALSHRLHSVIACPVILTDAS

SEQ ID NO: 34206 - protein, 89 aa, Diabrotica virgifera
  misc_feature: Coding regions on vcDNA: vcDNA=SeqID_13903; Strand=+; Position=99-366
  misc_feature: Homolog annotation: Hit_ID=AAH86701.1; Match level="QueryCoverage =100%, HitCoverage=19%, E-value=1e-23, Identity=58%"; Hit description= Zgc:101545 [Danio rerio] ref|NP_001008638.1| zgc:101545 [Danio rerio] sp|P02993|EF1A_ARTSA Elongation fac
  misc_feature: Gene Ontology Annotation: Molecular function=translation factor activity, nucleic acid binding; Biological process=protein biosynthesis
  misc_feature (54)..(54): Xaa can be any naturally occurring amino acid
  misc_feature (74)..(74): Xaa can be any naturally occurring amino acid
MGTELIHITSIATGHIDSGRSTTTGHLTLNCGGIDKLTIKKLHREAHKYRKGSXTYSWVLDKLKADRDPSITTXNALWTCQAAQYQVTI

SEQ ID NO: 34207 - protein, 42 aa, Diabrotica virgifera
  misc_feature: Coding regions on vcDNA: vcDNA=SeqID_13904; Strand=-; Position=73-201
  misc_feature (5)..(28): Xaa can be any naturally occurring amino acid
KHGEXXXXXXXXXXXXXXXXXXXXXXXXDQQMMLSPPQYSSY

SEQ ID NO: 34208 - protein, 65 aa, Diabrotica virgifera
  misc_feature: Coding regions on vcDNA: vcDNA=SeqID_13905; Strand=+; Position=138-332
HRESNRIIPETDTHTYLVRTDTQNASGDNSKYAKYPVEDDTLKNHTLLQEEMNHGSDNDGNGRQD

SEQ ID NO: 34209 - protein, 40 aa, Diabrotica virgifera
  misc_feature: Coding regions on vcDNA: vcDNA=SeqID_13906; Strand=+; Position=2-121
SNKTTSKPGSVWEKNFSGLRQQQNPGKENLIKGTHNFKFF

SEQ ID NO: 34210 - protein, 148 aa, Diabrotica virgifera
  misc_feature: Coding regions on vcDNA: vcDNA=SeqID_13907; Strand=+; Position=3-446
QTNPQRGKAQNVACQNFQLSLEVHTEGKKLQISMYPSTQKLKMCGAVAVSQKVTGLSEKYRPEPLRSHKKIDNNHLPVYKDTHLVQRASIAESPSKEVAPPLQPRQMRVNQSMRARISSDHKSGSTKVREARSSSISQSKASYLTNRH

SEQ ID NO: 34211 - protein, 96 aa, Diabrotica virgifera
  misc_feature: Coding regions on vcDNA: vcDNA=SeqID_13908; Strand=-; Position=24-314
  misc_feature (4)..(9): Xaa can be any naturally occurring amino acid
QSHXXXXXXIQHKVLRYCAFKSYLAIVSHDYSTVESHLSLLPLRLRRDISGAIFIHNVGLIGKLLKSQIENFTGETKHCGTCHVQKTTTVLKKKIA

SEQ ID NO: 34212 - protein, 57 aa, Diabrotica virgifera
  misc_feature: Coding regions on vcDNA: vcDNA=SeqID_13909; Strand=+; Position=49-222
SKFKGFPVLICNRFHSKIDNNSITPFAFFIINRNIRRDKLQCILVKFLLSIISVKYK

SEQ ID NO: 34213 - protein, 132 aa, Diabrotica virgifera
  misc_feature: Coding regions on vcDNA: vcDNA=SeqID_13910; Strand=+; Position=8-403
  misc_feature: Homolog annotation: Hit_ID=EAA11236.3; Match level="QueryCoverage =89%, HitCoverage=74%, E-value=1e-11, Identity=39%"; Hit description =ENSANGP00000017752 [Anopheles gambiae str. PEST] ref|XP_556851.1| ENSANGP00000017752 [Anopheles gambiae st
MGFIFVTFCALVAVAKAGIYGETYAAPLSYAAPVAKVAYSEAPAVSYSSVSALVAYAAPGIAKVAARISYSAPAFSYSALPVIVAAPVAYAAPAYIVAAPVAYAAPIDTAVYAEPSAPAHYDFGYAVRDAHT

SEQ ID NO: 34214 - protein, 53 aa, Diabrotica virgifera
  misc_feature: Coding regions on vcDNA: vcDNA=SeqID_13911; Strand=-; Position=35-196
RIAESTFYLLNYLFKINCCASTKIIDWCILNVTDLTWLSSTYLQTMVKISLVP

SEQ ID NO: 34215 - protein, 154 aa, Diabrotica virgifera
  misc_feature: Coding regions on vcDNA: vcDNA=SeqID_13912; Strand=+; Position=1-462
  misc_feature: Homolog annotation: Hit_ID=XP_397128.1; Match level="QueryCoverage =98%, HitCoverage=31%, E-value=2e-33, Identity=45%"; Hit description =similar to ENSANGP00000006836 [Apis mellifera]
  misc_feature: Gene Ontology Annotation: Biological process=hemocyte differentiation
  misc_feature: Pfam annotation: Pfam_ID=RRM_1; Match level="Score=48.8, E-value=1.5e- 11, Copies=1"; Pfam description=RNA recognition motif. (a.k.a. RRM, RB
  misc_feature (18)..(25): Xaa can be any naturally occurring amino acid
  misc_feature (105)..(105): Xaa can be any naturally occurring amino acid
  misc_feature (110)..(110): Xaa can be any naturally occurring amino acid
  misc_feature (136)..(136): Xaa can be any naturally occurring amino acid
QAKDRFLSQLISENPFVXXXXXXXXNKIRKLNCTLDDLRKAISKSDMIELSECKERIKRKMPIKINENVDNCTIYVENIKADANHEWVSQIFSEFGNVVYVSIPXYRHNXTNKGFAFVEFEDEAGAKNALTYFESXGCKMPSETNPEKLKSIRH

SEQ ID NO: 34216 - protein, 147 aa, Diabrotica virgifera
  misc_feature: Coding regions on vcDNA: vcDNA=SeqID_13913; Strand=+; Position=1-441
  misc_feature: Homolog annotation: Hit_ID=EAA07634.3; Match level="QueryCoverage =98%, HitCoverage=13%, E-value=2e-42, Identity=64%"; Hit description =ENSANGP00000012174 [Anopheles gambiae str. PEST] ref|XP_563581.1| ENSANGP00000012174 [Anopheles gambiae st
  misc_feature: Gene Ontology Annotation: Molecular function=receptor activity; Cellular component=integral to plasma membrane; Biological process =larval development (sensu Insecta)
GKEDQSIFKIAKRDSPTKTIVSDLKPGTRYRLWLEVYLTNGKIKTSNVQDFITKPRTAPSLGASTQQDKLSRAEHLEPKGDYYGPLVIVAILAAIAILSTLVLLLILIRRHNQNKAAITPPSRINQSAYDNPSYKVEIQQETMGKGF

SEQ ID NO: 34217 - protein, 47 aa, Diabrotica virgifera
  misc_feature: Coding regions on vcDNA: vcDNA=SeqID_13914; Strand=+; Position=191-334
DSIQKENKFFSNLNTSLSGFVRWDAEYFMHNAKYGYTFENTLAFFPV

SEQ ID NO: 34218 - protein, 71 aa, Diabrotica virgifera
  misc_feature: Coding regions on vcDNA: vcDNA=SeqID_13915; Strand=-; Position=114-329
  misc_feature (25)..(31): Xaa can be any naturally occurring amino acid
LWFLLLYNLVSLILVFSFLQVKVFXXXXXXXESLKYSTLFMIVQKELLFFQKWMFVFHDSWFQKFVLFILE

SEQ ID NO: 34219 - protein, 25 aa, Diabrotica virgifera
  misc_feature: Coding regions on vcDNA: vcDNA=SeqID_13916; Strand=-; Position=2-76
FLLMYVIMILFHVNVFYCLYASHVF

SEQ ID NO: 34220 - protein, 148 aa, Diabrotica virgifera
  misc_feature: Coding regions on vcDNA: vcDNA=SeqID_13917; Strand=+; Position=2-445
  misc_feature: Homolog annotation: Hit_ID=AAM51136.1; Match level="QueryCoverage =99%, HitCoverage=20%, E-value=9e-39, Identity=57%"; Hit description =SD26211p [Drosophila melanogaster]
RTKDICLTYKRDDLDLTGFVDADWASNKLDRISYTGFAFKLSGGAISWKSVKQKSVALSSTEAEYVALGEATKEAIYLRNLLSEIQGTLESVVLYNDNQGAQKLCMNPVFHEKTKHIDIRHHFIREAVQNNVVELKYLCTDEMLADIL

SEQ ID NO: 34221 - protein, 129 aa, Diabrotica virgifera
  misc_feature: Coding regions on vcDNA: vcDNA=SeqID_13918; Strand=+; Position=22-411
  misc_feature: Homolog annotation: Hit_ID=XP_422430.1; Match level="QueryCoverage =93%, HitCoverage=32%, E-value=2e-34, Identity=52%"; Hit description =PREDICTED: similar to Uroporphyrinogen decarboxylase (URO-D) (UPD) [Gallus gallus]
  misc_feature: Gene Ontology Annotation: Molecular function=uroporphyrinogen decarboxylase activity; Cellular component=cellular_component unknown; Biological process=coenzymes and prosthetic group metabolism
  misc_feature: Pfam annotation: Pfam_ID=URO-D; Match level="Score=-145.0, E-value =0.00046, Copies=1"; Pfam description=Uroporphyrinogen decarboxylase (URO-D
VSSDIRQKLKDANLAQVPLVLFAKGAHFNLEDQAELGYDVLGIDWTVDPSTVRTRLKNKNITVQGNLDPCALYAPKEELENMIKEMIRSFGTDRYIVNLGHGIYPDAPVESVQTFIEAVHSINIITTKY

SEQ ID NO: 34222 - protein, 114 aa, Diabrotica virgifera
  misc_feature: Coding regions on vcDNA: vcDNA=SeqID_13919; Strand=+; Position=78-419
MDISKRSRQWKCFDFGPPTKKVDFSPKEQIKENYEPKISSSRKNIPVTGKKCFNFHEQLAPQAISELAVHPKKIQEVEDWFNRFVLDKKKNVFTPPLLLPRPNGSGKTSTINGK

SEQ ID NO: 34223 - protein, 126 aa, Diabrotica virgifera
  misc_feature: Coding regions on vcDNA: vcDNA=SeqID_13920; Strand=+; Position=67-444
KNYTPRTTMASSTPTIVGEISATDEVSQYKVEKIVLDGDLLSSSLPQLEMSVSGNSNPASSYSARKTSSVLASKKEVTPRKKSAVKKPTVSSSIPLPVIKPAKATPSAKLSSQTVKSNTGKLSKPN

SEQ ID NO: 34224 - protein, 68 aa, Diabrotica virgifera
  misc_feature: Coding regions on vcDNA: vcDNA=SeqID_13921; Strand=-; Position=52-258
  misc_feature (21)..(27): Xaa can be any naturally occurring amino acid
QNSWKSYSPATPLLESNYKIXXXXXXXMQSPQIVCYFFYKQNGADKSYFFQLLLYNSEDFNFTTKTPK

SEQ ID NO: 34225 - protein, 92 aa, Diabrotica virgifera
  misc_feature: Coding regions on vcDNA: vcDNA=SeqID_13922; Strand=+; Position=172-447
  misc_feature: Homolog annotation: Hit_ID=XP_311560.1; Match level="QueryCoverage =91%, HitCoverage=22%, E-value=9e-25, Identity=59%"; Hit description =ENSANGP00000016081 [Anopheles gambiae]
  misc_feature: Gene Ontology Annotation: Molecular function=endoplasmic reticulum receptor activity; Cellular component=integral to membrane; Biological process=cotranslational membrane targeting
YSSNIFPVRKSANKNPPILSHEFVIQNHADIVSCIAMVFVVGLMVQATSPIASIFITLQHNVTEAGEVPLYSPGVKDWACIFFYTLICVVIH

SEQ ID NO: 34226 - protein, 118 aa, Diabrotica virgifera
  misc_feature: Coding regions on vcDNA: vcDNA=SeqID_13923; Strand=+; Position=32-385
  misc_feature: Homolog annotation: Hit_ID=EAL31989.1; Match level="QueryCoverage =88%, HitCoverage=19%, E-value=1e-21, Identity=52%"; Hit description =GA20046-PA [Drosophila pseudoobscura]
  misc_feature: Gene Ontology Annotation: Molecular function=chaperone activity; Cellular component=cytoplasm; Biological process=regulation of cell cycle
  misc_feature (32)..(32): Xaa can be any naturally occurring amino acid
  misc_feature (45)..(45): Xaa can be any naturally occurring amino acid
  misc_feature (47)..(47): Xaa can be any naturally occurring amino acid
HTASEIRFYSYDDLINIVRATLSSMILSHHLXYLANMAVYAVLRXDXTGDLQSTQLFKILGGTLEDSFLDCGYLIGILPDVHHSKRVDNASFLLSISPMVTFKIIVFGSHMNVHSMAI

SEQ ID NO: 34227 - protein, 115 aa, Diabrotica virgifera
  misc_feature: Coding regions on vcDNA: vcDNA=SeqID_13924; Strand=+; Position=61-405
  misc_feature: Homolog annotation: Hit_ID=NP_650917.1; Match level="QueryCoverage =100%, HitCoverage=77%, E-value=5e-42, Identity=73%"; Hit description= CG17272-PA [Drosophila melanogaster] gb|AAF55810.2| CG17272-PA [Drosophila melanogaster]
  misc_feature: Gene Ontology Annotation: Molecular function=calcium ion binding; Cellular component=centrosome; Biological process=mitosis
  misc_feature (113)..(113): Xaa can be any naturally occurring amino acid
MAHYFKEKDIDEFRECFYLFARSGTIKTLDELTVIMRSLGLSPTKSEMTGYLKQKGGKMSFPDFLEVMYIHSKVENIPKEVVDAFKAADPGNTGKIPAKQLRYLLQNWGECLXTK

SEQ ID NO: 34228 - protein, 36 aa, Diabrotica virgifera
  misc_feature: Coding regions on vcDNA: vcDNA=SeqID_13925; Strand=-; Position=52-162
YLIKAEGDSFMCIYGTKSFKYSRYINNGLNTIYFFK

SEQ ID NO: 34229 - protein, 100 aa, Diabrotica virgifera
  misc_feature: Coding regions on vcDNA: vcDNA=SeqID_13926; Strand=-; Position=3-302
  misc_feature (8)..(51): Xaa can be any naturally occurring amino acid
  misc_feature (66)..(72): Xaa can be any naturally occurring amino acid
IYVIFFEXXXXXXXXXXXXXXXXXXXXXXXXXXXXXXXXXXXXXXXXXXXXNINSFIRYRGNSLTXXXXXXXTTIISANIFRKYPQYFLQLQTRIFPGRV

SEQ ID NO: 34230 - protein, 147 aa, Diabrotica virgifera
  misc_feature: Coding regions on vcDNA: vcDNA=SeqID_13927; Strand=+; Position=1-441
QMYNKNVIGKKNLSLMKKNFDSDSSTNSTRTEDDAEKTSVSDSDCDDTVIFKKAVSTVSPTKRYSLRSRASVDKSISPKKTPVRKKTAKTPVKKEKKTVSKGKKIANTGQDLETATNVEEVRTVLHELKPGTAMKGMTTSQTSVLED

SEQ ID NO: 34231 - protein, 145 aa, Diabrotica virgifera
  misc_feature: Coding regions on vcDNA: vcDNA=SeqID_13928; Strand=+; Position=3-437
  misc_feature: Homolog annotation: Hit_ID=XP_319748.1; Match level="QueryCoverage =96%, HitCoverage=20%, E-value=3e-55, Identity=75%"; Hit description =ENSANGP00000006368 [Anopheles gambiae]
  misc_feature: Gene Ontology Annotation: Molecular function=serine-type endopeptidase activity; Cellular component=membrane fraction; Biological process=cytoskeleton organization and biogenesis
QNQEVEPDWLAGDSNLQDLQEQDIRDRGCGVSSPHAQRRIVGGEEAGFGTFPWQAYIRIGSSRCGGSLVSRRHVVTAGHCVARATPRQVHVTLGDYVINSAVEPLPAYTFGVSTIQVHPFFKFTPQADRFDVAVLRLDRAAHNLL

SEQ ID NO: 34232 - protein, 62 aa, Diabrotica virgifera
  misc_feature: Coding regions on vcDNA: vcDNA=SeqID_13929; Strand=-; Position=2-187
TMTEAAQKRIQAFEFWCYRKMLRIFSEVLRRINKEIELMLLIKERKTQYFGHIVRNQKYELL

SEQ ID NO: 34233 - protein, 43 aa, Diabrotica virgifera
  misc_feature: Coding regions on vcDNA: vcDNA=SeqID_13930; Strand=-; Position=68-199
HFRTSYENLKLFSQRFDDSQLSFRAIPRLLLTPVATDGYISIC

SEQ ID NO: 34234 - protein, 146 aa, Diabrotica virgifera
  misc_feature: Coding regions on vcDNA: vcDNA=SeqID_13931; Strand=+; Position=1-438
  misc_feature (57)..(71): Xaa can be any naturally occurring amino acid
  misc_feature (74)..(81): Xaa can be any naturally occurring amino acid
QTRGDLSSTSAKKVRQELEEKLETNLQSRKKEIDDLVMEFVSSKQDKKKGGKKKAEXXXXXXXXXXXXXXXPSXXXXXXXXAFFAAGFLPVEAKKTSEDESANEQSDGDSEEEYSPKKAKPVKTRKLPPKKKNGSESDSDEDWGKK

SEQ ID NO: 34235 - protein, 106 aa, Diabrotica virgifera
  misc_feature: Coding regions on vcDNA: vcDNA=SeqID_13932; Strand=+; Position=3-323
  misc_feature: Homolog annotation: Hit_ID=CAC12696.1; Match level="QueryCoverage =84%, HitCoverage=22%, E-value=3e-27, Identity=60%"; Hit description =prophenoloxidase activating factor [Tenebrio molitor]
  misc_feature: Gene Ontology Annotation: Molecular function=serine-type endopeptidase activity; Cellular component=plasma membrane; Biological process=lipid metabolism
NTRLGEFFQVHYSFMCAGGEKGQDSCNGDGGSPLVCAFDDDKDRYYHAGIDAWGIGCGEKQIPAVYTDLAVFRNWIDGEMSKKRLPTTFYDRSDPFIARITNGQKL

SEQ ID NO: 34236 - protein, 57 aa, Diabrotica virgifera
  misc_feature: Coding regions on vcDNA: vcDNA=SeqID_13933; Strand=-; Position=150-323
VGHSRIVCCLGGINRTDVVITSIDVDNGCRTSALERCIYIQGHLHRWQELIRQHRML

SEQ ID NO: 34237 - protein, 49 aa, Diabrotica virgifera
  misc_feature: Coding regions on vcDNA: vcDNA=SeqID_13934; Strand=+; Position=162-311
MYLHINFEFMTSTQLRFLLSTVDFGQLVCEEMLLVFHYILFFKMSHHLI

SEQ ID NO: 34238 - protein, 123 aa, Diabrotica virgifera
  misc_feature: Coding regions on vcDNA: vcDNA=SeqID_13935; Strand=+; Position=85-453
MHWVNDHSDEDIIKYLRYGKGPLSTTGLQLIGYLKTEFSRDKTDYPDVQILIKKTHPKGGCYHFKGANLKKELQDIFCKPYEGFNVEIVLLHPKSKGFIKLNDVDPYHQPYINPMALSDEDEY

SEQ ID NO: 34239 - protein, 139 aa, Diabrotica virgifera
  misc_feature: Coding regions on vcDNA: vcDNA=SeqID_13936; Strand=+; Position=2-418
  misc_feature (92)..(99): Xaa can be any naturally occurring amino acid
GRVGLGEECAKTIYTGTWGIIAPGIYVYAIKVFEDINLPLTQGILVAEFSCSNSRCSLAIVAKYPMKRISELESRINRTEIRGLLANQTNSXXXXXXXXALEYKKSLFDDVINFGNFSEWYYYHNSKHILYVWEKSNFF

SEQ ID NO: 34240 - protein, 48 aa, Diabrotica virgifera
  misc_feature: Coding regions on vcDNA: vcDNA=SeqID_13937; Strand=-; Position=0-143
HGDRKTQRALYARSWALPHFSHCTNIAIARGYNDREIHKTQVLTSNLS

SEQ ID NO: 34241 - protein, 105 aa, Diabrotica virgifera
  misc_feature: Coding regions on vcDNA: vcDNA=SeqID_13938; Strand=+; Position=116-430
  misc_feature: Homolog annotation: Hit_ID=CAG07540.1; Match level="QueryCoverage =100%, HitCoverage=55%, E-value=3e-35, Identity=68%"; Hit description= unnamed protein product [Tetraodon nigroviridis]
MASHGKAETEKLKQNLENQLDRLVEQLQDLENCKNELDKEEYEETKNDTMDQLKELNDSLSKLVKGDISLISALSAVQLATQAAISKAFKTPEVIRLFGKKEPQQ

SEQ ID NO: 34242 - protein, 85 aa, Diabrotica virgifera
  misc_feature: Coding regions on vcDNA: vcDNA=SeqID_13939; Strand=+; Position=3-260
  misc_feature (72)..(78): Xaa can be any naturally occurring amino acid
NPSGITNHKWFGPVPLRGCKNSTFGPKFQAFQTIILKPRCLKKRLKGIMDKTITAKPKFEFIQRNPNNFTIXXXXXXXTGGTLQP

SEQ ID NO: 34243 - protein, 130 aa, Diabrotica virgifera
  misc_feature: Coding regions on vcDNA: vcDNA=SeqID_13940; Strand=+; Position=3-395
  misc_feature (129)..(129): Xaa can be any naturally occurring amino acid
MLKNISSEIVFYEENPSKEPSDIILSSSEDRLSKRESSSRSIISPLGSKAAFGKPSAVLKTYYDLILRFTSLKQRSISSIEDWMKEVSTSLLKDESKEGSIPWLKDERAEIGIPSIKDETEEDSSPWLXR

SEQ ID NO: 34244 - protein, 149 aa, Diabrotica virgifera
  misc_feature: Coding regions on vcDNA: vcDNA=SeqID_13941; Strand=+; Position=2-448
  misc_feature: Homolog annotation: Hit_ID=XP_396968.1; Match level="QueryCoverage =100%, HitCoverage=38%, E-value=5e-34, Identity=48%"; Hit description= similar to vacuolar protein sorting protein 18 [Apis mellifera]
  misc_feature: Gene Ontology Annotation: Cellular component=vacuolar membrane; Biological process=ommochrome biosynthesis
  misc_feature (147)..(147): Xaa can be any naturally occurring amino acid
YELAKKYSRGNLQCYNHVLIKEADKLFADQKHELSAQRYAETESSLEEICLKFIEANQHNALKLFLRCKLDTLKPQDKTQITMIVIWVMELYLVKLEQMRLAGLEQTATYADLQKEFDVFLALDEISNCIKNNKGTVYNLMSSHGDXNN

SEQ ID NO: 34245 - protein, 50 aa, Diabrotica virgifera
  misc_feature: Coding regions on vcDNA: vcDNA=SeqID_13942; Strand=+; Position=260-409
  misc_feature (41)..(41): Xaa can be any naturally occurring amino acid
MVFKGTFFGVRHVQIFLLFWLCLMTYALRFNLSVAIVAMTXKTSVNPDVP

SEQ ID NO: 34246 - protein, 70 aa, Diabrotica virgifera
  misc_feature: Coding regions on vcDNA: vcDNA=SeqID_13943; Strand=-; Position=1-210
  misc_feature (65)..(65): Xaa can be any naturally occurring amino acid
KLFKNLLRMFIYHFLITCWPLNTQSSYWSTLTLRFFDHPCFLQKIVPFFVHPPLILDIFLGKSRXSNYRV

SEQ ID NO: 34247 - protein, 71 aa, Diabrotica virgifera
  misc_feature: Coding regions on vcDNA: vcDNA=SeqID_13944; Strand=+; Position=1-216
  misc_feature: Homolog annotation: Hit_ID=XP_392981.1; Match level="QueryCoverage =100%, HitCoverage=11%, E-value=2e-22, Identity=74%"; Hit description= similar to Hypothetical protein MGC76072 [Apis mellifera]
  misc_feature: Pfam annotation: Pfam_ID=HEAT; Match level="Score=23.5, E-value =0.00066, Copies=1"; Pfam description=HEAT repeat
TKVLLPTVLSMANDKVANVRFNVAKTLQRIAPQLDQSVIQPQVKPVLDKLNVDTDVDVKYSASEAIMGIAG

SEQ ID NO: 34248 - protein, 138 aa, Diabrotica virgifera
  misc_feature: Coding regions on vcDNA: vcDNA=SeqID_13945; Strand=+; Position=1-414
  misc_feature: Homolog annotation: Hit_ID=XP_392732.1; Match level="QueryCoverage =92%, HitCoverage=19%, E-value=3e-12, Identity=35%"; Hit description =similar to CG4357-PA [Apis mellifera]
  misc_feature (111)..(117): Xaa can be any naturally occurring amino acid
NELISSFRTLVMFSNYRLALQRLTRSEVVQKIIESCPSLLEDPAAIALIQDPELMFYLSTPEQGNEIIEKHPVLLEAGSYIVAQVQQEQASLNPNQAGTSTGYSYSLEALXXXXXXXDSSSDTSFSQNPLTRNTSFNA

SEQ ID NO: 34249 - protein, 54 aa, Diabrotica virgifera
  misc_feature: Coding regions on vcDNA: vcDNA=SeqID_13946; Strand=+; Position=210-374
  misc_feature (18)..(24): Xaa can be any naturally occurring amino acid
SPRIFYCVIIIRILFCIXXXXXXXRSLAYDHHFITDILFYCAADTSSPYFNSIQ

SEQ ID NO: 34250 - protein, 78 aa, Diabrotica virgifera
  misc_feature: Coding regions on vcDNA: vcDNA=SeqID_13947; Strand=+; Position=40-276
  misc_feature (41)..(47): Xaa can be any naturally occurring amino acid
IFSSIIFIVKFGKFGDFVGMRCFFNAVSALDCYTLKDFDRXXXXXXXHKIRVEFTLTKIKNRFLARKVQMQRWHRRHV

SEQ ID NO: 34251 - protein, 64 aa, Diabrotica virgifera
  misc_feature: Coding regions on vcDNA: vcDNA=SeqID_13948; Strand=+; Position=66-257
  misc_feature: Homolog annotation: Hit_ID=AAS17723.1; Match level="QueryCoverage =95%, HitCoverage=9%, E-value=6e-14, Identity=62%"; Hit description =heat shock protein 70 [Argopecten irradians]
  misc_feature: Gene Ontology Annotation: Molecular function=protein binding
MVTTPSVSIELGITYSCVRFIQHGKVEISANSHGYTDSPTYVAFKHLERHIGDACKNQVSMIPK

SEQ ID NO: 34252 - protein, 65 aa, Diabrotica virgifera
  misc_feature: Coding regions on vcDNA: vcDNA=SeqID_13949; Strand=+; Position=199-393
  misc_feature (16)..(24): Xaa can be any naturally occurring amino acid
NLPKIHLLISFNNNKXXXXXXXXXLIQYVCETWNVLITFFNISFTKKVILYKILCIVYNIRCNHQ

SEQ ID NO: 34253 - protein, 125 aa, Diabrotica virgifera
  misc_feature: Coding regions on vcDNA: vcDNA=SeqID_13950; Strand=+; Position=37-411
KLDKITLISTMSRYCSIASCQKLTRSIKNSLNLRNDYKEVVQICLQSKNVKNTSSFWKIILKNIAKVKSNNSSEAVSVFSNNIADQRNDINRKTNNPELLHIEIQKLCSNLQKHISQNKPLAWST

SEQ ID NO: 34254 - protein, 132 aa, Diabrotica virgifera
  misc_feature: Coding regions on vcDNA: vcDNA=SeqID_13951; Strand=+; Position=18-413
IYEMVSVKMVLKWFCVLGLVTAANAYSTKDSKAINPKDINQWNIVQIVPTNSQSNNNSPPYAAPPGFVWIQAPASNFATSLGGSHSNSNSETKLPNYGSNNPITSPVTEGVSGSGLNKLCLQPKGQFPSKSC

SEQ ID NO: 34255 - protein, 121 aa, Diabrotica virgifera
  misc_feature: Coding regions on vcDNA: vcDNA=SeqID_13952; Strand=+; Position=25-387
  misc_feature: Homolog annotation: Hit_ID=BVFFSL; Match level="QueryCoverage=41%, HitCoverage=3%, E-value=8e-10, Identity=54%"; Hit description=sol protein, large splice form - fruit fly (Drosophila melanogaster) gb|AAB95431.1| small optic
  misc_feature: Pfam annotation: Pfam_ID=zf-RanBP; Match level="Score=38.3, E-value =2.3e-08, Copies=1"; Pfam description=Zn-finger in Ran binding protein and o
MYLFQGHVVVQGDGSELGAVTGFADQRSLAVDQDMTLKKGEFWSCSKCTLKNSLNNLVCKACKTDKYPETMSSRSPSPRHDRSKRNMVRGATSSKVVQSTRSIAVVKGKVNILTDLDHNSI

SEQ ID NO: 34256 - protein, 72 aa, Diabrotica virgifera
  misc_feature: Coding regions on vcDNA: vcDNA=SeqID_13953; Strand=-; Position=131-349
SLVKYCSYHIGEAQNIQRYKTLYDQISYRFSAYLREVANNRISLNRLTDFNNKNLSYDTLIKNSQFSPKCVL

SEQ ID NO: 34257 - protein, 42 aa, Diabrotica virgifera
  misc_feature: Coding regions on vcDNA: vcDNA=SeqID_13954; Strand=+; Position=1-129
LPNFIERYVITNVQRRILILPTKPLIIGPCVSRTNSASVNIY

SEQ ID NO: 34258 - protein, 40 aa, Diabrotica virgifera
  misc_feature: Coding regions on vcDNA: vcDNA=SeqID_13955; Strand=-; Position=19-141
VFNLLAPNTTSKNVTRHPTRLNTMGTYYANTYEACTICKP

SEQ ID NO: 34259 - protein, 85 aa, Diabrotica virgifera
  misc_feature: Coding regions on vcDNA: vcDNA=SeqID_13956; Strand=+; Position=1-255
  misc_feature (5)..(24): Xaa can be any naturally occurring amino acid
KIASXXXXXXXXXXXXXXXXXXXXYFCTVQRNTVINNFSVNTDTIIVGPLCITYQKILIIYILCPKLKFLKTYGSYRWWNILTNF

SEQ ID NO: 34260 - protein, 90 aa, Diabrotica virgifera
  misc_feature: Coding regions on vcDNA: vcDNA=SeqID_13957; Strand=+; Position=149-418
NYHKYKIMFNPTEIKQEVDEFETTCKKEMEDEVDEDKVLQDTFKAEIKDEPTSESVNYDAFDYVDVKECHIKDEIKQDDGVSCKDMKTDA

SEQ ID NO: 34261 - protein, 48 aa, Diabrotica virgifera
  misc_feature: Coding regions on vcDNA: vcDNA=SeqID_13958; Strand=-; Position=149-295
LTTYSNTEEVQIIVFSSFNLFKFPTFLFWEHVKNICWLQKLLKYLQIL

SEQ ID NO: 34262 - protein, 46 aa, Diabrotica virgifera
  misc_feature: Coding regions on vcDNA: vcDNA=SeqID_13959; Strand=+; Position=39-176
  misc_feature (34)..(44): Xaa can be any naturally occurring amino acid
EVSKIRKRMKSLKTNKRSSRTIHSSFFIYIFTYXXXXXXXXXXXYA

SEQ ID NO: 34263 - protein, 104 aa, Diabrotica virgifera
  misc_feature: Coding regions on vcDNA: vcDNA=SeqID_13960; Strand=+; Position=6-320
ATASTISYKVTAIVAFLVASQAVVNSRALSGELQVHLNSNTNPSSNTSLQILLTVNLRDKLKGKLEGQLEGHYPVNNPMGNLAVSVTMVNKPTDFPIESKLLSK

SEQ ID NO: 34264 - protein, 136 aa, Diabrotica virgifera
  misc_feature: Coding regions on vcDNA: vcDNA=SeqID_13961; Strand=+; Position=8-415
  misc_feature: Homolog annotation: Hit_ID=XP_392033.1; Match level="QueryCoverage =93%, HitCoverage=18%, E-value=2e-20, Identity=44%"; Hit description =similar to CG6980-PA [Apis mellifera]
MYNSEYLCKDEEFNNFMVKVSEVNNIVQKLASKDKQIQEIGNIEAQRYLNDDGQNLNVDDNVELKVKNARTLINKKVLENEQKDPNSMSQEAFMKEVEKDADKRYKDKLVRKEKMETFKKQATLAFRRREFEKALT

SEQ ID NO: 34265 - protein, 60 aa, Diabrotica virgifera
  misc_feature: Coding regions on vcDNA: vcDNA=SeqID_13962; Strand=-; Position=141-323
NCHCGSGISQIRPIRLKVGNNQYTVNLQVTIAKVNTSTKFISFYLITSYVFHRLRYFSGH

SEQ ID NO: 34266 - protein, 105 aa, Diabrotica virgifera
  misc_feature: Coding regions on vcDNA: vcDNA=SeqID_13963; Strand=+; Position=1-318
  misc_feature (1)..(8): Xaa can be any naturally occurring amino acid
  misc_feature (62)..(72): Xaa can be any naturally occurring amino acid
XXXXXXXXIFQIVMTYFPSALYIYNSANKFEKVSYVKFLVHSTGTSPSTEAEIINCWIILVXXXXXXXXXXXHAYFVHFAAKYSSKIKCIIVCDMPVFHVKSNAF

SEQ ID NO: 34267 - protein, 119 aa, Diabrotica virgifera
  misc_feature: Coding regions on vcDNA: vcDNA=SeqID_13964; Strand=+; Position=2-361
ASYTGGIGNATELWKKDTLDVFLQLDELFGKNYKSTTNAFTMFGRYDDEHDLLFHDVTEKLRTVPTLKENDPMPFVYETSLNSDRQCLMSGSSNTRFTFSLFLFVTCLYLVYSVKNVLL

SEQ ID NO: 34268 - protein, 84 aa, Diabrotica virgifera
  misc_feature: Coding regions on vcDNA: vcDNA=SeqID_13965; Strand=+; Position=101-355
  misc_feature (82)..(82): Xaa can be any naturally occurring amino acid
LNIYCVIFCFLNKGRISIQNFGLKKWSFKHQQFPSTTERIPQPTGILCFYILTEGRWPTRLLYGCKVIFQLHTNSECVVFMXPI

SEQ ID NO: 34269 - protein, 66 aa, Diabrotica virgifera
  misc_feature: Coding regions on vcDNA: vcDNA=SeqID_13966; Strand=+; Position=149-349
ILLTEYFQLYLFPFVFYFYVALTLAYSTCISVKLLTNLFSLIYPIRFSSSCIKFKYYSPSSLFLIS

SEQ ID NO: 34270 - protein, 66 aa, Diabrotica virgifera
  misc_feature: Coding regions on vcDNA: vcDNA=SeqID_13967; Strand=+; Position=235-432
NLFIMPIYSTFLTKCTSLIHFIQIKNITFPYEKILLGDIKFHLQIICSFYISTNFLSCFTQIKSNL

SEQ ID NO: 34271 - protein, 118 aa, Diabrotica virgifera
  misc_feature: Coding regions on vcDNA: vcDNA=SeqID_13968; Strand=+; Position=56-412
  misc_feature (110)..(116): Xaa can be any naturally occurring amino acid
RFPKWRSKRKIYIISNLNCGFIPKENSKLQGNSFRTIFTNIDTVDVYSNRSPFVAINTIVPCNSKYIILVQVITYEDAKKIHKPSLSSYICVICHVTLDEYGLSRTNTSXXXXXXXQH

SEQ ID NO: 34272 - protein, 78 aa, Diabrotica virgifera
  misc_feature: Coding regions on vcDNA: vcDNA=SeqID_13969; Strand=+; Position=196-429
  misc_feature (59)..(59): Xaa can be any naturally occurring amino acid
FLLKSDQNHHTGISPLEVLNIGLVSKFPIDSMHCLYLGVMKKLLLTWICGDLRVRLCGXDVTNISENLVFYGKFVVSE

SEQ ID NO: 34273 - protein, 51 aa, Diabrotica virgifera
  misc_feature: Coding regions on vcDNA: vcDNA=SeqID_13970; Strand=+; Position=1-153
  misc_feature (4)..(38): Xaa can be any naturally occurring amino acid
THEXXXXXXXXXXXXXXXXXXXXXXXXXXXXXXXXXXXRGAAQVVPVLFRL

SEQ ID NO: 34274 - protein, 70 aa, Diabrotica virgifera
  misc_feature: Coding regions on vcDNA: vcDNA=SeqID_13971; Strand=-; Position=0-209
WNMEDNVYISLLTICGNNLALMYRSVTSLLVVCGMLYFTQLHTLHYNCQIYANVLICSTALVGGDRPRVR

SEQ ID NO: 34275 - protein, 132 aa, Diabrotica virgifera
  misc_feature: Coding regions on vcDNA: vcDNA=SeqID_13972; Strand=-; Position=3-401
  misc_feature (48)..(59): Xaa can be any naturally occurring amino acid
  misc_feature (119)..(128): Xaa can be any naturally occurring amino acid
ENCSFYPKSANFDIFVQNYLSCTSCLKPNILSYRRVPPTRKVLGGSPXXXXXXXXXXXXLTFSAKFILFVAFIEIKSMLTGLCPTNTQKQLHFNYIFSRLQLKYSLNLLECLKNNQTVXXXXXXXXXXLNLK

SEQ ID NO: 34276 - protein, 142 aa, Diabrotica virgifera
  misc_feature: Coding regions on vcDNA: vcDNA=SeqID_13973; Strand=+; Position=2-427
  misc_feature: Homolog annotation: Hit_ID=CAH92809.1; Match level="QueryCoverage =94%, HitCoverage=11%, E-value=2e-17, Identity=37%"; Hit description =hypothetical protein [Pongo pygmaeus]
  misc_feature: Gene Ontology Annotation: Molecular function=pre-mRNA splicing factor activity; Cellular component=spliceosome complex; Biological process =lariat formation, 5'-splice site cleavage
  misc_feature: Pfam annotation: Pfam_ID=HA2; Match level="Score=80.2, E-value=5.6e -21, Copies=1"; Pfam description=Helicase associated domain (HA2)
IPEIMRTSLTKIVLDSKAFSNNMETMTFMKTLPTPPEESTVSKAIEELKELELLDNNENLTPLGKRLAEFQLEPKLAKTLVNSYIFKCLSPIVDIVTLFSTDVELFSSGLIDKETIKEIKSEFSKDSDHLAMMRMEKFMEFD

SEQ ID NO: 34277 - protein, 145 aa, Diabrotica virgifera
  misc_feature: Coding regions on vcDNA: vcDNA=SeqID_13974; Strand=+; Position=3-437
LISLNLSKKMEIFNEAQRQNSKFKSVWNQIDADPKTSDRLLSTYSPDERLAIYDYCVQSTQGPPVPEEISMSIKESNRKEDTTPTEEEALKKQRDAKRRPVKYKSVHTSRNKSYIEVMREVIQNQTDMYKDYLIEKQKEEEAIER

SEQ ID NO: 34278 - protein, 116 aa, Diabrotica virgifera
  misc_feature: Coding regions on vcDNA: vcDNA=SeqID_13975; Strand=+; Position=78-425
SKNVLLFNIMQNKYTTKPDTAIEKNKQLLLQLEMDDEVKQIINYPEKYADTFLDVTVIKPVNNKEFTREKKVMSGNQVKQFITSMNLNEDLLPSTHEEKCSGDSRRTSNQSPPNSR

SEQ ID NO: 34279 - protein, 76 aa, Diabrotica virgifera
  misc_feature: Coding regions on vcDNA: vcDNA=SeqID_13976; Strand=+; Position=90-320
SSYTSDMKEVVVVAANFITSSVSPDASITVKLYPKVVQVVVNLSVTDTVGTVGSADASMCAVIESRSGTQVDIAYI

SEQ ID NO: 34280 - protein, 61 aa, Diabrotica virgifera
  misc_feature: Coding regions on vcDNA: vcDNA=SeqID_13977; Strand=+; Position=80-265
LSGSVMCKNLDIRYVEKHRRQVDIFDFYTAHDQLTMSITNSIYANSQFNFATVGLISTNVP

SEQ ID NO: 34281 - protein, 47 aa, Diabrotica virgifera
  misc_feature: Coding regions on vcDNA: vcDNA=SeqID_13978; Strand=-; Position=3-143
  misc_feature (2)..(9): Xaa can be any naturally occurring amino acid
  misc_feature (31)..(38): Xaa can be any naturally occurring amino acid
YXXXXXXXXTFLKLIYSHTILCNYLYIKFIXXXXXXXXILLSYSVSV

SEQ ID NO: 34282 - protein, 23 aa, Diabrotica virgifera
  misc_feature: Coding regions on vcDNA: vcDNA=SeqID_13979; Strand=+; Position=2-70
MLVLFVVFVFLGICLGVRLGGGG

SEQ ID NO: 34283 - protein, 48 aa, Diabrotica virgifera
  misc_feature: Coding regions on vcDNA: vcDNA=SeqID_13980; Strand=+; Position=3-149
  misc_feature (2)..(2): Xaa can be any naturally occurring amino acid
  misc_feature (4)..(4): Xaa can be any naturally occurring amino acid
VXGXGAIVMSYSGQHLCLLHMMPLLTMEGSHMVLEIYIGEFLRFNSIN

SEQ ID NO: 34284 - protein, 128 aa, Diabrotica virgifera
  misc_feature: Coding regions on vcDNA: vcDNA=SeqID_13981; Strand=+; Position=2-388
KTGRSRESSPHPRAFTEIDTSKIQNVRRSDSPDVKAVDQKVEETFIHRNVSEEVVETKESLPKIRESKQISPVEIGTFIEEERSAILKENDHVVDSSWVIIEEEELSYIPEVIRPVIWLNRTDRCRYY

SEQ ID NO: 34285 - protein, 120 aa, Diabrotica virgifera
  misc_feature: Coding regions on vcDNA: vcDNA=SeqID_13982; Strand=+; Position=67-426
  misc_feature (25)..(31): Xaa can be any naturally occurring amino acid
  misc_feature (68)..(85): Xaa can be any naturally occurring amino acid
DDYYLSLHNAIHNEDPELYECVVCXXXXXXXSRTLYEHIIEEHEKEGMYCNECDKTFSSQTWFESHKXXXXXXXXXXXXXXXXXXAKFTTNYYLMQHMQESHTKYKCNECDVTFPYKQNL

SEQ ID NO: 34286 - protein, 44 aa, Diabrotica virgifera
  misc_feature: Coding regions on vcDNA: vcDNA=SeqID_13983; Strand=+; Position=3-134
  misc_feature (35)..(42): Xaa can be any naturally occurring amino acid
RGFIFLIRYLLFCRVRLSNKSYRSKKTHNNSETVXXXXXXXXLH

SEQ ID NO: 34287 - protein, 143 aa, Diabrotica virgifera
  misc_feature: Coding regions on vcDNA: vcDNA=SeqID_13984; Strand=+; Position=5-433
  misc_feature: Homolog annotation: Hit_ID=EAA08446.2; Match level="QueryCoverage =76%, HitCoverage=17%, E-value=1e-15, Identity=37%"; Hit description =ENSANGP00000003182 [Anopheles gambiae str. PEST] ref|XP_562867.1| ENSANGP00000003182 [Anopheles gambiae st
  misc_feature: Gene Ontology Annotation: Molecular function=fibroblast growth factor receptor activity; Cellular component=integral to membrane; Biological process=endoderm cell fate determination
  misc_feature: Pfam annotation: Pfam_ID=I-set; Match level="Score=-6.3, E-value =0.0029, Copies=1"; Pfam description=Immunoglobulin I-set domain
  misc_feature (104)..(110): Xaa can be any naturally occurring amino acid
SSTKRAYASLLLCFLLVELVTSEITFIEGKFRRGPVFKHHRSHKKHIVKSSGSTLRLSCDASGTPTPNITWYKDGLSPLPRRLTPIKTYKWTLVLEDMEKEDAXXXXXXXCNEVGCKDLQFDVEVNEREQNTPRLVKELHNMT

SEQ ID NO: 34288 - protein, 137 aa, Diabrotica virgifera
  misc_feature: Coding regions on vcDNA: vcDNA=SeqID_13985; Strand=+; Position=3-413
  misc_feature (8)..(13): Xaa can be any naturally occurring amino acid
EKPAKIVXXXXXXRKSGEKRKSGGKPYGKGDSPVVAAVLDDVKRIKVAGPKEGRLYPNLSDIEATTETEPETYTRSPSPDNSNSSFETSNNSDDPNTSFGREIIQAVCKNQTPQKRAIFDESTASDVSSILDDMDNY

SEQ ID NO: 34289 - protein, 66 aa, Diabrotica virgifera
  misc_feature: Coding regions on vcDNA: vcDNA=SeqID_13986; Strand=+; Position=4-204
PRVCSKYHKNDYVISPLKFMNCNLLEFYETFLFLIIFIRFILELLIIFLAKFCHNTSYVQYFAIRM

SEQ ID NO: 34290 - protein, 50 aa, Diabrotica virgifera
  misc_feature: Coding regions on vcDNA: vcDNA=SeqID_13987; Strand=-; Position=1-150
  misc_feature (28)..(28): Xaa can be any naturally occurring amino acid
  misc_feature (33)..(33): Xaa can be any naturally occurring amino acid
  misc_feature (40)..(40): Xaa can be any naturally occurring amino acid
  misc_feature (43)..(46): Xaa can be any naturally occurring amino acid
  misc_feature (49)..(49): Xaa can be any naturally occurring amino acid
PQHINISPHTLHLTPFPTPFLTPPNTKXYFLSXQFFPFLXSTXXXXSTXL

SEQ ID NO: 34291 - protein, 45 aa, Diabrotica virgifera
  misc_feature: Coding regions on vcDNA: vcDNA=SeqID_13988; Strand=+; Position=33-170
NSRVGDTKVLTTGILLKGTQYVFCIKNMTKLKFYRFFIRYFFRLF

SEQ ID NO: 34292 - protein, 51 aa, Diabrotica virgifera
  misc_feature: Coding regions on vcDNA: vcDNA=SeqID_13989; Strand=+; Position=94-249
ALDSVHGWLLLNDFKILSISDVCLVISCTFAHSFTGTLLNVAKVKYHSFNI

SEQ ID NO: 34293 - protein, 42 aa, Diabrotica virgifera
  misc_feature: Coding regions on vcDNA: vcDNA=SeqID_13990; Strand=+; Position=30-158
KINLLRFIPLMKSHNNIFPAEATLTYFITQALTSAIVLFSVF

SEQ ID NO: 34294 - protein, 61 aa, Diabrotica virgifera
  misc_feature: Coding regions on vcDNA: vcDNA=SeqID_13991; Strand=-; Position=81-266
SVTPQILPNFCKNTMCTYTICEKILDKETTCQKHEIFVNFSLLIPRNFLVQYDISQRKNDT

SEQ ID NO: 34295 - protein, 58 aa, Diabrotica virgifera
  misc_feature: Coding regions on vcDNA: vcDNA=SeqID_13992; Strand=+; Position=264-437
YHPFIRIHFCRHSLMSYHSRRLHTGCFIENCPYSCWKDLGTKYEDWTYNTWIKCGSLP

SEQ ID NO: 34296 - protein, 52 aa, Diabrotica virgifera
  misc_feature: Coding regions on vcDNA: vcDNA=SeqID_13993; Strand=-; Position=209-367
  misc_feature (14)..(24): Xaa can be any naturally occurring amino acid
NLIISCNKKPIKSXXXXXXXXXXXYDLCMKDLYLNQSFKNLILMIDDISDHP

SEQ ID NO: 34297 - protein, 121 aa, Diabrotica virgifera
  misc_feature: Coding regions on vcDNA: vcDNA=SeqID_13994; Strand=+; Position=19-381
TMTRWYIDFCPFQNSFITKKDDMYFKMKKLRDMECVKMKEASSALWMIKNSANSSWVEELLAESILLETQLRYKLIVNKIRESKDMDIPLKTRKLTGSVALSNLQYDIREQDKKTSDSTTF

SEQ ID NO: 34298 - protein, 55 aa, Diabrotica virgifera
  misc_feature: Coding regions on vcDNA: vcDNA=SeqID_13995; Strand=-; Position=2-166
LAKIDRTLTDCDTPPGSTSLHHPPPGARSVAEMGPKAVRIRWWDCECPSEVRSDC

SEQ ID NO: 34299 - protein, 70 aa, Diabrotica virgifera
  misc_feature: Coding regions on vcDNA: vcDNA=SeqID_13996; Strand=+; Position=2-211
SWFTTSHERLSNYDAAYKPCQRLNRLLQQAQAQFRNDCADYTMDAINGLDSGDIVATPFWGSQTGSKVTW

SEQ ID NO: 34300 - protein, 62 aa, Diabrotica virgifera
  misc_feature: Coding regions on vcDNA: vcDNA=SeqID_13997; Strand=+; Position=143-331
TLAEGSYNSRRERRRQVVYRDRSVLTCVYSFKLRYIFQQILTNTLTVFVFIVFKSHNNGQNC

SEQ ID NO: 34301 - protein, 66 aa, Diabrotica virgifera
  misc_feature: Coding regions on vcDNA: vcDNA=SeqID_13998; Strand=+; Position=138-338
IVVDPIQFEFIHKTGSTLGEMYQIRESRMDYERDYTVYPVGFQRKRRQDMVPHLQISSVSNQAPLT

SEQ ID NO: 34302 - protein, 49 aa, Diabrotica virgifera
  misc_feature: Coding regions on vcDNA: vcDNA=SeqID_13999; Strand=+; Position=106-255
YTGLDTGNVNNGLTPDFINNGTYRSFIVNRRHRYFMSRNTVADAAASAT

SEQ ID NO: 34303 - protein, 79 aa, Diabrotica virgifera
  misc_feature: Coding regions on vcDNA: vcDNA=SeqID_14000; Strand=-; Position=2-238
  misc_feature (6)..(14): Xaa can be any naturally occurring amino acid
  misc_feature (22)..(28): Xaa can be any naturally occurring amino acid
  misc_feature (62)..(70): Xaa can be any naturally occurring amino acid
YFNQLXXXXXXXXXFFRIRKKXXXXXXXIASKFYAYALNPGVVTLTSVTSIVACEILSQNTXXXXXXXXXYFYLLFTHA

SEQ ID NO: 34304 - protein, 57 aa, Diabrotica virgifera
  misc_feature: Coding regions on vcDNA: vcDNA=SeqID_14001; Strand=+; Position=72-245
MTTLASLILHENHHCSNNFSFREIGMLSSANTFLRASHGTRRGSSQLEVAAVWVVLI

SEQ ID NO: 34305 - protein, 53 aa, Diabrotica virgifera
  misc_feature: Coding regions on vcDNA: vcDNA=SeqID_14002; Strand=-; Position=143-304
NGDGFVKTLKFSLNSVTLTRKSLNSFKALSALKIERSGERAQCLTAFHRMNRP

SEQ ID NO: 34306 - protein, 77 aa, Diabrotica virgifera
  misc_feature: Coding regions on vcDNA: vcDNA=SeqID_14003; Strand=+; Position=2-235
  misc_feature: Homolog annotation: Hit_ID=ZP_00215138.1; Match level="QueryCoverage =100%, HitCoverage=35%, E-value=5e-26, Identity=75%"; Hit description= COG1396: Predicted transcriptional regulators [Burkholderia cepacia R18194]
  misc_feature: Pfam annotation: Pfam_ID=Cupin_2; Match level="Score=37.3, E-value =4.4e-08, Copies=1"; Pfam description=Cupin domain
TLDEAGGLATHDNEEFCYVLSGELELHFEQGEPTLLRVGESALFSSLRPHAYVAPGGATLLVVLTPAGYAQQKPALP

SEQ ID NO: 34307 - protein, 18 aa, Diabrotica virgifera
  misc_feature: Coding regions on vcDNA: vcDNA=SeqID_14004; Strand=-; Position=0-53
RRLDGARRGRQPSRRGRV

SEQ ID NO: 34308 - protein, 87 aa, Diabrotica virgifera
  misc_feature: Coding regions on vcDNA: vcDNA=SeqID_14005; Strand=-; Position=11-274
FCTLHMLTYHRIFVRPATLLFDCPVNVSFFVISMLFSSTWCCNASASIPISLARRLKILCSRSSSHSTTMLYYGSLSPIFFGCYKKI

SEQ ID NO: 34309 - protein, 74 aa, Diabrotica virgifera
  misc_feature: Coding regions on vcDNA: vcDNA=SeqID_14006; Strand=+; Position=64-285
  misc_feature: Homolog annotation: Hit_ID=ZP_00212551.1; Match level="QueryCoverage =100%, HitCoverage=60%, E-value=2e-38, Identity=98%"; Hit description= COG1393: Arsenate reductase and related proteins, glutaredoxin family [Burkholderia cepacia
  misc_feature: Pfam annotation: Pfam_ID=ArsC; Match level="Score=20.3, E-value=7.8e -07, Copies=1"; Pfam description=ArsC family
MAKPHTVVVYGIPNCDTVKKARVWLDDHGVEFEFHDFKKLGVSAPLIEDWLKDVSLDALVNKRGTTWRGLDDAM

SEQ ID NO: 34310 - protein, 43 aa, Diabrotica virgifera
  misc_feature: Coding regions on vcDNA: vcDNA=SeqID_14007; Strand=+; Position=245-376
VHILNKNNIHKQIIQDEAQIWACRSTDLSASDTEYKSSSQSMP

SEQ ID NO: 34311 - protein, 107 aa, Diabrotica virgifera
  misc_feature: Coding regions on vcDNA: vcDNA=SeqID_14008; Strand=+; Position=1-321
  misc_feature (1)..(81): Xaa can be any naturally occurring amino acid
  misc_feature (88)..(103): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXSIYIIYXXXXXXXXXXXXXXXXEIYT

SEQ ID NO: 34312 - protein, 65 aa, Diabrotica virgifera
  misc_feature: Coding regions on vcDNA: vcDNA=SeqID_14009; Strand=+; Position=38-235
FDTYKPSFRIAIALHLHKYIAQTYNSSFLSVFYMLDFCKKCFFQENTHMMSCMYQNVWEHGYFVA

SEQ ID NO: 34313 - protein, 136 aa, Diabrotica virgifera
  misc_feature: Coding regions on vcDNA: vcDNA=SeqID_14010; Strand=+; Position=1-408
  misc_feature: Homolog annotation: Hit_ID=XP_315490.1; Match level="QueryCoverage =81%, HitCoverage=19%, E-value=3e-10, Identity=38%"; Hit description =ENSANGP00000006868 [Anopheles gambiae]
  misc_feature (75)..(82): Xaa can be any naturally occurring amino acid
RGNGGRRNENRRPYNRRPNRGRIKERPKYDYDDEEEDRFDDEEDVNSRRRKPIDKNKKSSSRKRPSEETSEETVXXXXXXXXDTRTIIKPVSGTIYDRPRVAPKIKLPVPKNEANKYAYKPYSTTKVTQKENDEYE

SEQ ID NO: 34314 - protein, 103 aa, Diabrotica virgifera
  misc_feature: Coding regions on vcDNA: vcDNA=SeqID_14011; Strand=-; Position=83-394
  misc_feature (8)..(33): Xaa can be any naturally occurring amino acid
  misc_feature (36)..(42): Xaa can be any naturally occurring amino acid
  misc_feature (46)..(64): Xaa can be any naturally occurring amino acid
  misc_feature (70)..(80): Xaa can be any naturally occurring amino acid
  misc_feature (87)..(101): Xaa can be any naturally occurring amino acid
ILILRFSXXXXXXXXXXXXXXXXXXXXXXXXXXLKXXXXXXXITFXXXXXXXXXXXXXXXXXXXLLLIWXXXXXXXXXXXPGTPGSXXXXXXXXXXXXXXXSN

SEQ ID NO: 34315 - protein, 22 aa, Diabrotica virgifera
  misc_feature: Coding regions on vcDNA: vcDNA=SeqID_14012; Strand=+; Position=2-67
  misc_feature (1)..(8): Xaa can be any naturally occurring amino acid
XXXXXXXXHPRLKVLLREIGYM

SEQ ID NO: 34316 - protein, 36 aa, Diabrotica virgifera
  misc_feature: Coding regions on vcDNA: vcDNA=SeqID_14013; Strand=+; Position=187-297
PCTGIIIINIFNLCWNKRLILLGADINQFLHSFRFN

SEQ ID NO: 34317 - protein, 135 aa, Diabrotica virgifera
  misc_feature: Coding regions on vcDNA: vcDNA=SeqID_14014; Strand=+; Position=34-438
  misc_feature: Homolog annotation: Hit_ID=XP_316854.1; Match level="QueryCoverage =85%, HitCoverage=19%, E-value=7e-38, Identity=58%"; Hit description =ENSANGP00000013095 [Anopheles gambiae]
  misc_feature: Gene Ontology Annotation: Biological process=courtship behavior
MFRNICLALLLFVEVAVCVQKLQEHFQWNILDYEFPTEAIRRNALLTGRFKPENNLPVGMEIWQDKLFISVPRWKEGIPATLNYVPLNSPVKNPRLIPYPDFPSNELGNCENGLNTVYRMKADECDRLWVLDTGT

SEQ ID NO: 34318 - protein, 74 aa, Diabrotica virgifera
  misc_feature: Coding regions on vcDNA: vcDNA=SeqID_14015; Strand=-; Position=1-222
SNFTSRVSNDKKIDGKALFHVDLFTGMSISQLTSSETTHERIPQLSPAFSMQYLASRPAWRKYERLCLESCVDP

SEQ ID NO: 34319 - protein, 43 aa, Diabrotica virgifera
  misc_feature: Coding regions on vcDNA: vcDNA=SeqID_14016; Strand=-; Position=1-129
SADISKKRKRHHTKNRLHFPESNEPFTTHRTNGTMVLACRTLG

SEQ ID NO: 34320 - protein, 52 aa, Diabrotica virgifera
  misc_feature: Coding regions on vcDNA: vcDNA=SeqID_14017; Strand=+; Position=100-258
RRESDVANCSSHFVFIWISRGAREILVRETVSDQEESRSGYQEITQVIFKIL

SEQ ID NO: 34321 - protein, 82 aa, Diabrotica virgifera
  misc_feature: Coding regions on vcDNA: vcDNA=SeqID_14018; Strand=-; Position=135-383
DVHVPISQGIEGISKKGNTVSRVGKKLEKKLGLVCLVKHFCNASRYRALKTKKLHIFYDFAEVTGNIVMQFGGFQEVAIVHF

SEQ ID NO: 34322 - protein, 61 aa, Diabrotica virgifera
  misc_feature: Coding regions on vcDNA: vcDNA=SeqID_14019; Strand=+; Position=92-277
VDRFTFALAFLSLAFKTACNPLGLERPRYYRHTLGTAQSFCCLITRDWNEPFNHLNHIQRM

SEQ ID NO: 34323 - protein, 63 aa, Diabrotica virgifera
  misc_feature: Coding regions on vcDNA: vcDNA=SeqID_14020; Strand=-; Position=30-221
  misc_feature (3)..(13): Xaa can be any naturally occurring amino acid
  misc_feature (56)..(56): Xaa can be any naturally occurring amino acid
NFXXXXXXXXXXXFKQEMILQDKISTNLVHYKKIYINLQGLQELWQCMQTNLTQLXRSKSLSF

SEQ ID NO: 34324 - protein, 51 aa, Diabrotica virgifera
  misc_feature: Coding regions on vcDNA: vcDNA=SeqID_14021; Strand=-; Position=77-232
LMLANPSIYLPMIIHAPQRRYLNELFHYNPCMLQDVLCLNVLYVQAVITNP

SEQ ID NO: 34325 - protein, 58 aa, Diabrotica virgifera
  misc_feature: Coding regions on vcDNA: vcDNA=SeqID_14022; Strand=+; Position=172-348
QHVPYSLSMSHSYFKSLHCSDTLAVFSYSHNFLRHTLSLSIFTILMPYQSSIHHHSYF

SEQ ID NO: 34326 - protein, 106 aa, Diabrotica virgifera
  misc_feature: Coding regions on vcDNA: vcDNA=SeqID_14023; Strand=-; Position=96-416
  misc_feature (2)..(2): Xaa can be any naturally occurring amino acid
HXIVTLKQNKQTSVSLTRGVGSITWKQEQQSIFYKNLCTAKGNDWQDSPATILLKTGPYLTTQGFKILIRNSMPRPNKSSMSSGLQYLQKAFDSDTTPSKGMISHH

SEQ ID NO: 34327 - protein, 20 aa, Diabrotica virgifera
  misc_feature: Coding regions on vcDNA: vcDNA=SeqID_14024; Strand=+; Position=1-60
  misc_feature (9)..(18): Xaa can be any naturally occurring amino acid
KTLEKVVLXXXXXXXXXXKG

SEQ ID NO: 34328 - protein, 52 aa, Diabrotica virgifera
  misc_feature: Coding regions on vcDNA: vcDNA=SeqID_14025; Strand=-; Position=119-277
TLLIILNAKLIIYRLNIILLPLGIYSIFFLRYFKSIYKYVLSIYFCIYLRIY

SEQ ID NO: 34329 - protein, 69 aa, Diabrotica virgifera
  misc_feature: Coding regions on vcDNA: vcDNA=SeqID_14026; Strand=+; Position=1-207
CIKSYYVFWCVITSMLLSPCLLLVIHDYADEMPSMMQAFSVLSISCVSALDSHYNCHNDAVTAYNTAAA

SEQ ID NO: 34330 - protein, 115 aa, Diabrotica virgifera
  misc_feature: Coding regions on vcDNA: vcDNA=SeqID_14027; Strand=-; Position=39-386
  misc_feature (35)..(40): Xaa can be any naturally occurring amino acid
LWIPTFRFISILTFQIFNISKCHDLVVILMRILMXXXXXXYQQKIFYPNNPRTLINAQKFFNNFLKLVAYRQQTSAYGVGLFPRNKLSKSVIKIFRTIINVLWLLLLNICYKKYM

SEQ ID NO: 34331 - protein, 74 aa, Diabrotica virgifera
  misc_feature: Coding regions on vcDNA: vcDNA=SeqID_14028; Strand=-; Position=107-331
ALQSCTTTTNNRIRLLLNSSTAIVTICSHVSSLSSLNCIISTACQDNFLHRRPELSSVFTVLRTIGPNGFALEI

SEQ ID NO: 34332 - protein, 133 aa, Diabrotica virgifera
  misc_feature: Coding regions on vcDNA: vcDNA=SeqID_14029; Strand=+; Position=2-400
  misc_feature: Homolog annotation: Hit_ID=ZP_00211595.1; Match level="QueryCoverage =94%, HitCoverage=27%, E-value=1e-62, Identity=93%"; Hit description =COG0773: UDP-N-acetylmuramate-alanine ligase [Burkholderia cepacia R18194]
GRHYRVHDPNVRQIIPFISKPVVRYGLSPDAQVRAEDIDARDGRMHFRVIREGRAPLAVVLNMPGLHNVQNALAAIAIATDLGVTDDAIQLALAEFNGVGRRFQRYGDVPTADGGQYTLIDDYGHQPVQMAPP

SEQ ID NO: 34333 - protein, 19 aa, Diabrotica virgifera
  misc_feature: Coding regions on vcDNA: vcDNA=SeqID_14030; Strand=-; Position=31-90
PPPFYPNLTTSSNSAPLSS

SEQ ID NO: 34334 - protein, 55 aa, Diabrotica virgifera
  misc_feature: Coding regions on vcDNA: vcDNA=SeqID_14031; Strand=-; Position=0-164
VLKMPQEISQVRLKDQGVRSDDSNKIQREVLTIHAQIPRLITKDPIYYRLVESNL

SEQ ID NO: 34335 - protein, 22 aa, Diabrotica virgifera
  misc_feature: Coding regions on vcDNA: vcDNA=SeqID_14032; Strand=-; Position=1-66
LKISISKYIYIEIHRSRSRSGR

SEQ ID NO: 34336 - protein, 96 aa, Diabrotica virgifera
  misc_feature: Coding regions on vcDNA: vcDNA=SeqID_14033; Strand=+; Position=40-330
  misc_feature (48)..(54): Xaa can be any naturally occurring amino acid
NFNKTCFYFNKFHSIVKMISNILNIGCPSLYDSLISSKAHGFFISSSXXXXXXXGPIFCTLLVSTFVIFPTVGFAFDSYSVVVFFWIYVISFSDHY

SEQ ID NO: 34337 - protein, 66 aa, Diabrotica virgifera
  misc_feature: Coding regions on vcDNA: vcDNA=SeqID_14034; Strand=-; Position=0-197
VFWNLSIFFQPIYHRPFGPLKGSPKLLIFDNFELCYTFKSAVDHCRTSGWALGCLVLSLRVSGRLV

SEQ ID NO: 34338 - protein, 128 aa, Diabrotica virgifera
  misc_feature: Coding regions on vcDNA: vcDNA=SeqID_14035; Strand=-; Position=2-388
  misc_feature (10)..(97): Xaa can be any naturally occurring amino acid
  misc_feature (99)..(127): Xaa can be any naturally occurring amino acid
KNCSRILLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXG

SEQ ID NO: 34339 - protein, 134 aa, Diabrotica virgifera
  misc_feature: Coding regions on vcDNA: vcDNA=SeqID_14036; Strand=+; Position=3-404
  misc_feature: Homolog annotation: Hit_ID=XP_392578.1; Match level="QueryCoverage =100%, HitCoverage=6%, E-value=3e-59, Identity=81%"; Hit description =similar to ENSANGP00000006233 [Apis mellifera]
  misc_feature: Gene Ontology Annotation: Molecular function=structural constituent of cytoskeleton; Cellular component=synaptic junction; Biological process=protein targeting
  misc_feature: Pfam annotation: Pfam_ID=ZU5; Match level="Score=144.3, E-value=2.7e -40, Copies=1"; Pfam description=ZU5 domain
GAMRRCRHSGVRVIVPPRCASSPTRITCRYVRPQRTPTPPPLMEGEALASRLLELGPVGAKFLGPVILEVPHFASLRGKQREIIVLRSDNGETWKEHTLEASEEAIQDVLNHSFDGEELSQIEDLHTSRITRIL

SEQ ID NO: 34340 - protein, 27 aa, Diabrotica virgifera
  misc_feature: Coding regions on vcDNA: vcDNA=SeqID_14037; Strand=-; Position=92-175
CHCCTTAEITYDIIINILLRNTQVSDI

SEQ ID NO: 34341 - protein, 60 aa, Diabrotica virgifera
  misc_feature: Coding regions on vcDNA: vcDNA=SeqID_14038; Strand=-; Position=11-193
KRFYNRINNKTETSNLAVQKYFYVQKYFSKIYDYFLVNFYASLKFVTILLMFHILQKCSI

SEQ ID NO: 34342 - protein, 136 aa, Diabrotica virgifera
  misc_feature: Coding regions on vcDNA: vcDNA=SeqID_14039; Strand=-; Position=0-407
  misc_feature (20)..(41): Xaa can be any naturally occurring amino acid
SVQIGYSNPIGLLHLAYTPXXXXXXXXXXXXXXXXXXXXXXDGLRKALNISSVEKRLVSIHSKLRAVTIIYNMAVHVLMRQKCWKIICKYLCIFFFIESSVHRKNMKPTGHSTTTPLDTSSADYHDETHHQSARSA

SEQ ID NO: 34343 - protein, 41 aa, Diabrotica virgifera
  misc_feature: Coding regions on vcDNA: vcDNA=SeqID_14040; Strand=+; Position=2-127
LSLKSTSILLHIDYQEFNLTWTIIESPQKSEPTQGNPTDSQ

SEQ ID NO: 34344 - protein, 61 aa, Diabrotica virgifera
  misc_feature: Coding regions on vcDNA: vcDNA=SeqID_14041; Strand=-; Position=2-184
  misc_feature (22)..(29): Xaa can be any naturally occurring amino acid
  misc_feature (32)..(61): Xaa can be any naturally occurring amino acid
NKRLKKICPKFLYINLYILTKXXXXXXXXSHXXXXXXXXXXXXXXXXXXXXXXXXXXXXXX

SEQ ID NO: 34345 - protein, 93 aa, Diabrotica virgifera
  misc_feature: Coding regions on vcDNA: vcDNA=SeqID_14042; Strand=+; Position=105-386
  misc_feature: Homolog annotation: Hit_ID=NP_650196.1; Match level="QueryCoverage =98%, HitCoverage=22%, E-value=7e-23, Identity=64%"; Hit description =CG5641-PA [Drosophila melanogaster] gb|AAF54812.1| CG5641-PA [Drosophila melanogaster]
  misc_feature: Gene Ontology Annotation: Molecular function=RNA polymerase II transcription factor activity; Cellular component=nucleolus
  misc_feature (93)..(93): Xaa can be any naturally occurring amino acid
MARGGMRGRGGMNRNVGGRPPFKVKMFLPRHPFDLALCETSFPRTKAAPDDTAFTQALLKRNADLSPTPGEQTAILNLVTKIQTVLDNLVVAX

SEQ ID NO: 34346 - protein, 31 aa, Diabrotica virgifera
  misc_feature: Coding regions on vcDNA: vcDNA=SeqID_14043; Strand=+; Position=2-94
  misc_feature: Homolog annotation: Hit_ID=AAG45081.1; Match level="QueryCoverage =100%, HitCoverage=10%, E-value=1e-09, Identity=100%"; Hit description=elongation factor 1 alpha [Pseudohylesinus nebulosus nebulosus]
AECAVLIVAAGTGEFEAGISKNGQTREHALL

SEQ ID NO: 34347 - protein, 89 aa, Diabrotica virgifera
  misc_feature: Coding regions on vcDNA: vcDNA=SeqID_14044; Strand=+; Position=3-272
  misc_feature: Homolog annotation: Hit_ID=AAM29462.1; Match level="QueryCoverage =93%, HitCoverage=10%, E-value=9e-10, Identity=38%"; Hit description =RE36839p [Drosophila melanogaster]
YIAIGRHLFLLFTSQFVPSFLLYPDYIRHFILTTDASGDELFSSFRSRLNGIDLPRAYASGSVNQGECSKPTIIKEILTMHWGLKHFRC

SEQ ID NO: 34348 - protein, 138 aa, Diabrotica virgifera
  misc_feature: Coding regions on vcDNA: vcDNA=SeqID_14045; Strand=+; Position=12-425
DNSRAIDINKFPPADVQNNEYSGSDNQKFLDNSIRKTSTKVFSDFNFQLTTPRTKYFDTKYEEARQKLEQEYEENNPEHSDDHHMDITQEVEEDDREHDLHMDRLFGSVRNNPNSSIDYKEKTKISRNNTVDDNSEHN

SEQ ID NO: 34349 - protein, 93 aa, Diabrotica virgifera
  misc_feature: Coding regions on vcDNA: vcDNA=SeqID_14046; Strand=-; Position=1-279
  misc_feature (12)..(29): Xaa can be any naturally occurring amino acid
  misc_feature (61)..(67): Xaa can be any naturally occurring amino acid
  misc_feature (70)..(93): Xaa can be any naturally occurring amino acid
WIFLKRESPFLXXXXXXXXXXXXXXXXXXLLKMSKIIKSNNSLFYTLRGYHRGTQTLNFFXXXXXXXSPXXXXXXXXXXXXXXXXXXXXXXXX

SEQ ID NO: 34350 - protein, 50 aa, Diabrotica virgifera
  misc_feature: Coding regions on vcDNA: vcDNA=SeqID_14047; Strand=-; Position=220-372
QGTGRTKRAGSGCNKILLGPFLSVGSIMRTDWMDQLFKYIFTLPSSFSFT

SEQ ID NO: 34351 - protein, 39 aa, Diabrotica virgifera
  misc_feature: Coding regions on vcDNA: vcDNA=SeqID_14048; Strand=-; Position=33-152
ISTPFFKGPKNQLKIYTFRDRFLKINNLIGITRTSSKYM

SEQ ID NO: 34352 - protein, 35 aa, Diabrotica virgifera
  misc_feature: Coding regions on vcDNA: vcDNA=SeqID_14049; Strand=-; Position=2-106
CEWPLNNLVFNLNLTSHISNNQGLVLKDAWVTQAS

SEQ ID NO: 34353 - protein, 67 aa, Diabrotica virgifera
  misc_feature: Coding regions on vcDNA: vcDNA=SeqID_14050; Strand=-; Position=201-404
VSKLRSKECWSIFLLVKKNRENHSQLASKIKLIITTSKITLHFIVYNICKINGFKVLIFEKAAVKWA

SEQ ID NO: 34354 - protein, 55 aa, Diabrotica virgifera
  misc_feature: Coding regions on vcDNA: vcDNA=SeqID_14051; Strand=+; Position=158-322
CVATTLVNGPRCFDADVEYTQDKRCLVEFVYFPRGIQYVVNNQQLRQARNGDTVG

SEQ ID NO: 34355 - protein, 133 aa, Diabrotica virgifera
  misc_feature: Coding regions on vcDNA: vcDNA=SeqID_14052; Strand=+; Position=15-413
  misc_feature: Homolog annotation: Hit_ID=XP_394676.1; Match level="QueryCoverage =99%, HitCoverage=45%, E-value=2e-34, Identity=53%"; Hit description =similar to CG2767-PA [Apis mellifera]
  misc_feature: Gene Ontology Annotation: Molecular function=bile acid transporter activity; Cellular component=cytoplasm; Biological process =canalicular bile acid transport
  misc_feature: Pfam annotation: Pfam_ID=Aldo_ket_red; Match level="Score=-84.1, E -value=0.00016, Copies=1"; Pfam description=Aldo/keto reductase family
  misc_feature (93)..(93): Xaa can be any naturally occurring amino acid
  misc_feature (105)..(105): Xaa can be any naturally occurring amino acid
  misc_feature (125)..(125): Xaa can be any naturally occurring amino acid
  misc_feature (128)..(128): Xaa can be any naturally occurring amino acid
EDALNAALDAGYRHFDTATVYGNEAIIGKVLNKWFSSGKIKREDLFITTKLPLCGGHPDRVEMFIKQSLEDLKLDYLDLYLIHFPVTSNYIGXLLHHQINLNWNXVDHLSLWQKMEEQVDAGRTXSIXVSNFT

SEQ ID NO: 34356 - protein, 78 aa, Diabrotica virgifera
  misc_feature: Coding regions on vcDNA: vcDNA=SeqID_14053; Strand=+; Position=77-313
  misc_feature: Homolog annotation: Hit_ID=EAK90877.1; Match level="QueryCoverage =100%, HitCoverage=17%, E-value=2e-17, Identity=55%"; Hit description= probable translation elongation factor EF-1 alpha [Candida albicans SC5314] gb|EAK90873.1| probable trans
  misc_feature: Gene Ontology Annotation: Molecular function=translation factor activity, nucleic acid binding; Biological process=protein biosynthesis
  misc_feature (30)..(30): Xaa can be any naturally occurring amino acid
  misc_feature (43)..(43): Xaa can be any naturally occurring amino acid
  misc_feature (69)..(69): Xaa can be any naturally occurring amino acid
MGKEMIQVNIVDIGHVDSGISTTTENLVYXCGGSETRAIDQFXENSNNVAYGSFIYTCVVDRRKAEREXESSIDNALW

SEQ ID NO: 34357 - protein, 28 aa, Diabrotica virgifera
  misc_feature: Coding regions on vcDNA: vcDNA=SeqID_14054; Strand=-; Position=1-84
  misc_feature (12)..(28): Xaa can be any naturally occurring amino acid
TTLNCYFNKKAXXXXXXXXXXXXXXXXX

SEQ ID NO: 34358 - protein, 101 aa, Diabrotica virgifera
  misc_feature: Coding regions on vcDNA: vcDNA=SeqID_14055; Strand=+; Position=58-363
  misc_feature: Homolog annotation: Hit_ID=EAL28297.1; Match level="QueryCoverage =96%, HitCoverage=26%, E-value=3e-18, Identity=53%"; Hit description =GA19329-PA [Drosophila pseudoobscura]
  misc_feature: Gene Ontology Annotation: Molecular function=fructose-bisphosphate aldolase activity; Biological process=fructose metabolism
MTTSWNDPDAALRANLIIFADAIIAPVTCILGTNKSTATVCKRLADIGVEINDLYRRIYIQLHFTTDPSNAQYISAVILFHECLYHIADNGTPFPDLPIQR

SEQ ID NO: 34359 - protein, 42 aa, Diabrotica virgifera
  misc_feature: Coding regions on vcDNA: vcDNA=SeqID_14056; Strand=-; Position=141-269
GYLKMSNISMHNSYLNDVHVSKNLNFQRSPYYESHNHISISS

SEQ ID NO: 34360 - protein, 75 aa, Diabrotica virgifera
  misc_feature: Coding regions on vcDNA: vcDNA=SeqID_14057; Strand=+; Position=48-275
LVQGDIPHNHFKYNAYIFYSPFLMTLDNRNLQVIINDMLISRFDNFFTLNVSSIWNVQYGITISTLRFHFSYISP

SEQ ID NO: 34361 - protein, 24 aa, Diabrotica virgifera
  misc_feature: Coding regions on vcDNA: vcDNA=SeqID_14058; Strand=+; Position=2-73
RHSSVWHLRPLSQSLVHESLEKLT

SEQ ID NO: 34362 - protein, 99 aa, Diabrotica virgifera
  misc_feature: Coding regions on vcDNA: vcDNA=SeqID_14059; Strand=+; Position=88-384
KLEKAIWKVKTNNINSPKDKINSVQNYLRWTAKSVLNASDSITCPLNRKHIMPIEKIEEHVKKCSLISAGYKTNEDFLSETPEPSSSLISLDLSKKMEI

SEQ ID NO: 34363 - protein, 103 aa, Diabrotica virgifera
  misc_feature: Coding regions on vcDNA: vcDNA=SeqID_14060; Strand=+; Position=9-317
LKIRQWGEDNLRPSWQEISSLRSVSKTYWAQWDSFILDDSLLILVIENDDGSMRITQLVIPKTIIADVLRQLHDSPSRRHFGVKKTLQRIRERFYWSDISDDV

SEQ ID NO: 34364 - protein, 96 aa, Diabrotica virgifera
  misc_feature: Coding regions on vcDNA: vcDNA=SeqID_14061; Strand=+; Position=97-384
  misc_feature: Homolog annotation: Hit_ID=NP_610666.1; Match level="QueryCoverage =88%, HitCoverage=26%, E-value=1e-09, Identity=38%"; Hit description =CG18335-PA [Drosophila melanogaster] gb|AAF58679.2| CG18335-PA [Drosophila melanogaster]
  misc_feature (63)..(63): Xaa can be any naturally occurring amino acid
  misc_feature (91)..(91): Xaa can be any naturally occurring amino acid
IPPQIPHLKPGNTGFGQHNKNVLENTYGTTTHKVLQIQTLHTAEKLVLPDKTANDYQTYRPAXRDIDIVNERHGDTIYKHPMVPGYEGFVXREHGK

SEQ ID NO: 34365 - protein, 141 aa, Diabrotica virgifera
  misc_feature: Coding regions on vcDNA: vcDNA=SeqID_14062; Strand=+; Position=1-423
KNILVYLVRSYLLINGILNKMETPVLTKKQLKSTLSAKKQRPKETIKNVLALPFNNNYWPEVSPEDQKELKDLIIQHMPMIRDKQIKVPWKELKTVPKANRKSFRKEYNEKLLGPQPPKKCCSGISFGINSMSKLLEKNFA

SEQ ID NO: 34366 - protein, 61 aa, Diabrotica virgifera
  misc_feature: Coding regions on vcDNA: vcDNA=SeqID_14063; Strand=-; Position=57-242
CVARTAYSSYRVGYGHHIVPNPFIPVVNNVDDCIVLPEHRGQGSSGHANLVDIKGELIFGS

SEQ ID NO: 34367 - protein, 13 aa, Diabrotica virgifera
  misc_feature: Coding regions on vcDNA: vcDNA=SeqID_14064; Strand=-; Position=4-45
KWLITLINTVSLN

SEQ ID NO: 34368 - protein, 52 aa, Diabrotica virgifera
  misc_feature: Coding regions on vcDNA: vcDNA=SeqID_14065; Strand=+; Position=69-227
CIFILPNPDYHAQESFRIGVPDVPAPSNPVSTLFIPPQNLIIIFLSSDVPPL

SEQ ID NO: 34369 - protein, 62 aa, Diabrotica virgifera
  misc_feature: Coding regions on vcDNA: vcDNA=SeqID_14066; Strand=-; Position=17-205
SRNRSTRKFFTGTGYGLGTSKWHNGRMLLGDSVPLTVHVEAGQSLLRPGRGLVQDQVLRHPF

SEQ ID NO: 34370 - protein, 119 aa, Diabrotica virgifera
  misc_feature: Coding regions on vcDNA: vcDNA=SeqID_14067; Strand=+; Position=38-394
  misc_feature: Homolog annotation: Hit_ID=EAL32192.1; Match level="QueryCoverage =74%, HitCoverage=13%, E-value=2e-24, Identity=56%"; Hit description =GA16959-PA [Drosophila pseudoobscura]
  misc_feature: Gene Ontology Annotation: Molecular function=neurotransmitter:sodium symporter activity; Cellular component=integral to membrane; Biological process=sodium ion transport
MVRVEGQSQDSIIMDKDFPVGLENLGFQKEPSDYEKERNGDLTAVTVTTNEEAKERSQWGNSTEFLMSCIAMSVGLGNIWRFPFIANKNGGGAFLIPYLIILTFIGRPMYYMEMALRQF

SEQ ID NO: 34371 - protein, 53 aa, Diabrotica virgifera
  misc_feature: Coding regions on vcDNA: vcDNA=SeqID_14068; Strand=+; Position=2-163
GHVGVGEIGAVIVKNKHNGSQNVIKMIPKCGNFSHKELGKPIPSKTWFKQPGR

SEQ ID NO: 34372 - protein, 79 aa, Diabrotica virgifera
  misc_feature: Coding regions on vcDNA: vcDNA=SeqID_14069; Strand=+; Position=3-242
LQSRLVQMIDWDYRMHGCTHHSSCCPRYRSSCLWCIGNIRQLLFVTNNYISQYALSHCYTCKSSYSQSMSQISFPKTSS

SEQ ID NO: 34373 - protein, 85 aa, Diabrotica virgifera
  misc_feature: Coding regions on vcDNA: vcDNA=SeqID_14070; Strand=-; Position=2-256
  misc_feature (51)..(57): Xaa can be any naturally occurring amino acid
LKCHAMIRDILKIIYDVKINDALGASGFGLNFTSCLHLHIPLSPGYYVFSXXXXXXXLFSYTMMNAVAKLFSSLLLGRIKFNLTS

SEQ ID NO: 34374 - protein, 119 aa, Diabrotica virgifera
  misc_feature: Coding regions on vcDNA: vcDNA=SeqID_14071; Strand=+; Position=66-422
  misc_feature: Homolog annotation: Hit_ID=XP_395379.1; Match level="QueryCoverage =98%, HitCoverage=11%, E-value=8e-34, Identity=54%"; Hit description =similar to ENSANGP00000001411 [Apis mellifera]
MSVADFFIDKNVFITGGSGFLGKLIIEKLLRSCPGIGKIYVLLRPRKGKAIEERLEKIIESPIFNPLRHQNPDALRKLIPIKGDVSELNLGISKEDRELLVNTVHIIYHSAASVRFDDF

SEQ ID NO: 34375 - protein, 89 aa, Diabrotica virgifera
  misc_feature: Coding regions on vcDNA: vcDNA=SeqID_14072; Strand=-; Position=57-326
  misc_feature (11)..(27): Xaa can be any naturally occurring amino acid
  misc_feature (83)..(83): Xaa can be any naturally occurring amino acid
LPTTLFYAGVXXXXXXXXXXXXXXXXXQILVNFIKCHILNLKYCLQFLINFEFNLFTKNGNIHKQYRKKFGIPFPPSSYTCCXSSHALL

SEQ ID NO: 34376 - protein, 124 aa, Diabrotica virgifera
  misc_feature: Coding regions on vcDNA: vcDNA=SeqID_14073; Strand=+; Position=3-374
  misc_feature: Homolog annotation: Hit_ID=XP_307029.1; Match level="QueryCoverage =99%, HitCoverage=17%, E-value=3e-21, Identity=43%"; Hit description =ENSANGP00000016446 [Anopheles gambiae]
  misc_feature (66)..(72): Xaa can be any naturally occurring amino acid
  misc_feature (105)..(113): Xaa can be any naturally occurring amino acid
PIQLGYMFKIENENQVSHAAHYLCHHGAFKYSSITKKCRVVFDGSAVNDSGISLNDTLMTGNKLQXXXXXXXLRFREHVIVIVADIAKMYRQILIYDPNGEFQGXXXXXXXXXEVGVYRLNMVT

SEQ ID NO: 34377 - protein, 84 aa, Diabrotica virgifera
  misc_feature: Coding regions on vcDNA: vcDNA=SeqID_14074; Strand=+; Position=151-405
  misc_feature (17)..(23): Xaa can be any naturally occurring amino acid
  misc_feature (35)..(40): Xaa can be any naturally occurring amino acid
  misc_feature (53)..(60): Xaa can be any naturally occurring amino acid
CVLFNLFASVPRDVEMXXXXXXXLFLRYSIHDSFXXXXXXNFNELSMIKILYXXXXXXXXALKFPSDLLTFSYFYQFTLSYYSM

SEQ ID NO: 34378 - protein, 84 aa, Diabrotica virgifera
  misc_feature: Coding regions on vcDNA: vcDNA=SeqID_14075; Strand=-; Position=127-381
  misc_feature: Homolog annotation: Hit_ID=AAC46945.1; Match level="QueryCoverage =96%, HitCoverage=23%, E-value=2e-21, Identity=59%"; Hit description =mariner transposase pir||S35520 transposase - lacewing
  misc_feature: Gene Ontology Annotation: Molecular function=transposase activity; Cellular component=cellular_component unknown; Biological process =DNA transposition
  misc_feature (25)..(25): Xaa can be any naturally occurring amino acid
  misc_feature (71)..(71): Xaa can be any naturally occurring amino acid
LVELGYELLPHPPYSPDLAPCDYYXFPNLKKTLAGQKFKSNEEVIAAMEAYFADFEKRYFSDGLKKFKYCXVKCIKLKGDYVEK

SEQ ID NO: 34379 - protein, 113 aa, Diabrotica virgifera
  misc_feature: Coding regions on vcDNA: vcDNA=SeqID_14076; Strand=+; Position=1-342
  misc_feature: Homolog annotation: Hit_ID=XP_393100.1; Match level="QueryCoverage =92%, HitCoverage=51%, E-value=3e-28, Identity=53%"; Hit description =similar to prenylated rab acceptor 1 [Apis mellifera]
  misc_feature: Gene Ontology Annotation: Biological process=nonselective vesicle transport
  misc_feature: Pfam annotation: Pfam_ID=PRA1; Match level="Score=19.9, E-value=1.5e -05, Copies=1"; Pfam description=PRA1 family protein
NYLFVFLGLVVYCLVTSPLILLVIAGTFYVGYRLNKRQQEKPLVLFGKELTLAQQYVIVTLCSLPIFFMVGAHGAIFWVLGASMVVITLHAAFYNIEALVTREDDSYALLEEV

SEQ ID NO: 34380 - protein, 54 aa, Diabrotica virgifera
  misc_feature: Coding regions on vcDNA: vcDNA=SeqID_14077; Strand=-; Position=58-222
PVLEAIITFLHNMEAHKIHPVNLSQKRQFWSYQLIILRRRYDVIIIFGAIVNGH

SEQ ID NO: 34381 - protein, 31 aa, Diabrotica virgifera
  misc_feature: Coding regions on vcDNA: vcDNA=SeqID_14078; Strand=-; Position=1-96
VPLGHKTYMCLNLLTNGSSTVMSFMPGSECC

SEQ ID NO: 34382 - protein, 22 aa, Diabrotica virgifera
  misc_feature: Coding regions on vcDNA: vcDNA=SeqID_14079; Strand=-; Position=1-66
PSWRSMNLHGIRLTLGSCSVIR

SEQ ID NO: 34383 - protein, 57 aa, Diabrotica virgifera
  misc_feature: Coding regions on vcDNA: vcDNA=SeqID_14080; Strand=+; Position=46-219
EAIWNRSLQLTQTLNSVNRTRDNLGVTLEKDVRSEVTYQLDELCKVEDHLDILIATC

SEQ ID NO: 34384 - protein, 32 aa, Diabrotica virgifera
  misc_feature: Coding regions on vcDNA: vcDNA=SeqID_14081; Strand=-; Position=3-98
KTFMSKKKYIYKVLMKKLFKCSTSNSQWNFSN

SEQ ID NO: 34385 - protein, 44 aa, Diabrotica virgifera
  misc_feature: Coding regions on vcDNA: vcDNA=SeqID_14082; Strand=+; Position=105-236
NGVQESGSFVISALEQHGVIVRSYQLEISDVGKSIASLIQLDWV

SEQ ID NO: 34386 - protein, 36 aa, Diabrotica virgifera
  misc_feature: Coding regions on vcDNA: vcDNA=SeqID_14083; Strand=-; Position=3-110
  misc_feature (27)..(27): Xaa can be any naturally occurring amino acid
CYKFLNIVCKFFKIDYFLIPDGVGRTXLIRRQYREL

SEQ ID NO: 34387 - protein, 19 aa, Diabrotica virgifera
  misc_feature: Coding regions on vcDNA: vcDNA=SeqID_14084; Strand=+; Position=3-62
TLRCRCVQLLTSMRKSVMC

SEQ ID NO: 34388 - protein, 66 aa, Diabrotica virgifera
  misc_feature: Coding regions on vcDNA: vcDNA=SeqID_14085; Strand=-; Position=2-199
  misc_feature (3)..(14): Xaa can be any naturally occurring amino acid
  misc_feature (20)..(53): Xaa can be any naturally occurring amino acid
KLXXXXXXXXXXXXLLPKVXXXXXXXXXXXXXXXXXXXXXXXXXXXXXXXXXXLILNPRLRRRLGG

SEQ ID NO: 34389 - protein, 37 aa, Diabrotica virgifera
  misc_feature: Coding regions on vcDNA: vcDNA=SeqID_14086; Strand=-; Position=30-143
PQRLNSPALIPSTFAELLLKFLGLTLLTTQSKIPTQT

SEQ ID NO: 34390 - protein, 35 aa, Diabrotica virgifera
  misc_feature: Coding regions on vcDNA: vcDNA=SeqID_14087; Strand=-; Position=1-105
  misc_feature (25)..(35): Xaa can be any naturally occurring amino acid
VLCFVRPFICSVFVSSLLKIYTCDXXXXXXXXXXX

SEQ ID NO: 34391 - protein, 65 aa, Diabrotica virgifera
  misc_feature: Coding regions on vcDNA: vcDNA=SeqID_14088; Strand=+; Position=79-276
  misc_feature (6)..(15): Xaa can be any naturally occurring amino acid
NYYDTXXXXXXXXXXKVQRLLSSLFLFRTNKEFYRKLNLKKLDAVKQELGKDLIIFGRKWLFHST

SEQ ID NO: 34392 - protein, 22 aa, Diabrotica virgifera
  misc_feature: Coding regions on vcDNA: vcDNA=SeqID_14089; Strand=-; Position=1-66
TVRVTPIPAGDIVPVQGAFPLS

SEQ ID NO: 34393 - protein, 46 aa, Diabrotica virgifera
  misc_feature: Coding regions on vcDNA: vcDNA=SeqID_14090; Strand=+; Position=242-382
NSCNLGKSKFDKLSEFKDTWCVNIREYYNADGEIRPGSQGIMLTMD

SEQ ID NO: 34394 - protein, 52 aa, Diabrotica virgifera
  misc_feature: Coding regions on vcDNA: vcDNA=SeqID_14091; Strand=+; Position=221-376
  misc_feature (14)..(20): Xaa can be any naturally occurring amino acid
VTHKIRDNPFGGAXXXXXXXHTSIHTDRPILLPDIANFTLRRVSSTMKVVLH

SEQ ID NO: 34395 - protein, 43 aa, Diabrotica virgifera
  misc_feature: Coding regions on vcDNA: vcDNA=SeqID_14092; Strand=-; Position=172-303
NYEYIITFLKTTSFFCQLSFLTWGHFLPPLVIRVTKKGWSSEG

SEQ ID NO: 34396 - protein, 110 aa, Diabrotica virgifera
  misc_feature: Coding regions on vcDNA: vcDNA=SeqID_14093; Strand=+; Position=87-416
  misc_feature: Homolog annotation: Hit_ID=XP_318954.1; Match level="QueryCoverage =96%, HitCoverage=29%, E-value=9e-17, Identity=41%"; Hit description =ENSANGP00000015697 [Anopheles gambiae]
  misc_feature: Pfam annotation: Pfam_ID=UBA; Match level="Score=33.7, E-value=5.6e -07, Copies=1"; Pfam description=UBA/TS-N domain
  misc_feature (72)..(77): Xaa can be any naturally occurring amino acid
MSNIVDSLTEMGFSRQRAELAVSQTGSNNLEQVMEWLLSHEEDEAMPVTTNPPKAPEAASEIASENDNNTQXXXXXXVSEEAEAVAKSIKCDECGKLFKTNEEVEFHASK

SEQ ID NO: 34397 - protein, 146 aa, Diabrotica virgifera
  misc_feature: Coding regions on vcDNA: vcDNA=SeqID_14094; Strand=+; Position=1-438
  misc_feature (9)..(9): Xaa can be any naturally occurring amino acid
  misc_feature (64)..(64): Xaa can be any naturally occurring amino acid
TKLSPTTNXLKDLDFSFNKENIDENKDKTPVAKQPSTFEYNSKEITSMIKSQSLSTFKDQSSPXIGMVKSQSDLVTFNNHIVGIPIMEVEREQYQEINEKLQKFEDEEMKKQGVIQDLELHNKLLKQEMEEFKLELQRTQRSLEQT

SEQ ID NO: 34398 - protein, 54 aa, Diabrotica virgifera
  misc_feature: Coding regions on vcDNA: vcDNA=SeqID_14095; Strand=+; Position=266-427
MSCTPSSMLWHAGRAIQSVINTPRCEREHKVYQYSYAYEAHLAHHKGLHILLFF

SEQ ID NO: 34399 - protein, 46 aa, Diabrotica virgifera
  misc_feature: Coding regions on vcDNA: vcDNA=SeqID_14096; Strand=+; Position=102-242
LCIESTKFSTFRRFCKLTSENGCYIMLISRLLQFLFRKCDTGRALS

SEQ ID NO: 34400 - protein, 117 aa, Diabrotica virgifera
  misc_feature: Coding regions on vcDNA: vcDNA=SeqID_14097; Strand=+; Position=3-353
  misc_feature: Homolog annotation: Hit_ID=XP_396173.1; Match level="QueryCoverage =100%, HitCoverage=23%, E-value=1e-20, Identity=40%"; Hit description= similar to CG7922-PA [Apis mellifera]
  misc_feature: Gene Ontology Annotation: Biological process=nucleobase, nucleoside, nucleotide and nucleic acid metabolism
IMATIREHMGPLPQIQQLPDGEYQEVPPNIKFGHPKFYKLKEILLEHFGETGDSSRVIVFFEYRESVMEAFVLLIQSKPVLKPRIFIGQANGVSQKTQISVVKAFREGRCNVLLSTS

SEQ ID NO: 34401 - protein, 121 aa, Diabrotica virgifera
  misc_feature: Coding regions on vcDNA: vcDNA=SeqID_14098; Strand=+; Position=19-381
SRPAKMNYLEFFVCIVAYASATAVNLASFLEATNTTTTCACKQSLDNILAKIKEQNTNLNNANVTLNSIEVTIVKNVSVEVANQTQTLCKLEERLSVLIKKEVNIGVILDVQTTNLTNIVN

SEQ ID NO: 34402 - protein, 106 aa, Diabrotica virgifera
  misc_feature: Coding regions on vcDNA: vcDNA=SeqID_14099; Strand=-; Position=0-317
IHSTNTQILGQSDKFLASPPDGATIANEVYCHLMRSRKRLMSKFQPNPNYGMILEGKSRSDIKERLDAVYGASSRSMATVKNWFNEFQRGRTSVFDEPRVGAPNMV

SEQ ID NO: 34403 - protein, 90 aa, Diabrotica virgifera
  misc_feature: Coding regions on vcDNA: vcDNA=SeqID_14100; Strand=+; Position=159-428
  misc_feature: Homolog annotation: Hit_ID=AAL67865.1; Match level="QueryCoverage =100%, HitCoverage=40%, E-value=3e-13, Identity=45%"; Hit description= ATP synthase F0 subunit 6 [Crioceris duodecimpunctata] ref|NP _569064.1| ATP synthase F0 subunit 6
  misc_feature (13)..(13): Xaa can be any naturally occurring amino acid
  misc_feature (28)..(28): Xaa can be any naturally occurring amino acid
  misc_feature (33)..(39): Xaa can be any naturally occurring amino acid
  misc_feature (46)..(55): Xaa can be any naturally occurring amino acid
  misc_feature (69)..(78): Xaa can be any naturally occurring amino acid
FDPTSNFNLPINXLRTVLGLLIIPSRFXLIPSXXXXXXXKIIITLXXXXXXXXXXYKSQGRTLIFISLXXXXXXXXXXGLFPYIFTRTRH

SEQ ID NO: 34404 - protein, 137 aa, Diabrotica virgifera
  misc_feature: Coding regions on vcDNA: vcDNA=SeqID_14101; Strand=-; Position=1-411
  misc_feature (1)..(133): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQVSL

SEQ ID NO: 34405 - protein, 52 aa, Diabrotica virgifera
  misc_feature: Coding regions on vcDNA: vcDNA=SeqID_14102; Strand=+; Position=82-240
LSTIITFSYLCHHNNITTFIRLYKYCYPRSRFTNNCRVNYNHFSWSMLNRHF

SEQ ID NO: 34406 - protein, 141 aa, Diabrotica virgifera
  misc_feature: Coding regions on vcDNA: vcDNA=SeqID_14103; Strand=+; Position=3-425
  misc_feature: Homolog annotation: Hit_ID=CAA10770.1; Match level="QueryCoverage =98%, HitCoverage=40%, E-value=1e-22, Identity=38%"; Hit description =reverse transcriptase-like [Bos taurus]
HRIVESSEKFGLSLNIKKTKIMMVSKSPQNFSDITVHDQRIERVRKYNYLGTVNNENNDNSEEIKIRIEKARATFTKMKTVLCGRELSLNLKIRLMRCYVLSVLFYGMEAWTLKKVDTRKIEAFEMWMYRRILRISWTERV

SEQ ID NO: 34407 - protein, 47 aa, Diabrotica virgifera
  misc_feature: Coding regions on vcDNA: vcDNA=SeqID_14104; Strand=-; Position=1-141
  misc_feature (4)..(13): Xaa can be any naturally occurring amino acid
FVYXXXXXXXXXXPKGAGTAYRRVPSQKQDWYRVCQKVKILASLHLF

SEQ ID NO: 34408 - protein, 105 aa, Diabrotica virgifera
  misc_feature: Coding regions on vcDNA: vcDNA=SeqID_14105; Strand=+; Position=2-319
  misc_feature: Homolog annotation: Hit_ID=EAL40333.1; Match level="QueryCoverage =97%, HitCoverage=2%, E-value=5e-36, Identity=67%"; Hit description =ENSANGP00000027914 [Anopheles gambiae str. PEST] ref|XP_558026.1| ENSANGP00000027914 [Anopheles gambiae str
  misc_feature: Gene Ontology Annotation: Molecular function=protein binding
  misc_feature: Pfam annotation: Pfam_ID=WD40; Match level="Score=47.4, E-value=4.1e -11, Copies=2"; Pfam description=WD domain, G-beta repeat
DVRSKSIRHKFSAHESAVKCIAIDPHEDYFATGSADGDIKIWGVTVPNVLLSLPAEHARSSFFKNIGQGVTQLHIDNHSRLFSCGADGSMKVRQLPERESLLSHH

SEQ ID NO: 34409 - protein, 65 aa, Diabrotica virgifera
  misc_feature: Coding regions on vcDNA: vcDNA=SeqID_14106; Strand=+; Position=218-412
  misc_feature (35)..(35): Xaa can be any naturally occurring amino acid
IFTSSLILLSDPPAPINRQLRQRSGVADAVEGIAXLKWKRAGHVARMTDNRWTKWILEERPPGDD

SEQ ID NO: 34410 - protein, 76 aa, Diabrotica virgifera
  misc_feature: Coding regions on vcDNA: vcDNA=SeqID_14107; Strand=-; Position=47-277
  misc_feature (3)..(15): Xaa can be any naturally occurring amino acid
  misc_feature (20)..(34): Xaa can be any naturally occurring amino acid
  misc_feature (40)..(48): Xaa can be any naturally occurring amino acid
  misc_feature (53)..(72): Xaa can be any naturally occurring amino acid
YYXXXXXXXXXXXXXVNLMXXXXXXXXXXXXXXXLHKTYXXXXXXXXXPNLIXXXXXXXXXXXXXXXXXXXXRYNT

SEQ ID NO: 34411 - protein, 19 aa, Diabrotica virgifera
  misc_feature: Coding regions on vcDNA: vcDNA=SeqID_14108; Strand=+; Position=1-57
MHNYGVTSLPITVHPVALT

SEQ ID NO: 34412 - protein, 58 aa, Diabrotica virgifera
  misc_feature: Coding regions on vcDNA: vcDNA=SeqID_14109; Strand=-; Position=2-175
LLIGVRCLLFLCLFTINNIGYEQVRWFCSNFQSLLTTELLKKEITNVSVKVNIDRAYS

SEQ ID NO: 34413 - protein, 70 aa, Diabrotica virgifera
  misc_feature: Coding regions on vcDNA: vcDNA=SeqID_14110; Strand=-; Position=101-313
  misc_feature (4)..(10): Xaa can be any naturally occurring amino acid
LCRXXXXXXXQTRLSVFFNVSPASCRSIVFVVFPLIVFLLGNCLSLLSLSHNKMAPRWAPFCYALLYLFI

SEQ ID NO: 34414 - protein, 108 aa, Diabrotica virgifera
  misc_feature: Coding regions on vcDNA: vcDNA=SeqID_14111; Strand=+; Position=51-374
  misc_feature: Homolog annotation: Hit_ID=NP_650734.1; Match level="QueryCoverage =76%, HitCoverage=47%, E-value=6e-24, Identity=61%"; Hit description =CG14301-PA [Drosophila melanogaster] gb|AAF55573.1| CG14301-PA [Drosophila melanogaster]
MYWKTCFVQTVILILGYFIITDGYEQKSRVKRPRAPPPEPENDVESDFEERNKELNPNYVPPGFLSPSVIEYLELGKSIPGKPGSDYPVLSIVPYTNFYCDDQSYPGF

SEQ ID NO: 34415 - protein, 38 aa, Diabrotica virgifera
  misc_feature: Coding regions on vcDNA: vcDNA=SeqID_14112; Strand=+; Position=3-120
  misc_feature (13)..(13): Xaa can be any naturally occurring amino acid
IGGGSDGGFGGGXDAVSEVVTTIIQLQIYVGVPPAERE

SEQ ID NO: 34416 - protein, 68 aa, Diabrotica virgifera
  misc_feature: Coding regions on vcDNA: vcDNA=SeqID_14113; Strand=+; Position=3-209
LHAGNSLTFTESHSCCYAAVLQSTYLFYLLSVCRVSTRIRTPVSFALGQYFLYLLLAGFEKMFLYVNC

SEQ ID NO: 34417 - protein, 38 aa, Diabrotica virgifera
  misc_feature: Coding regions on vcDNA: vcDNA=SeqID_14114; Strand=-; Position=2-115
  misc_feature (38)..(38): Xaa can be any naturally occurring amino acid
SNSSYTALRIHEITSVLKKLLTQHLKLFRVSESEKKGX

SEQ ID NO: 34418 - protein, 59 aa, Diabrotica virgifera
  misc_feature: Coding regions on vcDNA: vcDNA=SeqID_14115; Strand=-; Position=187-366
LYLPPRQLSDVSNSFNYPHNRETLLIMSRSPKRSRSPKRSRSRYRSRDSRARSDSRDRR

SEQ ID NO: 34419 - protein, 66 aa, Diabrotica virgifera
  misc_feature: Coding regions on vcDNA: vcDNA=SeqID_14116; Strand=-; Position=2-199
  misc_feature (5)..(5): Xaa can be any naturally occurring amino acid
  misc_feature (22)..(22): Xaa can be any naturally occurring amino acid
LTSRXKEYECSAISVSVFFSLXVISRFLTFTEIHRVKILIECFSNFYVTLYCCFVNFLPDALATVW

SEQ ID NO: 34420 - protein, 130 aa, Diabrotica virgifera
  misc_feature: Coding regions on vcDNA: vcDNA=SeqID_14117; Strand=+; Position=2-391
ELIASPALLYTEEDAKSFIDEIRTEKAIKESIDDDTETRCSEDSILKEIHVNEGISNNKEEAVRNENVERKKSPSPKKETNDKEEDSDGEDESSNKNSDKLNNGQKMNSDDESVSKEPIENCKSEESDNN

SEQ ID NO: 34421 - protein, 50 aa, Diabrotica virgifera
  misc_feature: Coding regions on vcDNA: vcDNA=SeqID_14118; Strand=-; Position=1-150
MQITCFIKKMLSVIFCIVSSTPTYYISTLSTTKSIEITFNKCPKSSTNCT

SEQ ID NO: 34422 - protein, 30 aa, Diabrotica virgifera
  misc_feature: Coding regions on vcDNA: vcDNA=SeqID_14119; Strand=+; Position=48-137
IVSIVKQSKVYAVLIEALLANQINMQRWFF

SEQ ID NO: 34423 - protein, 122 aa, Diabrotica virgifera
  misc_feature: Coding regions on vcDNA: vcDNA=SeqID_14120; Strand=-; Position=2-367
  misc_feature: Homolog annotation: Hit_ID=BAC82594.1; Match level="QueryCoverage =91%, HitCoverage=9%, E-value=2e-10, Identity=32%"; Hit description =reverse transcriptase [Danio rerio]
MDDTQFGFRKGLGTTEALFPFNVLSQRCLDMNLDIYFCFIDFEKAFDRVRHEKLIELLKNRDIDRRDLRNIINLYWNQKANIKTEEQESENIDIKRGVRQGCVLSPLLLNLYSEALFHETIS

SEQ ID NO: 34424 - protein, 71 aa, Diabrotica virgifera
  misc_feature: Coding regions on vcDNA: vcDNA=SeqID_14121; Strand=+; Position=3-218
RTVHEIEKLKNTCSIIFKNLSNDTKHDPPLQPLDVGRDNIKTLNGNPQFLLQIWIPYVKVSNFYSRHFFEL

SEQ ID NO: 34425 - protein, 105 aa, Diabrotica virgifera
  misc_feature: Coding regions on vcDNA: vcDNA=SeqID_14122; Strand=+; Position=54-367
  misc_feature: Homolog annotation: Hit_ID=XP_392071.1; Match level="QueryCoverage =66%, HitCoverage=15%, E-value=1e-15, Identity=61%"; Hit description =similar to CG5502-PA [Apis mellifera]
  misc_feature: Gene Ontology Annotation: Molecular function=structural constituent of ribosome; Cellular component=cytosolic large ribosomal subunit (sensu Eukarya); Biological process=protein biosynthesis
  misc_feature (87)..(87): Xaa can be any naturally occurring amino acid
CVISLRSPIRDCGPGVCGRSNGFKYFNSIHIFKATNSLDVVIFIHQHVSMIQRLPRSVSHIAGHQTSAESWCTGRAVAHFHLVIGGXTHRTGLGAFGNRCSRVLM

SEQ ID NO: 34426 - protein, 102 aa, Diabrotica virgifera
  misc_feature: Coding regions on vcDNA: vcDNA=SeqID_14123; Strand=+; Position=94-399
FHTNGYRDNLDSKDIRDRLQKHKDFCSKKYQKYHYLLKDISVRLREHNCIRAMDSIRPVFIMLEDLRLMTNDLLQSVRQLCVLNCEHRMTICWNLVTNYMAI

SEQ ID NO: 34427 - protein, 56 aa, Diabrotica virgifera
  misc_feature: Coding regions on vcDNA: vcDNA=SeqID_14124; Strand=-; Position=84-254
LKKFRYLDLLNLVCHFFCTIFPDPTQFSLCILPTYPRKISNSAKIDVQDRRKLKTS

SEQ ID NO: 34428 - protein, 76 aa, Diabrotica virgifera
  misc_feature: Coding regions on vcDNA: vcDNA=SeqID_14125; Strand=-; Position=1-228
  misc_feature (15)..(25): Xaa can be any naturally occurring amino acid
GPFSQVFWVVSNFPXXXXXXXXXXXRPDWSLVSLIRFPGRLEISYAIALGLFVKWGFSKIYLLRFFFHNLFSRRLG

SEQ ID NO: 34429 - protein, 66 aa, Diabrotica virgifera
  misc_feature: Coding regions on vcDNA: vcDNA=SeqID_14126; Strand=+; Position=106-306
  misc_feature: Homolog annotation: Hit_ID=XP_321162.1; Match level="QueryCoverage =90%, HitCoverage=6%, E-value=2e-14, Identity=65%"; Hit description =ENSANGP00000020808 [Anopheles gambiae]
MGIGPFHRGRPYQSGPFFVGMPRRTESSDDKHVMARHAEIYPKEDEIQSIESIVSNTERALKIVSD

SEQ ID NO: 34430 - protein, 67 aa, Diabrotica virgifera
  misc_feature: Coding regions on vcDNA: vcDNA=SeqID_14127; Strand=+; Position=1-204
RHHYTHHYQNPLASHVLRAMQCSVILKRRQQGLHLHIRHDQVPLIHEFLLRTRRGMAIIARDFASDS

SEQ ID NO: 34431 - protein, 56 aa, Diabrotica virgifera
  misc_feature: Coding regions on vcDNA: vcDNA=SeqID_14128; Strand=-; Position=156-326
  misc_feature (21)..(29): Xaa can be any naturally occurring amino acid
KLVYGKQKKFLILRYIVISYXXXXXXXXXEVSDDTHHQKIDTFRRRGVYILDKNRN

SEQ ID NO: 34432 - protein, 56 aa, Diabrotica virgifera
  misc_feature: Coding regions on vcDNA: vcDNA=SeqID_14129; Strand=-; Position=83-253
  misc_feature (23)..(23): Xaa can be any naturally occurring amino acid
ELPLQYYGKNLTFPENYDTTSTXPPTNFMHLTAKDDVDNNGLRDVQVHSGLNLDDH

SEQ ID NO: 34433 - protein, 65 aa, Diabrotica virgifera
  misc_feature: Coding regions on vcDNA: vcDNA=SeqID_14130; Strand=+; Position=206-400
  misc_feature: Pfam annotation: Pfam_ID=CENP-B_N; Match level="Score=44.5, E-value =3e-10, Copies=1"; Pfam description=CENP-B N-terminal DNA-binding domain
KMSNKRKWLSLEAKIAIIEESEKTKKSSRILAKQFNVGRTQICTILKDKEAIYKSWERNGCCVKS

SEQ ID NO: 34434 - protein, 84 aa, Diabrotica virgifera
  misc_feature: Coding regions on vcDNA: vcDNA=SeqID_14131; Strand=+; Position=2-255
  misc_feature: Homolog annotation: Hit_ID=NP_690845.1; Match level="QueryCoverage =95%, HitCoverage=63%, E-value=5e-15, Identity=56%"; Hit description =Mitochondrial protein of unknown function, overexpression suppresses an rpo41 mutation affecting
  misc_feature (60)..(60): Xaa can be any naturally occurring amino acid
DDSTCALSVSGQSLALDDIYQRFRGAFPNKSTRRGSFTLDSDTPSHTGFAPSRTGRSRAXWTGAAPEACSASYNSEPEGARFQS

SEQ ID NO: 34435 - protein, 51 aa, Diabrotica virgifera
  misc_feature: Coding regions on vcDNA: vcDNA=SeqID_14132; Strand=-; Position=2-154
RCRVRSSYFQAALVNVDVIRKISFWNLASISRQFLVNKQTEINMLFNSEQI

SEQ ID NO: 34436 - protein, 74 aa, Diabrotica virgifera
  misc_feature: Coding regions on vcDNA: vcDNA=SeqID_14133; Strand=+; Position=1-225
  misc_feature (16)..(24): Xaa can be any naturally occurring amino acid
  misc_feature (31)..(36): Xaa can be any naturally occurring amino acid
  misc_feature (38)..(46): Xaa can be any naturally occurring amino acid
MTTMTTIKTNKIKLVXXXXXXXXXGTSTLLXXXXXXCXXXXXXXXXVIKHTYGASHQSIYRNENKKGFTDFFSF

SEQ ID NO: 34437 - protein, 63 aa, Diabrotica virgifera
  misc_feature: Coding regions on vcDNA: vcDNA=SeqID_14134; Strand=+; Position=78-269
FLKVKLLHFKVQNILKLNQPQSVSNYRQFKRISTIVGFAFTGTFFEALLHCKLPNMDIMSVET

SEQ ID NO: 34438 - protein, 57 aa, Diabrotica virgifera
  misc_feature: Coding regions on vcDNA: vcDNA=SeqID_14135; Strand=-; Position=1-171
  misc_feature (35)..(44): Xaa can be any naturally occurring amino acid
  misc_feature (46)..(54): Xaa can be any naturally occurring amino acid
LLELTMLMTCHASFNMLISRRCVGGSFDAQNGSNXXXXXXXXXXEXXXXXXXXXWAD

SEQ ID NO: 34439 - protein, 71 aa, Diabrotica virgifera
  misc_feature: Coding regions on vcDNA: vcDNA=SeqID_14136; Strand=+; Position=24-239
DTLRLGLLIFQQIYTPCIWTHVQPSLRGCTILRMIPFPHITPSLLPPTEDLIYRLTLQTLIALTVPVINMT

SEQ ID NO: 34440 - protein, 131 aa, Diabrotica virgifera
  misc_feature: Coding regions on vcDNA: vcDNA=SeqID_14137; Strand=+; Position=8-400
  misc_feature: Homolog annotation: Hit_ID=AAH51147.1; Match level="QueryCoverage =96%, HitCoverage=20%, E-value=5e-13, Identity=34%"; Hit description =C130022K22Rik protein [Mus musculus]
MPPSDSESDKKLESDDDNDFYQSDNEEHTDPGEKWVDYVDCFGRTRKCMQKDLEYLKSKDNEMKKVVEVKHQQLDNPASQNLENDDNFVQSSTESLAENEVGQSELLSSDMRRELLRQQWEKEEEELRNKS

SEQ ID NO: 34441 - protein, 72 aa, Diabrotica virgifera
  misc_feature: Coding regions on vcDNA: vcDNA=SeqID_14138; Strand=-; Position=103-321
TQIDIQSNDLSFLLKCVFPLLNTHDRIRTNDFPRTSTIPHNLKCYVTRFLNITISLTNYITFKVISAVITNQ

SEQ ID NO: 34442 - protein, 78 aa, Diabrotica virgifera
  misc_feature: Coding regions on vcDNA: vcDNA=SeqID_14139; Strand=+; Position=157-390
  misc_feature: Homolog annotation: Hit_ID=AAH41195.1; Match level="QueryCoverage =97%, HitCoverage=16%, E-value=2e-39, Identity=98%"; Hit description =Alphatub84b-prov protein [Xenopus laevis]
  misc_feature: Gene Ontology Annotation: Molecular function=GTP binding; Cellular component=microtubule; Biological process=microtubule-based process
  misc_feature (2)..(2): Xaa can be any naturally occurring amino acid
NXISVHVGQAGVQIGNACWELYCLEHGIQPDGQMPSDKTVGGGDDSFNTFFSETGAGKHVPRAVFVDLEPTVIDEVRT

SEQ ID NO: 34443 - protein, 111 aa, Diabrotica virgifera
  misc_feature: Coding regions on vcDNA: vcDNA=SeqID_14140; Strand=+; Position=3-335
  misc_feature: Homolog annotation: Hit_ID=NP_728012.1; Match level="QueryCoverage =100%, HitCoverage=23%, E-value=2e-48, Identity=75%"; Hit description= CG4678-PB, isoform B [Drosophila melanogaster] ref|NP_573152.1| CG4678-PA, isoform A [Drosophila
  misc_feature: Gene Ontology Annotation: Molecular function=carboxypeptidase D activity; Cellular component=membrane fraction; Biological process =neuropeptide signaling pathway
VSCKTSRTAFRRGITNGAEWYPLTGGMQDYNYVWYGCMEVTLEVSCCKYPPAHELPKYWEDNKQALIKFLAEAHRGVHGFVMDESGNPLGKASLKIKAMDVGFQTTKYGEF

SEQ ID NO: 34444 - protein, 102 aa, Diabrotica virgifera
  misc_feature: Coding regions on vcDNA: vcDNA=SeqID_14141; Strand=+; Position=54-359
  misc_feature: Homolog annotation: Hit_ID=XP_393112.1; Match level="QueryCoverage =91%, HitCoverage=16%, E-value=3e-40, Identity=88%"; Hit description =similar to ENSANGP00000017773 [Apis mellifera]
  misc_feature: Gene Ontology Annotation: Molecular function=molecular_function unknown; Cellular component=26S proteasome; Biological process =biological_process unknown
MVLESTMICVDNSDYMRGGDFLPSRLQAQQDAVNLVCHSKTRSNPENNVGLLTLAKVEVLATLTSDVGRILSKLHQVQPNGEINLHSGIRIAQRALKHRQGK

SEQ ID NO: 34445 - protein, 49 aa, Diabrotica virgifera
  misc_feature: Coding regions on vcDNA: vcDNA=SeqID_14142; Strand=+; Position=3-152
  misc_feature (15)..(37): Xaa can be any naturally occurring amino acid
PSPIHYSTQTHSKRXXXXXXXXXXXXXXXXXXXXXXXNINRGTKIILDL

SEQ ID NO: 34446 - protein, 40 aa, Diabrotica virgifera
  misc_feature: Coding regions on vcDNA: vcDNA=SeqID_14143; Strand=-; Position=0-119
FVKNTSNYYLKEFKNFVNLLKRFQLSQTAETTSSTSTHSL

SEQ ID NO: 34447 - protein, 14 aa, Diabrotica virgifera
  misc_feature: Coding regions on vcDNA: vcDNA=SeqID_14144; Strand=-; Position=24-68
MNPNLSDIMSLLYY

SEQ ID NO: 34448 - protein, 123 aa, Diabrotica virgifera
  misc_feature: Coding regions on vcDNA: vcDNA=SeqID_14145; Strand=+; Position=3-371
PPLSETEKKAIITELEPVYRENGVLSRTMEEAAKVKPKKKKVTRIKELEKLDKEFEELKKSELEKVDDAFKEKPKSKKKSKPVLMKIVKVEQVAQKPKIIEIKEEPINLADIKLKKSRVPVKI

SEQ ID NO: 34449 - protein, 100 aa, Diabrotica virgifera
  misc_feature: Coding regions on vcDNA: vcDNA=SeqID_14146; Strand=+; Position=41-340
  misc_feature: Homolog annotation: Hit_ID=XP_397059.1; Match level="QueryCoverage =92%, HitCoverage=28%, E-value=3e-20, Identity=54%"; Hit description =similar to RIKEN cDNA C030048B08 [Apis mellifera]
  misc_feature (8)..(8): Xaa can be any naturally occurring amino acid
TKENVDIXNMSLTKSHHEQLELCTTRPAYRQGRKLTAVKVYTINQESQHLYIYGVPSLKLHHELKTKCLRYGKVASIAVVEDANNVPFTECYHIEYNRIQ

SEQ ID NO: 34450 - protein, 56 aa, Diabrotica virgifera
  misc_feature: Coding regions on vcDNA: vcDNA=SeqID_14147; Strand=-; Position=2-169
  misc_feature (11)..(25): Xaa can be any naturally occurring amino acid
  misc_feature (30)..(56): Xaa can be any naturally occurring amino acid
YYSSSTKSKLXXXXXXXXXXXXXXXLIYKXXXXXXXXXXXXXXXXXXXXXXXXXXX

SEQ ID NO: 34451 - protein, 105 aa, Diabrotica virgifera
  misc_feature: Coding regions on vcDNA: vcDNA=SeqID_14148; Strand=+; Position=7-323
  misc_feature: Homolog annotation: Hit_ID=XP_319799.1; Match level="QueryCoverage =99%, HitCoverage=28%, E-value=1e-37, Identity=67%"; Hit description =ENSANGP00000019592 [Anopheles gambiae]
  misc_feature: Gene Ontology Annotation: Molecular function=enzyme activator activity; Cellular component=delta-DNA polymerase cofactor complex; Biological process=DNA strand elongation
  misc_feature (61)..(61): Xaa can be any naturally occurring amino acid
  misc_feature (67)..(67): Xaa can be any naturally occurring amino acid
MLWADKYRPKDLSSVDYHTEQSVNLKNLTKDGDFPHLLIYGPLGAGKKTRVMCLLKELYGXGVDRLXMEMMHFTTPSNKNLEIMTLSSNEHIEVNPTDVGIYERV

SEQ ID NO: 34452 - protein, 115 aa, Diabrotica virgifera
  misc_feature: Coding regions on vcDNA: vcDNA=SeqID_14149; Strand=+; Position=1-345
  misc_feature: Homolog annotation: Hit_ID=XP_319825.1; Match level="QueryCoverage =95%, HitCoverage=25%, E-value=1e-24, Identity=52%"; Hit description =ENSANGP00000023803 [Anopheles gambiae]
  misc_feature: Gene Ontology Annotation: Molecular function=ATP dependent RNA helicase activity; Cellular component=nucleus; Biological process =RNA localization
  misc_feature (86)..(86): Xaa can be any naturally occurring amino acid
  misc_feature (93)..(93): Xaa can be any naturally occurring amino acid
SPRVWEQTADAATETASTEVHKSGVNGTYVSLHSSGFRDFRSISAYRITIWACGFKHPSEFQHECVPQAVIGIANLCQSRSLMGKXGCFCITXLRIINPTEYVAKVLIICHTTEL

SEQ ID NO: 34453 - protein, 54 aa, Diabrotica virgifera
  misc_feature: Coding regions on vcDNA: vcDNA=SeqID_14150; Strand=+; Position=147-311
LAIVLFESVQVDISSVNCKLLQKLELNSLRPNRWSGDWSLKRESEFHTQNWNNC

SEQ ID NO: 34454 - protein, 99 aa, Diabrotica virgifera
  misc_feature: Coding regions on vcDNA: vcDNA=SeqID_14151; Strand=+; Position=102-398
  misc_feature: Homolog annotation: Hit_ID=XP_315245.1; Match level="QueryCoverage =71%, HitCoverage=9%, E-value=4e-17, Identity=57%"; Hit description =ENSANGP00000018017 [Anopheles gambiae]
MVSGPIDVSVLIIDNDTCLINKKSNKIISNVYEGIPETLVLNVVSWLLLILLFAILRNRAWDYGRLALVHTEKWTQLFYKNTDDAVAVEESDHEVSLIP

SEQ ID NO: 34455 - protein, 52 aa, Diabrotica virgifera
  misc_feature: Coding regions on vcDNA: vcDNA=SeqID_14152; Strand=-; Position=0-155
KRLWCSQKLTNDEIIQKLTIEIRLLKIFARLEYKQIKDFLEKKRYVQNLIEL

SEQ ID NO: 34456 - protein, 134 aa, Diabrotica virgifera
  misc_feature: Coding regions on vcDNA: vcDNA=SeqID_14153; Strand=+; Position=1-402
  misc_feature: Homolog annotation: Hit_ID=CAG32160.1; Match level="QueryCoverage =96%, HitCoverage=19%, E-value=7e-30, Identity=47%"; Hit description =hypothetical protein [Gallus gallus] ref|NP_001006549.1| similar to hypothetical protein FLJ11301
  misc_feature: Gene Ontology Annotation: Molecular function=GTPase activity; Cellular component=nucleolus; Biological process=signal transduction
  misc_feature (87)..(94): Xaa can be any naturally occurring amino acid
NKQKFETERENVTLVDVNKLGLLTAEETYRMMQKQKENKKCLRIPRRPEWDLTMEAEHLQKLEYEQFILWRQQLAEASEQQGLLFTXXXXXXXXWRQLWRVLERSDVIVQIVDARNPNMFYCEDIHTYSNEIQP

SEQ ID NO: 34457 - protein, 53 aa, Diabrotica virgifera
  misc_feature: Coding regions on vcDNA: vcDNA=SeqID_14154; Strand=-; Position=89-250
  misc_feature (11)..(20): Xaa can be any naturally occurring amino acid
  misc_feature (34)..(43): Xaa can be any naturally occurring amino acid
YYSITYLTCIXXXXXXXXXXKCFLIDTINKIIIXXXXXXXXXXVISKIFYEPI

SEQ ID NO: 34458 - protein, 64 aa, Diabrotica virgifera
  misc_feature: Coding regions on vcDNA: vcDNA=SeqID_14155; Strand=+; Position=12-206
RFKCSLYVYIQTTFFEKTLRFENISIYYIKYKNMFVEQNIFFNYLKVYFLRNFVRVIVIKFLFK

SEQ ID NO: 34459 - protein, 51 aa, Diabrotica virgifera
  misc_feature: Coding regions on vcDNA: vcDNA=SeqID_14156; Strand=+; Position=2-154
  misc_feature (44)..(51): Xaa can be any naturally occurring amino acid
TDAWDLLYNNKIFFSKPGDKFYLLIPNYYCETVFDFDHRKIYFXXXXXXXX

SEQ ID NO: 34460 - protein, 85 aa, Diabrotica virgifera
  misc_feature: Coding regions on vcDNA: vcDNA=SeqID_14157; Strand=+; Position=2-259
FFLVAVRARFLILCLITEWFLHIGIFFKLGSVPPLFIVLRIRVPNISKECSRLQPQSWNVFWLPVDRYCITLILQNLAIDTCFKI

SEQ ID NO: 34461 - protein, 60 aa, Diabrotica virgifera
  misc_feature: Coding regions on vcDNA: vcDNA=SeqID_14158; Strand=+; Position=2-181
GPQHQTVAMRGFDCLWDLAVGPKISTIAPYSQSHDTVKPCSFPLYSSLYTSPFRQSVFIT

SEQ ID NO: 34462 - protein, 47 aa, Diabrotica virgifera
  misc_feature: Coding regions on vcDNA: vcDNA=SeqID_14159; Strand=-; Position=1-141
HPPRDDETAVPAVTVLPHVPCTSKLVPPTICCVVASPIEMVIEQEDP

SEQ ID NO: 34463 - protein, 32 aa, Diabrotica virgifera
  misc_feature: Coding regions on vcDNA: vcDNA=SeqID_14160; Strand=-; Position=1-96
  misc_feature (1)..(7): Xaa can be any naturally occurring amino acid
  misc_feature (23)..(32): Xaa can be any naturally occurring amino acid
XXXXXXXTQTNNQTKIHKKGRAXXXXXXXXXX

SEQ ID NO: 34464 - protein, 129 aa, Diabrotica virgifera
  misc_feature: Coding regions on vcDNA: vcDNA=SeqID_14161; Strand=+; Position=9-395
VSRADPRVHPHVCHASDEYKPEETVIEFDVPQKTQSSTDIEIPTEYHHGKKRIAHASFETLFGPSKPPVITAKPKTVQTPGQTLANRYKLAKQAQANREQELLINQVQQTVVTKRPAPSLLEAAREKKK

SEQ ID NO: 34465 - protein, 55 aa, Diabrotica virgifera
  misc_feature: Coding regions on vcDNA: vcDNA=SeqID_14162; Strand=+; Position=64-231
QYIVKRVPISTGQVYSYHNLIPNNVSIQIDHTHAISMYHMVYPPMNIVESYLENF

SEQ ID NO: 34466 - protein, 68 aa, Diabrotica virgifera
  misc_feature: Coding regions on vcDNA: vcDNA=SeqID_14163; Strand=-; Position=1-204
RSYLHVFQYYKLSQKVVAYLPETDRQDREICLKFRPQMTLDLNRAFHSQSFVSSFRHMSYNPCILILF

SEQ ID NO: 34467 - protein, 66 aa, Diabrotica virgifera
  misc_feature: Coding regions on vcDNA: vcDNA=SeqID_14164; Strand=-; Position=178-378
  misc_feature (9)..(14): Xaa can be any naturally occurring amino acid
  misc_feature (55)..(62): Xaa can be any naturally occurring amino acid
LRICGKRGXXXXXXFLKTSEISKDSFTACNSTCKTQASCLKACAVCRQLIIACNXXXXXXXXFGTI

SEQ ID NO: 34468 - protein, 104 aa, Diabrotica virgifera
  misc_feature: Coding regions on vcDNA: vcDNA=SeqID_14165; Strand=+; Position=1-315
  misc_feature: Pfam annotation: Pfam_ID=CBM_14; Match level="Score=25.2, E-value =0.0002, Copies=1"; Pfam description=Chitin binding Peritrophin-A domain
IENNNMFKLLVFIFAITTVIAYETAFQYPVTCPPFDPSAPPVYEPDPYYCDIFYECSGSTPFQFHCAPGTNFDIKTNLCEFNVDCGDRSTTVGTTTEGTQPPKF

SEQ ID NO: 34469 - protein, 65 aa, Diabrotica virgifera
  misc_feature: Coding regions on vcDNA: vcDNA=SeqID_14166; Strand=+; Position=155-349
  misc_feature (2)..(12): Xaa can be any naturally occurring amino acid
IXXXXXXXXXXXYKIVYLVKIHTCNRGVPHHFFHPFSKNRSSWEQNKSSPWHRINLEGPGNWARA

SEQ ID NO: 34470 - protein, 44 aa, Diabrotica virgifera
  misc_feature: Coding regions on vcDNA: vcDNA=SeqID_14167; Strand=+; Position=155-286
YANFCFLPFLPILVIKFGKITIYVFSDNILMPNLPIWYTYLLES

SEQ ID NO: 34471 - protein, 28 aa, Diabrotica virgifera
  misc_feature: Coding regions on vcDNA: vcDNA=SeqID_14168; Strand=+; Position=3-89
LEYSSIRCSLGCFLQVRIALLNYILIKL

SEQ ID NO: 34472 - protein, 44 aa, Diabrotica virgifera
  misc_feature: Coding regions on vcDNA: vcDNA=SeqID_14169; Strand=-; Position=65-199
  misc_feature (4)..(21): Xaa can be any naturally occurring amino acid
  misc_feature (23)..(29): Xaa can be any naturally occurring amino acid
GCPXXXXXXXXXXXXXXXXXXIXXXXXXXIYTLYVKKFYKLIRI

SEQ ID NO: 34473 - protein, 26 aa, Diabrotica virgifera
  misc_feature: Coding regions on vcDNA: vcDNA=SeqID_14170; Strand=-; Position=2-79
  misc_feature (18)..(26): Xaa can be any naturally occurring amino acid
FKYFLGSIESSFYIKRKXXXXXXXXX

SEQ ID NO: 34474 - protein, 69 aa, Diabrotica virgifera
  misc_feature: Coding regions on vcDNA: vcDNA=SeqID_14171; Strand=+; Position=1-210
IALEMDFWRRSARKLRLERIQNDQVRNIIKSTIIDKIQRRQLIWYGHVERLHLFSPSYASSLLLLPLCE

SEQ ID NO: 34475 - protein, 79 aa, Diabrotica virgifera
  misc_feature: Coding regions on vcDNA: vcDNA=SeqID_14172; Strand=+; Position=1-240
  misc_feature (18)..(18): Xaa can be any naturally occurring amino acid
NMYSLGLTESPNCECGKXSNLLHILLECSHQSVNINKFYDNLNILKIPLPVYLNNLIFSEEINILKTIYEHIKNCKYRL

SEQ ID NO: 34476 - protein, 35 aa, Diabrotica virgifera
  misc_feature: Coding regions on vcDNA: vcDNA=SeqID_14173; Strand=+; Position=24-131
HIRFDFYQNANNPRMHFDQVQCPAEIVARSGCSWF

SEQ ID NO: 34477 - protein, 82 aa, Diabrotica virgifera
  misc_feature: Coding regions on vcDNA: vcDNA=SeqID_14174; Strand=+; Position=3-251
  misc_feature: Homolog annotation: Hit_ID=XP_316875.1; Match level="QueryCoverage =91%, HitCoverage=33%, E-value=1e-17, Identity=59%"; Hit description =ENSANGP00000013101 [Anopheles gambiae]
  misc_feature: Pfam annotation: Pfam_ID=CHCH; Match level="Score=48.2, E-value=2.3e -11, Copies=1"; Pfam description=CHCH domain
VTACPTVLFSGGGSSEAPVQQPPQQVAPQQQYAGTGAAGEQGPCSWEIKQFLQCSSTQSDLSLCQGFNEALQQCKVRNNIAV

SEQ ID NO: 34478 - protein, 131 aa, Diabrotica virgifera
  misc_feature: Coding regions on vcDNA: vcDNA=SeqID_14175; Strand=+; Position=3-398
  misc_feature: Homolog annotation: Hit_ID=NP_733041.2; Match level="QueryCoverage =90%, HitCoverage=13%, E-value=1e-09, Identity=33%"; Hit description =CG6995-PB, isoform B [Drosophila melanogaster] gb|AAN14018.2| CG6995- PB, isoform B [Drosophila
GRVGERRQQIEARRLEREKKKLEVEKERIAREKVALARIEREAHWEKQKKMEYDMTNMYEKDMDRRVSKRSAPFRREEFERKRPAYDRHFNEPPPPPSLKTREASPQSFSSRSKELYTKSVKYSVPKRDSL

SEQ ID NO: 34479 - protein, 112 aa, Diabrotica virgifera
  misc_feature: Coding regions on vcDNA: vcDNA=SeqID_14176; Strand=-; Position=2-337
  misc_feature (7)..(14): Xaa can be any naturally occurring amino acid
  misc_feature (17)..(76): Xaa can be any naturally occurring amino acid
  misc_feature (79)..(86): Xaa can be any naturally occurring amino acid
VLFHFEXXXXXXXXGGXXXXXXXXXXXXXXXXXXXXXXXXXXXXXXXXXXXXXXXXXXXXXXXXXXXXXXXXXXXXVEXXXXXXXXIFTNTKLMFCTVNTNIAAFSILRTRG

SEQ ID NO: 34480 - protein, 34 aa, Diabrotica virgifera
  misc_feature: Coding regions on vcDNA: vcDNA=SeqID_14177; Strand=-; Position=1-102
NAKGAGDRALASLAIMLCVSTRLTVLNEQILGAS

SEQ ID NO: 34481 - protein, 60 aa, Diabrotica virgifera
  misc_feature: Coding regions on vcDNA: vcDNA=SeqID_14178; Strand=-; Position=16-198
  misc_feature (5)..(34): Xaa can be any naturally occurring amino acid
PFRAXXXXXXXXXXXXXXXXXXXXXXXXXXXXXXSPIFVIHIYYIFIFIVSLDNYILFIY

SEQ ID NO: 34482 - protein, 45 aa, Diabrotica virgifera
  misc_feature: Coding regions on vcDNA: vcDNA=SeqID_14179; Strand=+; Position=89-223
  misc_feature (23)..(35): Xaa can be any naturally occurring amino acid
NDKSVASFYYKFIFVTEKLSNKXXXXXXXXXXXXXERKKKGGGAG

SEQ ID NO: 34483 - protein, 60 aa, Diabrotica virgifera
  misc_feature: Coding regions on vcDNA: vcDNA=SeqID_14180; Strand=+; Position=1-180
  misc_feature (6)..(23): Xaa can be any naturally occurring amino acid
  misc_feature (30)..(52): Xaa can be any naturally occurring amino acid
LFTYFXXXXXXXXXXXXXXXXXXLITIVRXXXXXXXXXXXXXXXXXXXXXXXLIYLLLSN

SEQ ID NO: 34484 - protein, 35 aa, Diabrotica virgifera
  misc_feature: Coding regions on vcDNA: vcDNA=SeqID_14181; Strand=+; Position=1-105
  misc_feature (4)..(16): Xaa can be any naturally occurring amino acid
  misc_feature (25)..(25): Xaa can be any naturally occurring amino acid
HCIXXXXXXXXXXXXXPFGSPVYYXPARGAPNIKS

SEQ ID NO: 34485 - protein, 123 aa, Diabrotica virgifera
  misc_feature: Coding regions on vcDNA: vcDNA=SeqID_14182; Strand=+; Position=20-388
  misc_feature: Homolog annotation: Hit_ID=NP_608909.1; Match level="QueryCoverage =96%, HitCoverage=96%, E-value=6e-21, Identity=44%"; Hit description =CG8680-PA [Drosophila melanogaster] gb|AAF52221.1| CG8680-PA [Drosophila melanogaster]
  misc_feature (62)..(62): Xaa can be any naturally occurring amino acid
  misc_feature (92)..(92): Xaa can be any naturally occurring amino acid
MVKMSQVKLLAQLSERILLRQSIATPAVRCMSDWVPKEKETHTGQKWASDDYRLSRRVCTPXHGGRGGAINLVDEVAPEACKDRVLWCDGGXGPERHPRVSINLGRPGNHACGYCGLRVYREG

SEQ ID NO: 34486 - protein, 60 aa, Diabrotica virgifera
  misc_feature: Coding regions on vcDNA: vcDNA=SeqID_14183; Strand=+; Position=3-182
DDQEFHAVFDYTTYWPTFKNLGIFEATVKQLFLRHHYKRTYNMTMINPQWTGRISAKKVP

SEQ ID NO: 34487 - protein, 128 aa, Diabrotica virgifera
  misc_feature: Coding regions on vcDNA: vcDNA=SeqID_14184; Strand=+; Position=1-384
  misc_feature: Homolog annotation: Hit_ID=NP_523775.2; Match level="QueryCoverage =96%, HitCoverage=5%, E-value=4e-13, Identity=38%"; Hit description =CG4903-PA [Drosophila melanogaster] gb|AAF57837.2| CG4903-PA [Drosophila melanogaster]
  misc_feature (90)..(96): Xaa can be any naturally occurring amino acid
KLEDVPKDTTIVEVKPALNESVDHDYCFVKPQIEEEKVEPIPEPPVEPPKVEAKQEKKPGSSSSSSSSDSDSSSCSCGSNCTCSSSSGSXXXXXXXSSSESSSEEGKKRQLAKKQKRKERAKKLKKTK

SEQ ID NO: 34488 - protein, 18 aa, Diabrotica virgifera
  misc_feature: Coding regions on vcDNA: vcDNA=SeqID_14185; Strand=-; Position=1-54
KSNEVSCLSSYPPILLVR

SEQ ID NO: 34489 - protein, 44 aa, Diabrotica virgifera
  misc_feature: Coding regions on vcDNA: vcDNA=SeqID_14186; Strand=+; Position=215-349
FDYLVVHFIYGLLTTTQIRMSYCRWVSLFQVALTALFGAYPERL

SEQ ID NO: 34490 - protein, 74 aa, Diabrotica virgifera
  misc_feature: Coding regions on vcDNA: vcDNA=SeqID_14187; Strand=+; Position=2-226
  misc_feature (19)..(27): Xaa can be any naturally occurring amino acid
  misc_feature (42)..(63): Xaa can be any naturally occurring amino acid
  misc_feature (65)..(72): Xaa can be any naturally occurring amino acid
GRVGGPWDLFRYNILVHSXXXXXXXXXYCERVFYFHNQKQLXXXXXXXXXXXXXXXXXXXXXXNXXXXXXXXVT

SEQ ID NO: 34491 - protein, 73 aa, Diabrotica virgifera
  misc_feature: Coding regions on vcDNA: vcDNA=SeqID_14188; Strand=+; Position=3-224
  misc_feature: Homolog annotation: Hit_ID=XP_318631.1; Match level="QueryCoverage =100%, HitCoverage=20%, E-value=1e-09, Identity=45%"; Hit description= ENSANGP00000021029 [Anopheles gambiae]
KVPPRDYVGGEDNGESPNLIRSQFSGGHRPSKLVQSQGIGYVAWGEEENSVKEYEVMGEFTGYWVAISPGNIP

SEQ ID NO: 34492 - protein, 21 aa, Diabrotica virgifera
  misc_feature: Coding regions on vcDNA: vcDNA=SeqID_14189; Strand=+; Position=3-65
HCFSCFSNQSHPHCFSKLILR

SEQ ID NO: 34493 - protein, 91 aa, Diabrotica virgifera
  misc_feature: Coding regions on vcDNA: vcDNA=SeqID_14190; Strand=+; Position=1-273
  misc_feature (28)..(28): Xaa can be any naturally occurring amino acid
  misc_feature (30)..(37): Xaa can be any naturally occurring amino acid
  misc_feature (53)..(69): Xaa can be any naturally occurring amino acid
  misc_feature (81)..(88): Xaa can be any naturally occurring amino acid
HPLTCGLIILIQTIFTSVITGLINYNYXFXXXXXXXXVGGILILFIYITRIAXXXXXXXXXXXXXXXXXIFTIISILRFIXXXXXXXXMNN

SEQ ID NO: 34494 - protein, 82 aa, Diabrotica virgifera
  misc_feature: Coding regions on vcDNA: vcDNA=SeqID_14191; Strand=+; Position=31-279
QYVDFIARHSYTIPSYHTHVHLGSRHRPDPSRKLHITSLDIPLDKWDGAKVSLYVPILSRHSSPLQLLHAASKPKLTMQPIV

SEQ ID NO: 34495 - protein, 52 aa, Diabrotica virgifera
  misc_feature: Coding regions on vcDNA: vcDNA=SeqID_14192; Strand=+; Position=143-301
MFKNNTDDKDIEETVLDEEPVLDEEPVPSKSSSSAKRQWKDMKFQQKMFVLL

SEQ ID NO: 34496 - protein, 74 aa, Diabrotica virgifera
  misc_feature: Coding regions on vcDNA: vcDNA=SeqID_14193; Strand=-; Position=3-224
  misc_feature (11)..(33): Xaa can be any naturally occurring amino acid
  misc_feature (37)..(44): Xaa can be any naturally occurring amino acid
  misc_feature (50)..(61): Xaa can be any naturally occurring amino acid
  misc_feature (70)..(74): Xaa can be any naturally occurring amino acid
VFLKTDYLSLXXXXXXXXXXXXXXXXXXXXXXXIINXXXXXXXXWYTRFXXXXXXXXXXXXFLQFLFTIXXXXX

SEQ ID NO: 34497 - protein, 38 aa, Diabrotica virgifera
  misc_feature: Coding regions on vcDNA: vcDNA=SeqID_14194; Strand=+; Position=1-117
PTRPEKIYYMHILSYLCENKFRFIRVRINWCTLCPRDY

SEQ ID NO: 34498 - protein, 22 aa, Diabrotica virgifera
  misc_feature: Coding regions on vcDNA: vcDNA=SeqID_14195; Strand=-; Position=1-66
VAVTLGVTATPSAINAPLHGES

SEQ ID NO: 34499 - protein, 103 aa, Diabrotica virgifera
  misc_feature: Coding regions on vcDNA: vcDNA=SeqID_14196; Strand=-; Position=3-311
  misc_feature (1)..(8): Xaa can be any naturally occurring amino acid
  misc_feature (12)..(30): Xaa can be any naturally occurring amino acid
  misc_feature (33)..(54): Xaa can be any naturally occurring amino acid
  misc_feature (60)..(76): Xaa can be any naturally occurring amino acid
  misc_feature (78)..(93): Xaa can be any naturally occurring amino acid
  misc_feature (96)..(103): Xaa can be any naturally occurring amino acid
XXXXXXXXKNSXXXXXXXXXXXXXXXXXXXFMXXXXXXXXXXXXXXXXXXXXXXIEIFNXXXXXXXXXXXXXXXXXYXXXXXXXXXXXXXXXXYSXXXXXXXX

SEQ ID NO: 34500 - protein, 96 aa, Diabrotica virgifera
  misc_feature: Coding regions on vcDNA: vcDNA=SeqID_14197; Strand=+; Position=1-291
  misc_feature: Homolog annotation: Hit_ID=AAF63957.1; Match level="QueryCoverage =95%, HitCoverage=21%, E-value=4e-12, Identity=45%"; Hit description =CALNUC [Spodoptera frugiperda]
QKPYTDEELAEYIRQHEQYQQGIPQGYHPGAYQVPPAGYQHPPPGAGYQQQHPAGGYQQHPQAGYQQPPPPGYQHQPRVGGYQQPPQQGYQQHHLK

SEQ ID NO: 34501 - protein, 119 aa, Diabrotica virgifera
  misc_feature: Coding regions on vcDNA: vcDNA=SeqID_14198; Strand=+; Position=3-362
NSFLSTQYKKRKELYHNVNLSNIAALIILTKEFIEIMNKMEKITRTSEESIDQFLEKTSELIISWLSTKSKSDDESIKGTYITEVERNLTENDILNSTIYAISTWNDNDNVYWKLSHEV

SEQ ID NO: 34502 - protein, 118 aa, Diabrotica virgifera
  misc_feature: Coding regions on vcDNA: vcDNA=SeqID_14199; Strand=-; Position=1-354
  misc_feature (12)..(26): Xaa can be any naturally occurring amino acid
  misc_feature (29)..(60): Xaa can be any naturally occurring amino acid
  misc_feature (65)..(71): Xaa can be any naturally occurring amino acid
  misc_feature (73)..(85): Xaa can be any naturally occurring amino acid
  misc_feature (95)..(113): Xaa can be any naturally occurring amino acid
GLCYLGTVKIRXXXXXXXXXXXXXXXYKXXXXXXXXXXXXXXXXXXXXXXXXXXXXXXXXVIIRXXXXXXXVXXXXXXXXXXXXXYIKLISNMLXXXXXXXXXXXXXXXXXXXFIYKL

SEQ ID NO: 34503 - protein, 110 aa, Diabrotica virgifera
  misc_feature: Coding regions on vcDNA: vcDNA=SeqID_14200; Strand=+; Position=38-367
  misc_feature (83)..(92): Xaa can be any naturally occurring amino acid
LQLFLVKMDCCKKGESRTIVKQCKLTKKDGTVVDCECTCTCKCENDCKGSACPGKNGCNCDCTEETAKLGPDGKYRCVCECTXXXXXXXXXXHIYFVVCSKAFYKDCILF

SEQ ID NO: 34504 - protein, 152 aa, Diabrotica virgifera
  misc_feature: Coding regions on vcDNA: vcDNA=SeqID_14201; Strand=+; Position=2-457
RRVGVELTEKIDNEELRKAVIYRYNSFKQAQEEITEYEPTEQELRELLTRGDILLQKQSEQAATDTSDVKCDQNRKNDDAGIDFPQIQEHSSSTEDNVKDEATNHLEATVEVKTISDTNENAYQIDKTNIESSENKMEASEDIPESIKEHIT

SEQ ID NO: 34505 - protein, 125 aa, Diabrotica virgifera
  misc_feature: Coding regions on vcDNA: vcDNA=SeqID_14202; Strand=-; Position=1-375
  misc_feature (3)..(121): Xaa can be any naturally occurring amino acid
KDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTRL

SEQ ID NO: 34506 - protein, 144 aa, Diabrotica virgifera
  misc_feature: Coding regions on vcDNA: vcDNA=SeqID_14203; Strand=+; Position=3-434
  misc_feature: Homolog annotation: Hit_ID=XP_316580.1; Match level="QueryCoverage =74%, HitCoverage=18%, E-value=1e-22, Identity=46%"; Hit description =ENSANGP00000011538 [Anopheles gambiae]
TRPESHSSGGEEAPTKDVQEPKPGPSQEPGDKENDEEEPADEEAANSWLNECFDAYEAGGYSPKFLTPDEIEPGTIVVIEEDDLKRLEFARIQVVGKGKTVENVITKEELMLQKEARKGMDGDEAQFSVEQALDSQVPPWSDKY

SEQ ID NO: 34507 - protein, 66 aa, Diabrotica virgifera
  misc_feature: Coding regions on vcDNA: vcDNA=SeqID_14204; Strand=-; Position=1-198
QSTTSRCIKIKNASHADACHPRSEPAQGCDQVRGQQPTDQTDWCPKIHDKMSKKTGGPLKRQPKNP

SEQ ID NO: 34508 - protein, 35 aa, Diabrotica virgifera
  misc_feature: Coding regions on vcDNA: vcDNA=SeqID_14205; Strand=-; Position=69-176
  misc_feature (6)..(12): Xaa can be any naturally occurring amino acid
TRKMRXXXXXXXTSCSGNLSQLSLRNTLKKKLKIS

SEQ ID NO: 34509 - protein, 87 aa, Diabrotica virgifera
  misc_feature: Coding regions on vcDNA: vcDNA=SeqID_14206; Strand=-; Position=1-261
  misc_feature (55)..(61): Xaa can be any naturally occurring amino acid
SYLLYLLGVVWFGYRLCDESLCATVRVTFVRFREFTFDVAVVDGSVATGFCYAVXXXXXXXKKWHTNSVIASFHSLLGAQVFDFIKV

SEQ ID NO: 34510 - protein, 50 aa, Diabrotica virgifera
  misc_feature: Coding regions on vcDNA: vcDNA=SeqID_14207; Strand=-; Position=60-212
  misc_feature (1)..(18): Xaa can be any naturally occurring amino acid
  misc_feature (36)..(49): Xaa can be any naturally occurring amino acid
XXXXXXXXXXXXXXXXXXFYAMKIFTPNSHLKLKSXXXXXXXXXXXXXXY

SEQ ID NO: 34511 - protein, 87 aa, Diabrotica virgifera
  misc_feature: Coding regions on vcDNA: vcDNA=SeqID_14208; Strand=+; Position=21-281
  misc_feature: Homolog annotation: Hit_ID=XP_316724.1; Match level="QueryCoverage =94%, HitCoverage=3%, E-value=3e-31, Identity=79%"; Hit description =ENSANGP00000002653 [Anopheles gambiae] gb|EAA11800.1| ENSANGP00000002653 [Anopheles gambiae
  misc_feature: Gene Ontology Annotation: Molecular function=actin binding; Cellular component=plasma membrane; Biological process=neuromuscular synaptic transmission
  misc_feature: Pfam annotation: Pfam_ID=efhand; Match level="Score=24.8, E-value =0.00027, Copies=1"; Pfam description=EF hand
  misc_feature (74)..(74): Xaa can be any naturally occurring amino acid
HASANAQQGDQLDQLGRRRQHNLEQQIQARNQSGVSEEALKEVSRMFEQFDKEKSGKLNHQEFKSCRLALGYDXPMVEEGQPDPEWD

SEQ ID NO: 34512 - protein, 45 aa, Diabrotica virgifera
  misc_feature: Coding regions on vcDNA: vcDNA=SeqID_14209; Strand=-; Position=106-243
  misc_feature (12)..(26): Xaa can be any naturally occurring amino acid
HEYDNEIASTHXXXXXXXXXXXXXXXAHLQLKMLVTVRTVQPYEM

SEQ ID NO: 34513 - protein, 26 aa, Diabrotica virgifera
  misc_feature: Coding regions on vcDNA: vcDNA=SeqID_14210; Strand=-; Position=33-113
CLINSFHKFWFVPEMYEHLNSIITHE

SEQ ID NO: 34514 - protein, 68 aa, Diabrotica virgifera
  misc_feature: Coding regions on vcDNA: vcDNA=SeqID_14211; Strand=+; Position=3-206
  misc_feature: Homolog annotation: Hit_ID=XP_310958.1; Match level="QueryCoverage =97%, HitCoverage=5%, E-value=5e-18, Identity=69%"; Hit description =ENSANGP00000019328 [Anopheles gambiae]
  misc_feature: Gene Ontology Annotation: Molecular function=pre-mRNA splicing factor activity; Cellular component=spliceosome complex; Biological process =mRNA splicing
HAIRQYRVAELNVQCGVRKSLGFLLEYIGEMGKDYIYAVAPRLGEARRGGDLVDRETACAAIKHIGLG

SEQ ID NO: 34515 - protein, 137 aa, Diabrotica virgifera
  misc_feature: Coding regions on vcDNA: vcDNA=SeqID_14212; Strand=+; Position=1-414
KPTNMIAVAVTFCLLVLSAQGQIPVQRCPDVNGVADFDGRAYLGDGYQQGTYPPSLEDHGRSCCDQYCSKHRWMYEESYAIYQFRHKSDTRSRTRSTTMFITWGLSISSTFLNSRLTCTFPGSWHRLLNLLCTLRPF

SEQ ID NO: 34516 - protein, 51 aa, Diabrotica virgifera
  misc_feature: Coding regions on vcDNA: vcDNA=SeqID_14213; Strand=+; Position=3-158
  misc_feature (31)..(37): Xaa can be any naturally occurring amino acid
HASDFLEYYQIDLFDLLYDLTSIQLILVHFXXXXXXXDDFTIIHVQVYQTN

SEQ ID NO: 34517 - protein, 67 aa, Diabrotica virgifera
  misc_feature: Coding regions on vcDNA: vcDNA=SeqID_14214; Strand=+; Position=67-267
  misc_feature: Homolog annotation: Hit_ID=XP_393092.1; Match level="QueryCoverage =100%, HitCoverage=30%, E-value=2e-15, Identity=56%"; Hit description= similar to QM protein [Apis mellifera]
  misc_feature: Gene Ontology Annotation: Cellular component=cytosolic large ribosomal subunit (sensu Eukarya); Biological process=protein biosynthesis
  misc_feature (41)..(41): Xaa can be any naturally occurring amino acid
CKNKRHPSSRFCNGVPHPNDRSFDMGTMKASLQGVPLCVDXVSDEYAEPISASLDSGRSCWDKYFVK

SEQ ID NO: 34518 - protein, 60 aa, Diabrotica virgifera
  misc_feature: Coding regions on vcDNA: vcDNA=SeqID_14215; Strand=-; Position=1-180
LYGPQILPTEPVLQLYFSRSFEWLILSGKFRTEVLVSRFKLETFAETTHSFFLVKVVGAH

SEQ ID NO: 34519 - protein, 59 aa, Diabrotica virgifera
  misc_feature: Coding regions on vcDNA: vcDNA=SeqID_14216; Strand=+; Position=1-180
  misc_feature (17)..(17): Xaa can be any naturally occurring amino acid
KRHPGEYRGGGEYVVPXGFGWANGETLTLNNEFYAKSHKKHHKHGKSHHRHEKQGNNDV

SEQ ID NO: 34520 - protein, 115 aa, Diabrotica virgifera
  misc_feature: Coding regions on vcDNA: vcDNA=SeqID_14217; Strand=+; Position=2-349
EGSALNCYGCHAKVGNGSSCETGKNISSTLSHTCTTPQDRTKTLACITLLTNTTIYRYCGYNNTCNLNETIKTTGFKWCKSCTTNLCNTQSSSVSIIAPTILTPMIIVTVVLSYF

SEQ ID NO: 34521 - protein, 18 aa, Diabrotica virgifera
  misc_feature: Coding regions on vcDNA: vcDNA=SeqID_14218; Strand=-; Position=1-54
LFFMFFLFSLFKTYFMNF

SEQ ID NO: 34522 - protein, 63 aa, Diabrotica virgifera
  misc_feature: Coding regions on vcDNA: vcDNA=SeqID_14219; Strand=+; Position=163-354
YDILLHFRYMYLYFIFSFYKHVIILLFISGCVCKTSMCIFCFLYSFSLYKYTYKFKLHSCCII

SEQ ID NO: 34523 - protein, 145 aa, Diabrotica virgifera
  misc_feature: Coding regions on vcDNA: vcDNA=SeqID_14220; Strand=+; Position=1-438
  misc_feature (2)..(9): Xaa can be any naturally occurring amino acid
PXXXXXXXXCSTIDGKIINISDFQSMDEFKNGCNATEEETLQRKQTIGVGSLSREEKTNSSESSETNSTKNRTVRVVQEENVIVIKENDSNLIFGVSLTTILVSVLSFLSGLLLGFFLNHFIRRRQNLEESESTTKLIIGNKVPH

SEQ ID NO: 34524 - protein, 139 aa, Diabrotica virgifera
  misc_feature: Coding regions on vcDNA: vcDNA=SeqID_14221; Strand=+; Position=16-432
  misc_feature: Homolog annotation: Hit_ID=XP_321394.1; Match level="QueryCoverage =100%, HitCoverage=63%, E-value=9e-55, Identity=69%"; Hit description= ENSANGP00000012182 [Anopheles gambiae]
  misc_feature: Gene Ontology Annotation: Molecular function=endopeptidase activity; Cellular component=proteasome core complex (sensu Eukarya); Biological process=protein catabolism
  misc_feature: Pfam annotation: Pfam_ID=Proteasome; Match level="Score=53.7, E-value= 5.4e-13, Copies=1"; Pfam description=Proteasome A-type and B-type
MVAMKGENCVAIAADRRFGIQAQTVATNFQKIFEMGPHLYVGLPGLATDTQTVMEKLRFRKNLYELKENRKISPKVFASMISNMLYEKRFGPFFVEPVVAGLLPNTYEPFICNMDLIGCINQPSDFVVGGTASAQLYGM

SEQ ID NO: 34525 - protein, 123 aa, Diabrotica virgifera
  misc_feature: Coding regions on vcDNA: vcDNA=SeqID_14222; Strand=+; Position=1-372
GFWSNVKVSALLTNVINIVEPFVCMWYDYERECLDCVISKLAQFVINKLVLKANTNEDFIKCECLGDLSFLTKLHLPSLVESWETEDYGYIKYHLIKNPDVKKVYNKMYKIVSKIVVETFEEM

SEQ ID NO: 34526 - protein, 87 aa, Diabrotica virgifera
  misc_feature: Coding regions on vcDNA: vcDNA=SeqID_14223; Strand=-; Position=45-308
  misc_feature (34)..(84): Xaa can be any naturally occurring amino acid
KIFKRRPINLNLVTLLKGFELAFKVNLSLNLLGXXXXXXXXXXXXXXXXXXXXXXXXXXXXXXXXXXXXXXXXXXXXXXXXXXXFIT

SEQ ID NO: 34527 - protein, 148 aa, Diabrotica virgifera
  misc_feature: Coding regions on vcDNA: vcDNA=SeqID_14224; Strand=+; Position=3-446
ILNWNSATSCSIKTRILLKQHISIRIMILRILIITCFISMIYASRIITRDDPVPDESACICHHGYTIQKHPKDNKFYCKGILHDGKTACVNLERPQCKCTLIKGFVIQDIYRYWCVKVKPGYVEEIRWDCENKKEWDRFFDIYPEERP

SEQ ID NO: 34528 - protein, 103 aa, Diabrotica virgifera
  misc_feature: Coding regions on vcDNA: vcDNA=SeqID_14225; Strand=+; Position=1-312
QTRPGLSLYFMSFVRKPSFVFRYNAIKKFVPFVLSYESSVKTFGTHITYIFYNWSRCSITISCNKDREICGNESCNVIKVGHWVCCVVHTGCSLVEHDALFPH

SEQ ID NO: 34529 - protein, 134 aa, Diabrotica virgifera
  misc_feature: Coding regions on vcDNA: vcDNA=SeqID_14226; Strand=+; Position=2-403
  misc_feature: Homolog annotation: Hit_ID=XP_310958.1; Match level="QueryCoverage =99%, HitCoverage=10%, E-value=2e-60, Identity=84%"; Hit description =ENSANGP00000019328 [Anopheles gambiae]
  misc_feature: Gene Ontology Annotation: Molecular function=pre-mRNA splicing factor activity; Cellular component=spliceosome complex; Biological process =mRNA splicing
EIISKYQVPELNVQNGVLKSLSILFEDIRAMGKEYIYAVTPLLEDALMDWDLIHRQTACTAIKHKALGVYGFGCEDALIHLLNYVWPNIFETSPHLVQAFMDAIKGMPVALGPIKILHYTLQGLFHPASKVRDV

SEQ ID NO: 34530 - protein, 47 aa, Diabrotica virgifera
  misc_feature: Coding regions on vcDNA: vcDNA=SeqID_14227; Strand=-; Position=0-140
VKHNCFITNNYVVLLFKDCILKWQRYQQGIGLWAKCIVRIHPTCGQT

SEQ ID NO: 34531 - protein, 77 aa, Diabrotica virgifera
  misc_feature: Coding regions on vcDNA: vcDNA=SeqID_14228; Strand=+; Position=11-244
  misc_feature: Homolog annotation: Hit_ID=BAB88642.1; Match level="QueryCoverage =96%, HitCoverage=24%, E-value=1e-12, Identity=48%"; Hit description =NADH dehydrogenase subunit 5 [Leptura aethiops]
  misc_feature (12)..(19): Xaa can be any naturally occurring amino acid
  misc_feature (28)..(28): Xaa can be any naturally occurring amino acid
  misc_feature (50)..(56): Xaa can be any naturally occurring amino acid
  misc_feature (58)..(58): Xaa can be any naturally occurring amino acid
  misc_feature (76)..(76): Xaa can be any naturally occurring amino acid
LVFSTPIFICLXXXXXXXXLIFIIVGVXLGYELAKFKISYNLLRLNNISXXXXXXXIXNIPFLSTLGINYYPIYFXG

SEQ ID NO: 34532 - protein, 46 aa, Diabrotica virgifera
  misc_feature: Coding regions on vcDNA: vcDNA=SeqID_14229; Strand=+; Position=1-141
  misc_feature: Homolog annotation: Hit_ID=XP_312468.1; Match level="QueryCoverage =100%, HitCoverage=38%, E-value=2e-13, Identity=65%"; Hit description= ENSANGP00000022037 [Anopheles gambiae]
EKVDLDWDHTWVQRCHGYRKGVDFYKKYFNVIPIPQHQNFKLVNEI

SEQ ID NO: 34533 - protein, 95 aa, Diabrotica virgifera
  misc_feature: Coding regions on vcDNA: vcDNA=SeqID_14230; Strand=+; Position=1-288
KLKMQDFGEFVKTMENNKMDRVKKNTETIKVMADMVLEEMTKMYEQLLVDVAKGTASEIDVKTSEKMCETVERTTFDIIHKMKFIYNEGNIMLNE

SEQ ID NO: 34534 - protein, 65 aa, Diabrotica virgifera
  misc_feature: Coding regions on vcDNA: vcDNA=SeqID_14231; Strand=-; Position=20-217
  misc_feature (1)..(16): Xaa can be any naturally occurring amino acid
  misc_feature (57)..(63): Xaa can be any naturally occurring amino acid
XXXXXXXXXXXXXXXXFLKSYSLIHKVHTLIIYFIPISWSLSILMNCPYLKNYVTIXXXXXXXIQ

SEQ ID NO: 34535 - protein, 67 aa, Diabrotica virgifera
  misc_feature: Coding regions on vcDNA: vcDNA=SeqID_14232; Strand=-; Position=2-202
  misc_feature (53)..(66): Xaa can be any naturally occurring amino acid
CIQPVWRCSKLSSRRRQPWCPWCVRPMLLMKSSGVVIYYGQVNEKSPLRMKKXXXXXXXXXXXXXXD

SEQ ID NO: 34536 - protein, 105 aa, Diabrotica virgifera
  misc_feature: Coding regions on vcDNA: vcDNA=SeqID_14233; Strand=+; Position=13-327
  misc_feature (64)..(88): Xaa can be any naturally occurring amino acid
FFFPFLFFYRHDSVSFFNLPLVSCNSIVVVVFPLIVFLLGHHLSLFLLLFLLSFGVCGHSTVIXXXXXXXXXXXXXXXXXXXXXXXXXCKIKKIVFCIKFKSLKQ

SEQ ID NO: 34537 - protein, 64 aa, Diabrotica virgifera
  misc_feature: Coding regions on vcDNA: vcDNA=SeqID_14234; Strand=+; Position=75-269
  misc_feature (25)..(35): Xaa can be any naturally occurring amino acid
  misc_feature (43)..(57): Xaa can be any naturally occurring amino acid
SLMSEMKAFLKGWIDFMYLCNQGLXXXXXXXXXXXFIKAQKFXXXXXXXXXXXXXXXKMLIDFR

SEQ ID NO: 34538 - protein, 76 aa, Diabrotica virgifera
  misc_feature: Coding regions on vcDNA: vcDNA=SeqID_14235; Strand=-; Position=1-228
  misc_feature (1)..(18): Xaa can be any naturally occurring amino acid
  misc_feature (23)..(42): Xaa can be any naturally occurring amino acid
  misc_feature (47)..(58): Xaa can be any naturally occurring amino acid
  misc_feature (64)..(75): Xaa can be any naturally occurring amino acid
XXXXXXXXXXXXXXXXXXRVTLXXXXXXXXXXXXXXXXXXXXSFKLXXXXXXXXXXXXWYPRFXXXXXXXXXXXXL

SEQ ID NO: 34539 - protein, 125 aa, Diabrotica virgifera
  misc_feature: Coding regions on vcDNA: vcDNA=SeqID_14236; Strand=+; Position=3-377
  misc_feature (3)..(13): Xaa can be any naturally occurring amino acid
HAXXXXXXXXXXXTNKRIAFPLSTNTSSTANQNQTLPNLPPLAQPLTKPPSTLDSTCESVCQLLNSEQSRQNFENIWKGQLPEQFQKTVSLMVGCLTGNNKEAAKLHKETLLTEYKTLCDRWIDE

SEQ ID NO: 34540 - protein, 33 aa, Diabrotica virgifera
  misc_feature: Coding regions on vcDNA: vcDNA=SeqID_14237; Strand=+; Position=3-101
GKFLSLNSNLNVAFPVAADADPLKQAKFQVIKL

SEQ ID NO: 34541 - protein, 69 aa, Diabrotica virgifera
  misc_feature: Coding regions on vcDNA: vcDNA=SeqID_14238; Strand=+; Position=1-210
  misc_feature (4)..(9): Xaa can be any naturally occurring amino acid
TDAXXXXXXFFQSDLDYSRFALRLYYIISTNLLFSLHLPPDVELHPARRVAMASDVYSELSIFSKSTFS

SEQ ID NO: 34542 - protein, 118 aa, Diabrotica virgifera
  misc_feature: Coding regions on vcDNA: vcDNA=SeqID_14239; Strand=-; Position=3-356
  misc_feature (56)..(95): Xaa can be any naturally occurring amino acid
PLRKGVFFPGVLVGFPPGFPRPDLFNRRPLNWILVPPLGGFAFPFPRTLAWLPLGXXXXXXXXXXXXXXXXXXXXXXXXXXXXXXXXXXXXXXXXKLVYFFLKLVIKLFVSNFKPYKE

SEQ ID NO: 34543 - protein, 77 aa, Diabrotica virgifera
  misc_feature: Coding regions on vcDNA: vcDNA=SeqID_14240; Strand=-; Position=1-231
  misc_feature (1)..(77): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXX

SEQ ID NO: 34544 - protein, 87 aa, Diabrotica virgifera
  misc_feature: Coding regions on vcDNA: vcDNA=SeqID_14241; Strand=+; Position=143-403
  misc_feature: Homolog annotation: Hit_ID=AAL67865.1; Match level="QueryCoverage =94%, HitCoverage=36%, E-value=2e-09, Identity=42%"; Hit description =ATP synthase F0 subunit 6 [Crioceris duodecimpunctata] ref|NP _569064.1| ATP synthase F0 subunit 6
  misc_feature (18)..(18): Xaa can be any naturally occurring amino acid
  misc_feature (33)..(33): Xaa can be any naturally occurring amino acid
  misc_feature (38)..(44): Xaa can be any naturally occurring amino acid
  misc_feature (51)..(60): Xaa can be any naturally occurring amino acid
  misc_feature (74)..(83): Xaa can be any naturally occurring amino acid
IKLNYFDPTSNFNLPINXLRTVLGLLIIPSRFXLIPSXXXXXXXKIIITLXXXXXXXXXXYKSQGRTLIFISLXXXXXXXXXXGLFP

SEQ ID NO: 34545 - protein, 32 aa, Diabrotica virgifera
  misc_feature: Coding regions on vcDNA: vcDNA=SeqID_14242; Strand=+; Position=49-147
  misc_feature (10)..(16): Xaa can be any naturally occurring amino acid
VMQNFMFKLXXXXXXXRLEDPIEFYEIIKKFF

SEQ ID NO: 34546 - protein, 80 aa, Diabrotica virgifera
  misc_feature: Coding regions on vcDNA: vcDNA=SeqID_14243; Strand=+; Position=101-343
  misc_feature: Homolog annotation: Hit_ID=CAG32181.1; Match level="QueryCoverage =92%, HitCoverage=93%, E-value=8e-26, Identity=74%"; Hit description =hypothetical protein [Gallus gallus] ref|NP_055021.1| chromosome 11 open reading frame 10 [Homo
  misc_feature: Pfam annotation: Pfam_ID=UPF0197; Match level="Score=152.6, E-value =8.7e-43, Copies=1"; Pfam description=Uncharacterised protein family (UPF019
MVDTARLTRYASPVNPAIFPHLTLVLLGIGIFFTAWFFVYEVTSTKKSRSLKKELLVALVASIFSGFGILFLLLSVRIYV

SEQ ID NO: 34547 - protein, 108 aa, Diabrotica virgifera
  misc_feature: Coding regions on vcDNA: vcDNA=SeqID_14244; Strand=+; Position=3-329
  misc_feature (83)..(90): Xaa can be any naturally occurring amino acid
HAYEKSVFLGDFKAQEVYSVFHLKWEGSLDFRKDGKYDNNVICTIILAALEDPYLPKNIRIVQAVFEIIECFHTWNSLCIHKXXXXXXXXLLHEPQKNGIGTQNNLLL

SEQ ID NO: 34548 - protein, 112 aa, Diabrotica virgifera
  misc_feature: Coding regions on vcDNA: vcDNA=SeqID_14245; Strand=+; Position=42-380
RMVLGSDISRFCPWMAANLLAMESTFPWASKWIPSSSMICGILCFPHVLDLIIFHKLPWFSSAFRMRLCHFASLRVLSRCHISVESSSAYVVYSSLLLLWYVRQALCLSLIY

SEQ ID NO: 34549 - protein, 78 aa, Diabrotica virgifera
  misc_feature: Coding regions on vcDNA: vcDNA=SeqID_14246; Strand=-; Position=0-233
  misc_feature (1)..(8): Xaa can be any naturally occurring amino acid
  misc_feature (13)..(71): Xaa can be any naturally occurring amino acid
XXXXXXXXLFKFXXXXXXXXXXXXXXXXXXXXXXXXXXXXXXXXXXXXXXXXXXXXXXXXXXXXXXXXXXXIYIIEIV

SEQ ID NO: 34550 - protein, 85 aa, Diabrotica virgifera
  misc_feature: Coding regions on vcDNA: vcDNA=SeqID_14247; Strand=+; Position=149-403
TIRAYYSKAKFSKMKATLVLAVLVCVVGLTVSAPQTSDHCNACVGFSSMVKNYVLNQRPLEEVEKDSEDLCQRFYDMKVRNFCEN

SEQ ID NO: 34551 - protein, 69 aa, Diabrotica virgifera
  misc_feature: Coding regions on vcDNA: vcDNA=SeqID_14248; Strand=+; Position=147-356
KTSLSFGKTFIPFVLKTFTSSLAVITQAIKSVCQILVNNLIIIKYLMVSVNKVSNYAVHSSHKFQNILA

SEQ ID NO: 34552 - protein, 48 aa, Diabrotica virgifera
  misc_feature: Coding regions on vcDNA: vcDNA=SeqID_14249; Strand=+; Position=35-181
IFDILLGVRDIEKSYLKKLFQIFYPHIPGFMTEFLLLVSSIFCSQDPK

SEQ ID NO: 34553 - protein, 136 aa, Diabrotica virgifera
  misc_feature: Coding regions on vcDNA: vcDNA=SeqID_14250; Strand=+; Position=1-408
  misc_feature: Homolog annotation: Hit_ID=XP_317526.1; Match level="QueryCoverage =90%, HitCoverage=29%, E-value=1e-09, Identity=30%"; Hit description =ENSANGP00000010143 [Anopheles gambiae]
IFEEYLSKKLWEGVLLDTYIPDLIEESQVLPNFFNNSHIEHLLLFLEKFPSVAKDLPLEDFVVRARKKYYDVYNVVKKSKKYKNVLNHGDVWQPNFFYKFDSKHKPSSAIVFDFQLLRYAPPALDLLMPLHVNATK

SEQ ID NO: 34554 - protein, 146 aa, Diabrotica virgifera
  misc_feature: Coding regions on vcDNA: vcDNA=SeqID_14251; Strand=+; Position=3-440
  misc_feature: Homolog annotation: Hit_ID=XP_394563.1; Match level="QueryCoverage =99%, HitCoverage=26%, E-value=9e-25, Identity=37%"; Hit description =similar to hypothetical protein HH114 [Apis mellifera]
  misc_feature (48)..(60): Xaa can be any naturally occurring amino acid
  misc_feature (64)..(68): Xaa can be any naturally occurring amino acid
RMKISHPRTQHNKQRFWELYQQSVEKKEAPGIIVRIAEKFDIGPCLVXXXXXXXXXXXXXDENXXXXXNINVYLRDTSLISDPVLAYEMFLCTLYDNVYSPITDAMKSSLGQQYEIKLYREATQLGLGFRDEEQLKKYGYDKTPDC

SEQ ID NO: 34555 - protein, 77 aa, Diabrotica virgifera
  misc_feature: Coding regions on vcDNA: vcDNA=SeqID_14252; Strand=+; Position=143-373
  misc_feature (22)..(22): Xaa can be any naturally occurring amino acid
  misc_feature (37)..(37): Xaa can be any naturally occurring amino acid
  misc_feature (42)..(48): Xaa can be any naturally occurring amino acid
  misc_feature (55)..(64): Xaa can be any naturally occurring amino acid
PTRPIKLNYFDPTSNFNLPINXLRTVLGLLIIPSRFXLIPSXXXXXXXKIIITLXXXXXXXXXXYKSQGRTLIFISL

SEQ ID NO: 34556 - protein, 118 aa, Diabrotica virgifera
  misc_feature: Coding regions on vcDNA: vcDNA=SeqID_14253; Strand=-; Position=1-354
  misc_feature (9)..(118): Xaa can be any naturally occurring amino acid
EKIVPEFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34557 - protein, 148 aa, Diabrotica virgifera
  misc_feature: Coding regions on vcDNA: vcDNA=SeqID_14254; Strand=+; Position=2-445
KRVRVLAVLFLIFFCEVLSVSISNRQKTPLPIASPPNYDPDLSNIIKSIQNMEGVAENFTKNILRNHYRNLNQNLTDLDRRLAATTNEDIIGRCVSRFQFSQSIKTIVNEQIKNCATIVLAEYQNVITNSLNMAQGVMKFSTIVWTDI

SEQ ID NO: 34558 - protein, 137 aa, Diabrotica virgifera
  misc_feature: Coding regions on vcDNA: vcDNA=SeqID_14255; Strand=-; Position=2-412
  misc_feature: Homolog annotation: Hit_ID=AAW56879.1; Match level="QueryCoverage =93%, HitCoverage=6%, E-value=2e-15, Identity=33%"; Hit description =putative polyprotein [Oryza sativa (japonica cultivar-group)]
  misc_feature: Pfam annotation: Pfam_ID=DUF659; Match level="Score=-18.9, E-value =0.00013, Copies=1"; Pfam description=Protein of unknown function (DUF 659)
MLSNRLLTEEYERVEVQVNDKIKQADNLSLQCDGWSNLRNESVINFIVTTPEPLFVKSVLTKAEKHTAEYITKLMVEVLEEYGPKKFFAIVTDNAKNMRKAVRQCEEMYPHLVSYGCLAHTLHLLCSDILKLSSIEI

SEQ ID NO: 34559 - protein, 40 aa, Diabrotica virgifera
  misc_feature: Coding regions on vcDNA: vcDNA=SeqID_14256; Strand=-; Position=2-121
  misc_feature (26)..(36): Xaa can be any naturally occurring amino acid
NIIITNKYYLKKSIIHSTPTITTPTXXXXXXXXXXXIIHK

SEQ ID NO: 34560 - protein, 99 aa, Diabrotica virgifera
  misc_feature: Coding regions on vcDNA: vcDNA=SeqID_14257; Strand=-; Position=92-391
  misc_feature (44)..(50): Xaa can be any naturally occurring amino acid
LCYYVSVDIIHNIWLLTFLCTCKFFHFFMYIKNIMFCLQLLYFXXXXXXXSSFAILISFLISFSICLYLCPFFLFIILRLSMRRRILSVIYLCFIFGFL

SEQ ID NO: 34561 - protein, 45 aa, Diabrotica virgifera
  misc_feature: Coding regions on vcDNA: vcDNA=SeqID_14258; Strand=+; Position=109-246
WILFVRYYKHNLKILLLAILDKSIVSMDKRDLRNKILLVQMLEDD

SEQ ID NO: 34562 - protein, 29 aa, Diabrotica virgifera
  misc_feature: Coding regions on vcDNA: vcDNA=SeqID_14259; Strand=-; Position=3-89
  misc_feature (7)..(20): Xaa can be any naturally occurring amino acid
MSHKKVXXXXXXXXXXXXXXPTASFIPNP

SEQ ID NO: 34563 - protein, 81 aa, Diabrotica virgifera
  misc_feature: Coding regions on vcDNA: vcDNA=SeqID_14260; Strand=+; Position=1-243
AFQRVPTLHFPAGNFITLQIGNINSFHGPFFFNLITGKPLGLPNLRPLQLIPLIKSALLMTRATPFVLPKNFPAVLWKGTP

SEQ ID NO: 34564 - protein, 73 aa, Diabrotica virgifera
  misc_feature: Coding regions on vcDNA: vcDNA=SeqID_14261; Strand=+; Position=173-394
RLWPLRYSRLSLLTDIFGLPETCTFFNFYTLHPSFFFNFKYLIKKSFGYSKGHLALSNNVIFHSAFKFFKNTY

SEQ ID NO: 34565 - protein, 76 aa, Diabrotica virgifera
  misc_feature: Coding regions on vcDNA: vcDNA=SeqID_14262; Strand=+; Position=168-398
QKWQFPHFLGVMDGKREISTSQKGWDEIIKELTASDAGGRFQRSALSASLTNQRIQLGISGKSPHDVFLGRGTISF

SEQ ID NO: 34566 - protein, 119 aa, Diabrotica virgifera
  misc_feature: Coding regions on vcDNA: vcDNA=SeqID_14263; Strand=+; Position=24-383
  misc_feature: Homolog annotation: Hit_ID=XP_307637.1; Match level="QueryCoverage =99%, HitCoverage=54%, E-value=5e-45, Identity=72%"; Hit description =ENSANGP00000016192 [Anopheles gambiae]
  misc_feature: Gene Ontology Annotation: Molecular function=v-SNARE activity; Cellular component=Golgi membrane; Biological process=vesicle -mediated transport
  misc_feature: Pfam annotation: Pfam_ID=Synaptobrevin; Match level="Score=78.5, E -value=1.8e-20, Copies=1"; Pfam description=Synaptobrevin
  misc_feature (1)..(1): Xaa can be any naturally occurring amino acid
XHAQYGKRVNTVTRPYTFIEFDTYIQKAKKQFADSRSRRNLNVINNQLHDVQRIMVQNIDDVLQRGTVLSELDTKTQNLSMLTDKYKKDSTYLNTKSMYVTAAVGGLVFLSFILYFWIL

SEQ ID NO: 34567 - protein, 90 aa, Diabrotica virgifera
  misc_feature: Coding regions on vcDNA: vcDNA=SeqID_14264; Strand=+; Position=164-433
VVPYLTVTSVIPVLILSVQILKLMITNSTFYLPCDEDYHGNKPFCRIYVTNIQHVKDPKDAIRIYRSCGWENSKGITKDLCRHDDSDFVK

SEQ ID NO: 34568 - protein, 45 aa, Diabrotica virgifera
  misc_feature: Coding regions on vcDNA: vcDNA=SeqID_14265; Strand=+; Position=101-238
MQCLFPALLSMSAGYRIHTLNNFQGIPYIGRSLKHLRLTCLYPIT

SEQ ID NO: 34569 - protein, 53 aa, Diabrotica virgifera
  misc_feature: Coding regions on vcDNA: vcDNA=SeqID_14266; Strand=+; Position=23-184
SQCKLRGRVSVRVLIILPKTISKNRTIYGLSTSNISSYVVKATSDEPHQRFLQ

SEQ ID NO: 34570 - protein, 40 aa, Diabrotica virgifera
  misc_feature: Coding regions on vcDNA: vcDNA=SeqID_14267; Strand=+; Position=2-124
IGIYVLRNIHQTTFEKYIWWAALVVYILLMIGALIATILM

SEQ ID NO: 34571 - protein, 88 aa, Diabrotica virgifera
  misc_feature: Coding regions on vcDNA: vcDNA=SeqID_14268; Strand=+; Position=22-285
  misc_feature: Homolog annotation: Hit_ID=CAA76930.1; Match level="QueryCoverage =86%, HitCoverage=21%, E-value=5e-16, Identity=48%"; Hit description =polygalacturonase [Phaedon cochleariae]
THNVQQDYNGGGSSGYATSNIQINGLHLQSVTGSLKSGKAVYILCGNKACSNFNWSSISIYGGNEKNGCNYHPNGFSCYNIYIYELIK

SEQ ID NO: 34572 - protein, 34 aa, Diabrotica virgifera
  misc_feature: Coding regions on vcDNA: vcDNA=SeqID_14269; Strand=+; Position=118-222
FILSDVRLQVLCDGIGIAALRSLMRTALPMFLIL

SEQ ID NO: 34573 - protein, 42 aa, Diabrotica virgifera
  misc_feature: Coding regions on vcDNA: vcDNA=SeqID_14270; Strand=-; Position=0-125
  misc_feature (6)..(39): Xaa can be any naturally occurring amino acid
LGNLKXXXXXXXXXXXXXXXXXXXXXXXXXXXXXXXXXXCVG

SEQ ID NO: 34574 - protein, 60 aa, Diabrotica virgifera
  misc_feature: Coding regions on vcDNA: vcDNA=SeqID_14271; Strand=-; Position=2-181
  misc_feature (25)..(44): Xaa can be any naturally occurring amino acid
KKVRIIMILIIRKNIIFNFENVPLXXXXXXXXXXXXXXXXXXXXTKYLYLKSSIFCSLEK

SEQ ID NO: 34575 - protein, 71 aa, Diabrotica virgifera
  misc_feature: Coding regions on vcDNA: vcDNA=SeqID_14272; Strand=-; Position=51-266
LKGIKPESLGIRGICFQENKDKLDHTVTPISTNHIIVVLNNFSGISIRIKPVSQISNISQYKLLLKQARFG

SEQ ID NO: 34576 - protein, 83 aa, Diabrotica virgifera
  misc_feature: Coding regions on vcDNA: vcDNA=SeqID_14273; Strand=-; Position=1-249
  misc_feature (26)..(41): Xaa can be any naturally occurring amino acid
  misc_feature (53)..(61): Xaa can be any naturally occurring amino acid
IVLKIPSHVPTEQKNSKSKHISTYVXXXXXXXXXXXXXXXXTFHTFFCNEYCXXXXXXXXXLVTFQPKPFFFSNLLLSAQFLF

SEQ ID NO: 34577 - protein, 93 aa, Diabrotica virgifera
  misc_feature: Coding regions on vcDNA: vcDNA=SeqID_14274; Strand=-; Position=80-361
  misc_feature (20)..(25): Xaa can be any naturally occurring amino acid
  misc_feature (48)..(62): Xaa can be any naturally occurring amino acid
FSVNPMNFLILNGTPCILFXXXXXXETLITFHIIFPIPECHNFEIIAXXXXXXXXXXXXXXXFSASRFYFRFFLSLRTKKDLCNFPPKLIISE

SEQ ID NO: 34578 - protein, 67 aa, Diabrotica virgifera
  misc_feature: Coding regions on vcDNA: vcDNA=SeqID_14275; Strand=-; Position=2-202
  misc_feature (8)..(17): Xaa can be any naturally occurring amino acid
LQKSIFWXXXXXXXXXXKKPEFCVRIRTISQRFNYKNFEKFHLGNTYCKIEIVYPKKLIYNDIMRNP

SEQ ID NO: 34579 - protein, 56 aa, Diabrotica virgifera
  misc_feature: Coding regions on vcDNA: vcDNA=SeqID_14276; Strand=-; Position=163-333
  misc_feature (17)..(23): Xaa can be any naturally occurring amino acid
GGTEPILRNMLVCGDTXXXXXXXQKRVCTAIKKNKKKHFLQINFISCLDIVSHWNY

SEQ ID NO: 34580 - protein, 46 aa, Diabrotica virgifera
  misc_feature: Coding regions on vcDNA: vcDNA=SeqID_14277; Strand=-; Position=87-227
  misc_feature (33)..(45): Xaa can be any naturally occurring amino acid
LFSTKKFENIDLINSKLLSLNYKVHNPMLLKVXXXXXXXXXXXXXS

SEQ ID NO: 34581 - protein, 86 aa, Diabrotica virgifera
  misc_feature: Coding regions on vcDNA: vcDNA=SeqID_14278; Strand=-; Position=0-257
  misc_feature (1)..(85): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 34582 - protein, 115 aa, Diabrotica virgifera
  misc_feature: Coding regions on vcDNA: vcDNA=SeqID_14279; Strand=+; Position=2-349
  misc_feature (1)..(45): Xaa can be any naturally occurring amino acid
  misc_feature (49)..(58): Xaa can be any naturally occurring amino acid
  misc_feature (61)..(83): Xaa can be any naturally occurring amino acid
  misc_feature (86)..(113): Xaa can be any naturally occurring amino acid
XXXXXXXXXXXXXXXXXXXXXXXXXXXXXXXXXXXXXXXXXXXXXQGLXXXXXXXXXXEFXXXXXXXXXXXXXXXXXXXXXXXLFXXXXXXXXXXXXXXXXXXXXXXXXXXXXQY

SEQ ID NO: 34583 - protein, 40 aa, Diabrotica virgifera
  misc_feature: Coding regions on vcDNA: vcDNA=SeqID_14280; Strand=-; Position=116-238
IHFICNSKLYILWFKSTYFCTECAKFTIEIRIIDFVTKYI

SEQ ID NO: 34584 - protein, 34 aa, Diabrotica virgifera
  misc_feature: Coding regions on vcDNA: vcDNA=SeqID_14281; Strand=-; Position=1-102
YSTNISDSSLKQHDCKESIKSYFNIIFSNRSINS

SEQ ID NO: 34585 - protein, 25 aa, Diabrotica virgifera
  misc_feature: Coding regions on vcDNA: vcDNA=SeqID_14282; Strand=+; Position=1-75
NSRLDDASAANQMITMTRATFLLHL

SEQ ID NO: 34586 - protein, 100 aa, Diabrotica virgifera
  misc_feature: Coding regions on vcDNA: vcDNA=SeqID_14283; Strand=+; Position=21-320
  misc_feature: Homolog annotation: Hit_ID=EAL30128.1; Match level="QueryCoverage =97%, HitCoverage=45%, E-value=3e-20, Identity=47%"; Hit description =GA10934-PA [Drosophila pseudoobscura]
  misc_feature (3)..(3): Xaa can be any naturally occurring amino acid
PTXNPGAVQFGNFINYYQFHSPDDRITLLPKYIWDQHKPLVALDIGCNTGNLTIALKDFLEEHVSKDTSVLAVDIDPVLIDRAKDVKTNNIKFECLDIMD

SEQ ID NO: 34587 - protein, 63 aa, Diabrotica virgifera
  misc_feature: Coding regions on vcDNA: vcDNA=SeqID_14284; Strand=+; Position=127-318
HTLHDGIKIKRAHCHGDRSVTRSASSTTFIERISNRCGAAPSLFRLLNATNVTLRSKYFVNVS

SEQ ID NO: 34588 - protein, 120 aa, Diabrotica virgifera
  misc_feature: Coding regions on vcDNA: vcDNA=SeqID_14285; Strand=+; Position=17-376
  misc_feature: Pfam annotation: Pfam_ID=MARVEL; Match level="Score=1.0, E-value =0.033, Copies=1"; Pfam description=Membrane-associating domain
KMSVQKYGTEYLRSYPGLLKVCEQVLNISVIIAGSICGFLFKTILLNFNAIYALCTTLFFLIVHYKALFRKSTFPWDWIECANSLAVAVVYALGASITLSELSKEYIVAGIIGYIHCNGV

SEQ ID NO: 34589 - protein, 80 aa, Diabrotica virgifera
  misc_feature: Coding regions on vcDNA: vcDNA=SeqID_14286; Strand=-; Position=5-247
  misc_feature (14)..(20): Xaa can be any naturally occurring amino acid
  misc_feature (34)..(43): Xaa can be any naturally occurring amino acid
  misc_feature (57)..(63): Xaa can be any naturally occurring amino acid
  misc_feature (73)..(80): Xaa can be any naturally occurring amino acid
NLNHPEILLVRSSXXXXXXXDIRVFNSRYIVSNXXXXXXXXXXLYLNTIHISFQKMXXXXXXXDKNANFVALXXXXXXXX

SEQ ID NO: 34590 - protein, 126 aa, Diabrotica virgifera
  misc_feature: Coding regions on vcDNA: vcDNA=SeqID_14287; Strand=-; Position=1-378
  misc_feature (6)..(126): Xaa can be any naturally occurring amino acid
KDLFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34591 - protein, 57 aa, Diabrotica virgifera
  misc_feature: Coding regions on vcDNA: vcDNA=SeqID_14288; Strand=-; Position=48-221
  misc_feature (10)..(17): Xaa can be any naturally occurring amino acid
  misc_feature (31)..(42): Xaa can be any naturally occurring amino acid
TYEFKLIIQXXXXXXXXYTNFKLFEFRFLEXXXXXXXXXXXXVNILAFYQVKCFIHD

SEQ ID NO: 34592 - protein, 66 aa, Diabrotica virgifera
  misc_feature: Coding regions on vcDNA: vcDNA=SeqID_14289; Strand=+; Position=2-202
RGRVGFFTICAVISSIFLDSSLSFILIYFLLISLNIIFKCALYHIFGIAFHLFSGLERFIIYSFLS

SEQ ID NO: 34593 - protein, 69 aa, Diabrotica virgifera
  misc_feature: Coding regions on vcDNA: vcDNA=SeqID_14290; Strand=+; Position=78-287
  misc_feature (16)..(29): Xaa can be any naturally occurring amino acid
YRDVFDRGQYNNCIFXXXXXXXXXXXXXXIIVIYIQALDFKLAATEERFCFLSIKNQIIINVICISQDM

SEQ ID NO: 34594 - protein, 56 aa, Diabrotica virgifera
  misc_feature: Coding regions on vcDNA: vcDNA=SeqID_14291; Strand=-; Position=2-169
SFFLMQSIGLLYMFHSFVIPILGFWYLVAACTGLVDDCYIFLESLGRLQKAFIACD

SEQ ID NO: 34595 - protein, 53 aa, Diabrotica virgifera
  misc_feature: Coding regions on vcDNA: vcDNA=SeqID_14292; Strand=+; Position=62-223
CYNLSKELVNIQLSGVLLFEVLNFINKGSTCFKLGSHGTWRGTFYQFTVDEEK

SEQ ID NO: 34596 - protein, 74 aa, Diabrotica virgifera
  misc_feature: Coding regions on vcDNA: vcDNA=SeqID_14293; Strand=+; Position=64-288
  misc_feature: Homolog annotation: Hit_ID=Q28640; Match level="QueryCoverage=95%, HitCoverage=15%, E-value=1e-12, Identity=47%"; Hit description =Histidine-rich glycoprotein precursor (Histidine-proline rich glycoprotein) (HPRG)
  misc_feature: Gene Ontology Annotation: Cellular component=vacuole; Biological process=proteolysis and peptidolysis
MSHHGPPHRRSPSPPPPHHHGPGHDHHDHGPPHHHDQGPHHHDHGHHGRPPPPGPPAREYPPGQYPPGHHHPPR

SEQ ID NO: 34597 - protein, 48 aa, Diabrotica virgifera
  misc_feature: Coding regions on vcDNA: vcDNA=SeqID_14294; Strand=-; Position=1-144
  misc_feature (15)..(21): Xaa can be any naturally occurring amino acid
  misc_feature (28)..(40): Xaa can be any naturally occurring amino acid
NFNLWALLNWEFLNXXXXXXXPVETRCXXXXXXXXXXXXXLPLLINFH

SEQ ID NO: 34598 - protein, 105 aa, Diabrotica virgifera
  misc_feature: Coding regions on vcDNA: vcDNA=SeqID_14295; Strand=+; Position=3-320
  misc_feature: Pfam annotation: Pfam_ID=SapB_1; Match level="Score=9.7, E-value =0.066, Copies=1"; Pfam description=Saposin-like type B, region 1
PMKSCFELAILVCVGLTVSAQKNDDISDELCYACEELAKLIQESKQRGIPLEEVDEKVRKLCHLLPGFLEVLCDYQLIPDIDQMYNQTEDISPRDQCVKLELCNN

SEQ ID NO: 34599 - protein, 29 aa, Diabrotica virgifera
  misc_feature: Coding regions on vcDNA: vcDNA=SeqID_14296; Strand=+; Position=2-91
QLTCKYMYIRFVLNEYMNHLYLNTNENMI

SEQ ID NO: 34600 - protein, 42 aa, Diabrotica virgifera
  misc_feature: Coding regions on vcDNA: vcDNA=SeqID_14297; Strand=-; Position=184-312
FSINTNAKLTINLTGKNNTGVKNGGRPTTDDFTKLFGSHSKF

SEQ ID NO: 34601 - protein, 138 aa, Diabrotica virgifera
  misc_feature: Coding regions on vcDNA: vcDNA=SeqID_14298; Strand=+; Position=3-416
  misc_feature: Homolog annotation: Hit_ID=XP_310836.1; Match level="QueryCoverage =99%, HitCoverage=31%, E-value=9e-44, Identity=56%"; Hit description =ENSANGP00000012432 [Anopheles gambiae]
  misc_feature: Pfam annotation: Pfam_ID=TMPIT; Match level="Score=-71.3, E-value =5.4e-07, Copies=1"; Pfam description=TMPIT-like protein
FILGRIDVSFLNKERKFQYKEDYEKFKLVCHFIAFVLCITLSHYNYRFLDKIFAGFLAWYYCTISIRESILKVNGSRIKGWWRVHHILSIVSSGLLLTWPDNEPWELFRVYFIRYTIYSTFTQYLQFRYQRGVLHRLK

SEQ ID NO: 34602 - protein, 103 aa, Diabrotica virgifera
  misc_feature: Coding regions on vcDNA: vcDNA=SeqID_14299; Strand=-; Position=23-334
  misc_feature (8)..(73): Xaa can be any naturally occurring amino acid
KFETFEGXXXXXXXXXXXXXXXXXXXXXXXXXXXXXXXXXXXXXXXXXXXXXXXXXXXXXXXXXXXXXXXXXXLQCSYHNFSTKNNIEKQGTYKSYTVEMSNS

SEQ ID NO: 34603 - protein, 86 aa, Diabrotica virgifera
  misc_feature: Coding regions on vcDNA: vcDNA=SeqID_14300; Strand=-; Position=3-260
  misc_feature (62)..(86): Xaa can be any naturally occurring amino acid
KGAQYKAGTLGDSRVFRVTTIVKGRTVNRTQGAEVERDDGDSGLARPGTARAAGVEGSFVVXXXXXXXXXXXXXXXXXXXXXXXXX

SEQ ID NO: 34604 - protein, 46 aa, Diabrotica virgifera
  misc_feature: Coding regions on vcDNA: vcDNA=SeqID_14301; Strand=+; Position=3-143
  misc_feature (6)..(12): Xaa can be any naturally occurring amino acid
RVRYGXXXXXXXTFIQFCQTTNRYVFSNILLILTKSIDYFKLLDVK

SEQ ID NO: 34605 - protein, 111 aa, Diabrotica virgifera
  misc_feature: Coding regions on vcDNA: vcDNA=SeqID_14302; Strand=+; Position=1-337
  misc_feature: Homolog annotation: Hit_ID=EAL42096.1; Match level="QueryCoverage =91%, HitCoverage=43%, E-value=1e-20, Identity=41%"; Hit description =ENSANGP00000026495 [Anopheles gambiae str. PEST] ref|XP_560600.1| ENSANGP00000026495 [Anopheles gambiae st
  misc_feature: Gene Ontology Annotation: Molecular function=ceramidase activity; Cellular component=membrane fraction
  misc_feature (15)..(15): Xaa can be any naturally occurring amino acid
  misc_feature (29)..(29): Xaa can be any naturally occurring amino acid
PPDFVTGHPRNDVMXNKTFLTVQKTKQSXQDKPTWKTIATDASWETKFIWSRPDPLTPTSQAEIRWEIPDDTQPGSYQIQHFGNYKTLFSGIYAYSGVSRIFSVKENCQSK

SEQ ID NO: 34606 - protein, 59 aa, Diabrotica virgifera
  misc_feature: Coding regions on vcDNA: vcDNA=SeqID_14303; Strand=+; Position=2-181
SGNSGGPLVVNGVQIGIVSFGSSIVIIDCTLIHTEFILPGPDCISFGPFILILAHLILC

SEQ ID NO: 34607 - protein, 49 aa, Diabrotica virgifera
  misc_feature: Coding regions on vcDNA: vcDNA=SeqID_14304; Strand=+; Position=1-150
  misc_feature (26)..(35): Xaa can be any naturally occurring amino acid
  misc_feature (38)..(46): Xaa can be any naturally occurring amino acid
NFIDFKIVKCFFTESTDEFYLMIVTXXXXXXXXXXTRXXXXXXXXXQGL

SEQ ID NO: 34608 - protein, 51 aa, Diabrotica virgifera
  misc_feature: Coding regions on vcDNA: vcDNA=SeqID_14305; Strand=+; Position=109-261
  misc_feature (35)..(50): Xaa can be any naturally occurring amino acid
PFFHQTSFINYLSLIKTNMLLLQCPIKIVPYYVNXXXXXXXXXXXXXXXXE

SEQ ID NO: 34609 - protein, 43 aa, Diabrotica virgifera
  misc_feature: Coding regions on vcDNA: vcDNA=SeqID_14306; Strand=-; Position=3-131
RPLHYQRHHLICFAVTVHSARPYRLNLSTSIEVLQTPMSPCHD

SEQ ID NO: 34610 - protein, 122 aa, Diabrotica virgifera
  misc_feature: Coding regions on vcDNA: vcDNA=SeqID_14307; Strand=+; Position=38-403
  misc_feature: Homolog annotation: Hit_ID=CAE47497.1; Match level="QueryCoverage =95%, HitCoverage=37%, E-value=2e-26, Identity=55%"; Hit description =cathepsin L-like proteinase [Diabrotica virgifera virgifera]
  misc_feature (21)..(27): Xaa can be any naturally occurring amino acid
  misc_feature (30)..(38): Xaa can be any naturally occurring amino acid
  misc_feature (60)..(66): Xaa can be any naturally occurring amino acid
  misc_feature (71)..(77): Xaa can be any naturally occurring amino acid
SCSFAALVVATSTNLGAFEKXXXXXXXHRXXXXXXXXXLRCAVFEDNLKMFEEHNAEYEXXXXXXXLAVNXXXXXXXAEFHAMLARQIANTAKQSLSALHVTDANVNAVEKLYWRDSAFLGF

SEQ ID NO: 34611 - protein, 47 aa, Diabrotica virgifera
  misc_feature: Coding regions on vcDNA: vcDNA=SeqID_14308; Strand=+; Position=34-177
TAMTGIHVQVPSGAQYPALCPWPLHVYLSLLSKFVYSFLNTTIVFYL

SEQ ID NO: 34612 - protein, 75 aa, Diabrotica virgifera
  misc_feature: Coding regions on vcDNA: vcDNA=SeqID_14309; Strand=-; Position=168-395
KIIESYQDDTLTVCSQGNRQPKARTHSRHSSLSRCPRPTLSIDSNLSTDHEHGAKSDVTKLGGAHTDSKQSRLQR

SEQ ID NO: 34613 - protein, 67 aa, Diabrotica virgifera
  misc_feature: Coding regions on vcDNA: vcDNA=SeqID_14310; Strand=+; Position=222-422
AVHFWYKIIVFAQFTRLKFENLELSISVGPSVNTTHRLLEQIERQIKCRMRAFNPWIKDEKFVLGLP

SEQ ID NO: 34614 - protein, 60 aa, Diabrotica virgifera
  misc_feature: Coding regions on vcDNA: vcDNA=SeqID_14311; Strand=-; Position=141-323
ELMELLPPSMIPRAIRKELLLPQHIHLERVATNQYLVVLTARPPSVSAHPHGKLKKTPRA

SEQ ID NO: 34615 - protein, 44 aa, Diabrotica virgifera
  misc_feature: Coding regions on vcDNA: vcDNA=SeqID_14312; Strand=+; Position=2-133
  misc_feature (4)..(33): Xaa can be any naturally occurring amino acid
MIVXXXXXXXXXXXXXXXXXXXXXXXXXXXXXXRFSIFEFRRAK

SEQ ID NO: 34616 - protein, 28 aa, Diabrotica virgifera
  misc_feature: Coding regions on vcDNA: vcDNA=SeqID_14313; Strand=+; Position=3-86
  misc_feature (1)..(7): Xaa can be any naturally occurring amino acid
XXXXXXXGMYDTLETIIKNHFISKTNVI

SEQ ID NO: 34617 - protein, 44 aa, Diabrotica virgifera
  misc_feature: Coding regions on vcDNA: vcDNA=SeqID_14314; Strand=+; Position=1-135
  misc_feature (17)..(24): Xaa can be any naturally occurring amino acid
QTRPKHFTNIYLLRLNXXXXXXXXEGNTSKVYIVKIDKKSALVL

SEQ ID NO: 34618 - protein, 47 aa, Diabrotica virgifera
  misc_feature: Coding regions on vcDNA: vcDNA=SeqID_14315; Strand=-; Position=2-142
IKVLDFITKVRQMYTTFIRFSSERFHHVYHHKNLGFREKMVNFLNIR

SEQ ID NO: 34619 - protein, 45 aa, Diabrotica virgifera
  misc_feature: Coding regions on vcDNA: vcDNA=SeqID_14316; Strand=-; Position=1-135
  misc_feature (9)..(22): Xaa can be any naturally occurring amino acid
  misc_feature (35)..(40): Xaa can be any naturally occurring amino acid
IYTFLKNSXXXXXXXXXXXXXXYTKICKQIIVSFXXXXXXDKILL

SEQ ID NO: 34620 - protein, 33 aa, Diabrotica virgifera
  misc_feature: Coding regions on vcDNA: vcDNA=SeqID_14317; Strand=-; Position=0-98
  misc_feature (2)..(10): Xaa can be any naturally occurring amino acid
  misc_feature (20)..(32): Xaa can be any naturally occurring amino acid
SXXXXXXXXXLQTKILPNLXXXXXXXXXXXXXA

SEQ ID NO: 34621 - protein, 97 aa, Diabrotica virgifera
  misc_feature: Coding regions on vcDNA: vcDNA=SeqID_14318; Strand=+; Position=2-292
  misc_feature: Homolog annotation: Hit_ID=XP_317319.1; Match level="QueryCoverage =100%, HitCoverage=18%, E-value=1e-25, Identity=59%"; Hit description= ENSANGP00000006854 [Anopheles gambiae]
KNHLVLDICMYNDPAMLDCMYVEAMNTMQTNPDYAKMFRGRPGRFVLPLNSNSNTDKTKNLVGIKNTRAKAYYMSDGNIFVKPEKLCDLRCETPRIH

SEQ ID NO: 34622 - protein, 125 aa, Diabrotica virgifera
  misc_feature: Coding regions on vcDNA: vcDNA=SeqID_14319; Strand=+; Position=1-375
  misc_feature: Homolog annotation: Hit_ID=XP_314995.1; Match level="QueryCoverage =80%, HitCoverage=19%, E-value=1e-20, Identity=48%"; Hit description =ENSANGP00000021298 [Anopheles gambiae]
  misc_feature: Gene Ontology Annotation: Molecular function=catalase activity; Cellular component=cytoplasm; Biological process=response to hydrogen peroxide
APNYFPNSFNGPVCDKVAQHLEPAFTVSGEAYRYDTGDSDNFSQARRFVQKVLNREQQDRLVSNIVGHLSGALDFIQERQVNHFKQVDQSFGERIAAGLQNVKHTKYFFVMYLIFVVNQRVCQRL

SEQ ID NO: 34623 - protein, 117 aa, Diabrotica virgifera
  misc_feature: Coding regions on vcDNA: vcDNA=SeqID_14320; Strand=+; Position=13-366
  misc_feature (1)..(33): Xaa can be any naturally occurring amino acid
  misc_feature (35)..(47): Xaa can be any naturally occurring amino acid
  misc_feature (57)..(63): Xaa can be any naturally occurring amino acid
  misc_feature (72)..(96): Xaa can be any naturally occurring amino acid
  misc_feature (102)..(109): Xaa can be any naturally occurring amino acid
XXXXXXXXXXXXXXXXXXXXXXXXXXXXXXXXXKXXXXXXXXXXXXXVIRYLLVSKXXXXXXXHFYCRINSXXXXXXXXXXXXXXXXXXXXXXXXXFSNNRXXXXXXXXINMKDFYG

SEQ ID NO: 34624 - protein, 31 aa, Diabrotica virgifera
  misc_feature: Coding regions on vcDNA: vcDNA=SeqID_14321; Strand=-; Position=196-291
EFNAVKTRLNQTLIPYDNKKYNQNVTLTMKI

SEQ ID NO: 34625 - protein, 41 aa, Diabrotica virgifera
  misc_feature: Coding regions on vcDNA: vcDNA=SeqID_14322; Strand=-; Position=2-124
  misc_feature (30)..(38): Xaa can be any naturally occurring amino acid
ILKVQQTQCSRCHTNYKLYSNIELAISFLXXXXXXXXXPTR

SEQ ID NO: 34626 - protein, 34 aa, Diabrotica virgifera
  misc_feature: Coding regions on vcDNA: vcDNA=SeqID_14323; Strand=+; Position=3-107
  misc_feature (19)..(19): Xaa can be any naturally occurring amino acid
NVVIVKIDVDECDHRATEXNIKSMPTVIFLKNGQ

SEQ ID NO: 34627 - protein, 25 aa, Diabrotica virgifera
  misc_feature: Coding regions on vcDNA: vcDNA=SeqID_14324; Strand=-; Position=0-74
IPNIVNIALKAPNKGHGLISPTRPL

SEQ ID NO: 34628 - protein, 75 aa, Diabrotica virgifera
  misc_feature: Coding regions on vcDNA: vcDNA=SeqID_14325; Strand=+; Position=1-225
  misc_feature (2)..(12): Xaa can be any naturally occurring amino acid
  misc_feature (17)..(27): Xaa can be any naturally occurring amino acid
TXXXXXXXXXXXQHKEXXXXXXXXXXXTRGLQSPLKVTSGNCPGQPLKRLHSLHFPLFAYQTFFTQAPSSTTGCF

SEQ ID NO: 34629 - protein, 70 aa, Diabrotica virgifera
  misc_feature: Coding regions on vcDNA: vcDNA=SeqID_14326; Strand=-; Position=0-209
LEPSDCRRGNTVAYTQRTSRDVCSSTITVHKNQKEHNLIFQKKPSISQHCTARFHFYEEYAIKRYFKPSL

SEQ ID NO: 34630 - protein, 120 aa, Diabrotica virgifera
  misc_feature: Coding regions on vcDNA: vcDNA=SeqID_14327; Strand=+; Position=46-405
  misc_feature: Homolog annotation: Hit_ID=XP_394345.1; Match level="QueryCoverage =100%, HitCoverage=47%, E-value=5e-44, Identity=72%"; Hit description= similar to ENSANGP00000017482 [Apis mellifera]
  misc_feature: Gene Ontology Annotation: Molecular function=molecular_function unknown; Cellular component=DNA-directed RNA polymerase II, holoenzyme; Biological process=regulation of transcription, DNA -dependent
  misc_feature (9)..(15): Xaa can be any naturally occurring amino acid
  misc_feature (40)..(45): Xaa can be any naturally occurring amino acid
MRRGIGVGXXXXXXXEQERYRGKGNEIQESQFGQMTKQMXXXXXXLEDFATKHKNEIRKNPEFRKQFQEMCASIGVDPLSSGKGFWSVLGIGDFYYELAVQIVEVCLSTTAKNGGLISLD

SEQ ID NO: 34631 - protein, 47 aa, Diabrotica virgifera
  misc_feature: Coding regions on vcDNA: vcDNA=SeqID_14328; Strand=+; Position=3-143
LRVSFVDCDVIPIKLRLGLGVRPIIPPLLDLESYPGGGDDLPDRQFG

SEQ ID NO: 34632 - protein, 45 aa, Diabrotica virgifera
  misc_feature: Coding regions on vcDNA: vcDNA=SeqID_14329; Strand=-; Position=170-307
DQKPFPGHNGCTPVLAHRSGNCLPKLWTSLLAHNGVPWQKLMDIY

SEQ ID NO: 34633 - protein, 133 aa, Diabrotica virgifera
  misc_feature: Coding regions on vcDNA: vcDNA=SeqID_14330; Strand=+; Position=3-401
  misc_feature: Homolog annotation: Hit_ID=XP_395658.1; Match level="QueryCoverage =94%, HitCoverage=41%, E-value=3e-30, Identity=45%"; Hit description =similar to RH02901p [Apis mellifera]
KNRSINALLEVGTGKLLGTSNWDVNVVAGILSKDGSVEFSVDYFKVHINISQNMDTSIPPSLEDIQLELGNIQITFDGLGTVDYLIEFGVNVIPNLLRYQIMDAVEKLIQFKIQEALNQITIDKLINQNAQQL

SEQ ID NO: 34634 - protein, 70 aa, Diabrotica virgifera
  misc_feature: Coding regions on vcDNA: vcDNA=SeqID_14331; Strand=+; Position=3-212
  misc_feature (24)..(24): Xaa can be any naturally occurring amino acid
  misc_feature (35)..(35): Xaa can be any naturally occurring amino acid
PTPCQIINISLFRLPSPANISSLXKFWISIRTMFXIQRMRCLSLALRDCEDCLPAFNRVAHLCRDLSYGL

SEQ ID NO: 34635 - protein, 64 aa, Diabrotica virgifera
  misc_feature: Coding regions on vcDNA: vcDNA=SeqID_14332; Strand=-; Position=83-277
  misc_feature (4)..(10): Xaa can be any naturally occurring amino acid
  misc_feature (23)..(37): Xaa can be any naturally occurring amino acid
LLLXXXXXXXLIPFHGQITASYXXXXXXXXXXXXXXXDIFLIHRCNKCCRIHIINLHIFAQFTS

SEQ ID NO: 34636 - protein, 33 aa, Diabrotica virgifera
  misc_feature: Coding regions on vcDNA: vcDNA=SeqID_14333; Strand=+; Position=3-104
TVRNFKRIMEARVIARFGRDFTFALQMKEQKFC

SEQ ID NO: 34637 - protein, 45 aa, Diabrotica virgifera
  misc_feature: Coding regions on vcDNA: vcDNA=SeqID_14334; Strand=+; Position=1-135
  misc_feature (1)..(9): Xaa can be any naturally occurring amino acid
  misc_feature (23)..(34): Xaa can be any naturally occurring amino acid
  misc_feature (39)..(45): Xaa can be any naturally occurring amino acid
XXXXXXXXXPFFLFFLFTFYLFXXXXXXXXXXXXFESGXXXXXXX

SEQ ID NO: 34638 - protein, 105 aa, Diabrotica virgifera
  misc_feature: Coding regions on vcDNA: vcDNA=SeqID_14335; Strand=+; Position=1-315
  misc_feature (3)..(37): Xaa can be any naturally occurring amino acid
  misc_feature (40)..(87): Xaa can be any naturally occurring amino acid
  misc_feature (98)..(105): Xaa can be any naturally occurring amino acid
KEXXXXXXXXXXXXXXXXXXXXXXXXXXXXXXXXXXXDGXXXXXXXXXXXXXXXXXXXXXXXXXXXXXXXXXXXXXXXXXXXXXXXXHYLVLYSITFXXXXXXXX

SEQ ID NO: 34639 - protein, 59 aa, Diabrotica virgifera
  misc_feature: Coding regions on vcDNA: vcDNA=SeqID_14336; Strand=+; Position=1-180
  misc_feature (36)..(43): Xaa can be any naturally occurring amino acid
KILNDTLLQRSDNFITSKLKLFQRYNRLELFRRCIXXXXXXXXGTYILQRFDKFITSKI

SEQ ID NO: 34640 - protein, 23 aa, Diabrotica virgifera
  misc_feature: Coding regions on vcDNA: vcDNA=SeqID_14337; Strand=-; Position=0-68
  misc_feature (11)..(19): Xaa can be any naturally occurring amino acid
RRRERTRGLTXXXXXXXXXGLTR

SEQ ID NO: 34641 - protein, 34 aa, Diabrotica virgifera
  misc_feature: Coding regions on vcDNA: vcDNA=SeqID_14338; Strand=-; Position=2-103
CTQSKCHLDRITVCDKQAANKTLKTIFIFVRTCG

SEQ ID NO: 34642 - protein, 104 aa, Diabrotica virgifera
  misc_feature: Coding regions on vcDNA: vcDNA=SeqID_14339; Strand=+; Position=1-312
  misc_feature (4)..(47): Xaa can be any naturally occurring amino acid
  misc_feature (49)..(96): Xaa can be any naturally occurring amino acid
NLKXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXIISIFYKF

SEQ ID NO: 34643 - protein, 16 aa, Diabrotica virgifera
  misc_feature: Coding regions on vcDNA: vcDNA=SeqID_14340; Strand=-; Position=2-49
FSLTLDLIVIVFAYFF

SEQ ID NO: 34644 - protein, 60 aa, Diabrotica virgifera
  misc_feature: Coding regions on vcDNA: vcDNA=SeqID_14341; Strand=+; Position=2-184
PRVRLKLHQHFNNICTIAVALGKVGASCDCDTCSQECESIGSDYVGGICYQDDCYCAYIN

SEQ ID NO: 34645 - protein, 70 aa, Diabrotica virgifera
  misc_feature: Coding regions on vcDNA: vcDNA=SeqID_14342; Strand=-; Position=52-264
  misc_feature (15)..(50): Xaa can be any naturally occurring amino acid
PLLILSLFYFLKDFXXXXXXXXXXXXXXXXXXXXXXXXXXXXXXXXXXXXVFLLRSEKRVTYKCINKYHI

SEQ ID NO: 34646 - protein, 69 aa, Diabrotica virgifera
  misc_feature: Coding regions on vcDNA: vcDNA=SeqID_14343; Strand=+; Position=1-210
  misc_feature (9)..(24): Xaa can be any naturally occurring amino acid
ILIKLLVNXXXXXXXXXXXXXXXXDTQGRGRKSFAILVDGTLNDIVTTHVSTGTLFIGRPFCLTSRVPQ

SEQ ID NO: 34647 - protein, 49 aa, Diabrotica virgifera
  misc_feature: Coding regions on vcDNA: vcDNA=SeqID_14344; Strand=-; Position=2-148
DIYFDHLALKHRPKLIYGKKLHIRRVNIGLVFKPNSEVHPTFNDQLKGM

SEQ ID NO: 34648 - protein, 49 aa, Diabrotica virgifera
  misc_feature: Coding regions on vcDNA: vcDNA=SeqID_14345; Strand=+; Position=1-147
  misc_feature (41)..(49): Xaa can be any naturally occurring amino acid
QQAKSASTIKYPPSMLTLENFWVKLLHVLLPKLLEDVMTFXXXXXXXXX

SEQ ID NO: 34649 - protein, 19 aa, Diabrotica virgifera
  misc_feature: Coding regions on vcDNA: vcDNA=SeqID_14346; Strand=-; Position=1-57
IQPGQTLGRPIETTSIEMT

SEQ ID NO: 34650 - protein, 52 aa, Diabrotica virgifera
  misc_feature: Coding regions on vcDNA: vcDNA=SeqID_14347; Strand=+; Position=246-401
FFDPFNLIKRIIYLKDIMVHLLWRSDRFTLLIPPCWNRVDHCCSSYSNNSVR

SEQ ID NO: 34651 - protein, 48 aa, Diabrotica virgifera
  misc_feature: Coding regions on vcDNA: vcDNA=SeqID_14348; Strand=+; Position=3-149
  misc_feature (22)..(29): Xaa can be any naturally occurring amino acid
NSNKTFPIPKCLANQKHLSPHXXXXXXXXNSHSLKNIPTQTYDFPEIM

SEQ ID NO: 34652 - protein, 59 aa, Diabrotica virgifera
  misc_feature: Coding regions on vcDNA: vcDNA=SeqID_14349; Strand=-; Position=124-303
NYIVAKVAVAYAKAEAYTNLWDQLNTREGKTKIYKMPNREQRKQKILIRLDVSEMKIKY

SEQ ID NO: 34653 - protein, 66 aa, Diabrotica virgifera
  misc_feature: Coding regions on vcDNA: vcDNA=SeqID_14350; Strand=+; Position=67-264
  misc_feature: Homolog annotation: Hit_ID=AAR19394.1; Match level="QueryCoverage =87%, HitCoverage=28%, E-value=3e-11, Identity=50%"; Hit description =modified lacZ' [Cloning vector pTA6]
KLLNGKNPGFTKLNPLEKNPPFPNWLKTKKARTNPPSKNLPTPNGKWNPPCTGPLTPAGLVVTPNF

SEQ ID NO: 34654 - protein, 65 aa, Diabrotica virgifera
  misc_feature: Coding regions on vcDNA: vcDNA=SeqID_14351; Strand=+; Position=216-410
  misc_feature (1)..(7): Xaa can be any naturally occurring amino acid
  misc_feature (11)..(32): Xaa can be any naturally occurring amino acid
  misc_feature (34)..(48): Xaa can be any naturally occurring amino acid
  misc_feature (55)..(65): Xaa can be any naturally occurring amino acid
XXXXXXXFFMXXXXXXXXXXXXXXXXXXXXXXQXXXXXXXXXXXXXXXRGLHYFXXXXXXXXXXX

SEQ ID NO: 34655 - protein, 31 aa, Diabrotica virgifera
  misc_feature: Coding regions on vcDNA: vcDNA=SeqID_14352; Strand=+; Position=2-94
LFRHLIEISIIHLSTKFHGIIRLSHSCDQSF

SEQ ID NO: 34656 - protein, 53 aa, Diabrotica virgifera
  misc_feature: Coding regions on vcDNA: vcDNA=SeqID_14353; Strand=+; Position=37-198
  misc_feature (8)..(15): Xaa can be any naturally occurring amino acid
QQLLVQTXXXXXXXXVPVYKYMEDVRLFNPKEVDLQNHWFNKVSLVLYPLHTV

SEQ ID NO: 34657 - protein, 93 aa, Diabrotica virgifera
  misc_feature: Coding regions on vcDNA: vcDNA=SeqID_14354; Strand=+; Position=58-339
  misc_feature: Homolog annotation: Hit_ID=XP_315329.1; Match level="QueryCoverage =82%, HitCoverage=74%, E-value=3e-35, Identity=93%"; Hit description =ENSANGP00000021121 [Anopheles gambiae]
  misc_feature: Pfam annotation: Pfam_ID=LSM; Match level="Score=74.9, E-value=2.2e -19, Copies=1"; Pfam description=LSM domain
  misc_feature (9)..(15): Xaa can be any naturally occurring amino acid
KLKFLSNCXXXXXXXNRKEALSTFIQQIHGRPVVVKLNSGVDYRGVLACLDGYMNIALEQTEEYVNGQLKNKFGDAFIRGNNVLYISTQKRRY

SEQ ID NO: 34658 - protein, 79 aa, Diabrotica virgifera
  misc_feature: Coding regions on vcDNA: vcDNA=SeqID_14355; Strand=+; Position=7-243
  misc_feature: Homolog annotation: Hit_ID=CAA75108.1; Match level="QueryCoverage =86%, HitCoverage=43%, E-value=5e-12, Identity=50%"; Hit description =beta-galactosidase [Phagemid cloning vector pTZ19U]
MQLHTSSKLSPNFISLAFFLKLLDWKNPGFTQLNPLATNPPFPNWVITKKAPTVPPSQNFPTLNGKWNPPFTGALTPAV

SEQ ID NO: 34659 - protein, 73 aa, Diabrotica virgifera
  misc_feature: Coding regions on vcDNA: vcDNA=SeqID_14356; Strand=-; Position=10-231
  misc_feature (9)..(26): Xaa can be any naturally occurring amino acid
  misc_feature (44)..(58): Xaa can be any naturally occurring amino acid
  misc_feature (62)..(71): Xaa can be any naturally occurring amino acid
GHPYKYLIXXXXXXXXXXXXXXXXXXLFLTNLDICKNESPLMSXXXXXXXXXXXXXXXVSCXXXXXXXXXXPN

SEQ ID NO: 34660 - protein, 90 aa, Diabrotica virgifera
  misc_feature: Coding regions on vcDNA: vcDNA=SeqID_14357; Strand=-; Position=0-269
  misc_feature (1)..(64): Xaa can be any naturally occurring amino acid
  misc_feature (66)..(89): Xaa can be any naturally occurring amino acid
XXXXXXXXXXXXXXXXXXXXXXXXXXXXXXXXXXXXXXXXXXXXXXXXXXXXXXXXXXXXXXXXKXXXXXXXXXXXXXXXXXXXXXXXXV

SEQ ID NO: 34661 - protein, 74 aa, Diabrotica virgifera
  misc_feature: Coding regions on vcDNA: vcDNA=SeqID_14358; Strand=-; Position=1-222
CFLALAWPLIILPVSFKRQSLYAPAYWCTWFFSSCSPVVVVLYLLLSGHPPPVFLACLSFVVPRSLCLPLFQFY

SEQ ID NO: 34662 - protein, 144 aa, Diabrotica virgifera
  misc_feature: Coding regions on vcDNA: vcDNA=SeqID_14359; Strand=-; Position=0-431
  misc_feature (1)..(13): Xaa can be any naturally occurring amino acid
  misc_feature (17)..(143): Xaa can be any naturally occurring amino acid
XXXXXXXXXXXXXYHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 34663 - protein, 44 aa, Diabrotica virgifera
  misc_feature: Coding regions on vcDNA: vcDNA=SeqID_14360; Strand=+; Position=310-441
MEVCVNVLKHEQPEKLHIQLTHYKQKWNWDCGVSCVLMVLSKKK

SEQ ID NO: 34664 - protein, 49 aa, Diabrotica virgifera
  misc_feature: Coding regions on vcDNA: vcDNA=SeqID_14361; Strand=-; Position=2-151
LLILLISIIYMFSLQSTANKVKIAVMVANLREETVLQEEEVTIKIARGL

SEQ ID NO: 34665 - protein, 134 aa, Diabrotica virgifera
  misc_feature: Coding regions on vcDNA: vcDNA=SeqID_14362; Strand=+; Position=2-403
KQKEKISQVKQAKQRTLQSREIKRKIKASIIKVPDNINDDFLDKTVENLVITQTSDNIDESKHKKRKLGPESLEGFTVLGAENVANKVKVKRVLPSWLSNPTVISVNLQDLQTKFSDQKHLDKGIRKLPKANNI

SEQ ID NO: 34666 - protein, 50 aa, Diabrotica virgifera
  misc_feature: Coding regions on vcDNA: vcDNA=SeqID_14363; Strand=-; Position=1-150
  misc_feature (12)..(18): Xaa can be any naturally occurring amino acid
  misc_feature (21)..(32): Xaa can be any naturally occurring amino acid
IPPVVRPIYCVXXXXXXXSCXXXXXXXXXXXXEVDNFIYWNYSFLKRFKN

SEQ ID NO: 34667 - protein, 91 aa, Diabrotica virgifera
  misc_feature: Coding regions on vcDNA: vcDNA=SeqID_14364; Strand=+; Position=3-278
ISPRVRERINPYLLMHTISNCLKNVIQIQITGRRYQQSLTISLLPINPDVHLAATSDISFLGIWTLRHTIITCRPHYTLCMTNVTRPVPAL

SEQ ID NO: 34668 - protein, 172 aa, Diabrotica virgifera
  misc_feature: Coding regions on vcDNA: vcDNA=SeqID_14365; Strand=+; Position=2-520
  misc_feature (2)..(8): Xaa can be any naturally occurring amino acid
LXXXXXXXGYKDDQTPVDQSTKTKQTKPKQNNSQDNLLTKDKRTVSHAVQGAKKTDAVTKPEEPKPLFPANDPFNFKKNAEEAQKAFKEKGLGGWIATVQKNVQETLNALIKGGEGKKLVEAIIEWVKNLIKTVQEKGLPAVTKQVEAKLKEILARAIVENNKWPMKALTQK

SEQ ID NO: 34669 - protein, 60 aa, Diabrotica virgifera
  misc_feature: Coding regions on vcDNA: vcDNA=SeqID_14366; Strand=-; Position=0-179
  misc_feature (4)..(27): Xaa can be any naturally occurring amino acid
  misc_feature (29)..(57): Xaa can be any naturally occurring amino acid
FITXXXXXXXXXXXXXXXXXXXXXXXXSXXXXXXXXXXXXXXXXXXXXXXXXXXXXXIPA

SEQ ID NO: 34670 - protein, 53 aa, Diabrotica virgifera
  misc_feature: Coding regions on vcDNA: vcDNA=SeqID_14367; Strand=-; Position=1-159
  misc_feature (4)..(53): Xaa can be any naturally occurring amino acid
KKLXXXXXXXXXXXXXXXXXXXXXXXXXXXXXXXXXXXXXXXXXXXXXXXXXX

SEQ ID NO: 34671 - protein, 57 aa, Diabrotica virgifera; identical to SEQ ID NO: 32497
  misc_feature: Coding regions on vcDNA: vcDNA=SeqID_14368; Strand=-; Position=159-332
  misc_feature (1)..(12): Xaa can be any naturally occurring amino acid
  misc_feature (14)..(38): Xaa can be any naturally occurring amino acid

SEQ ID NO: 34672 - protein, 119 aa, Diabrotica virgifera
  misc_feature: Coding regions on vcDNA: vcDNA=SeqID_14369; Strand=-; Position=538-897
  misc_feature (1)..(16): Xaa can be any naturally occurring amino acid
  misc_feature (19)..(89): Xaa can be any naturally occurring amino acid
XXXXXXXXXXXXXXXXDEXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 34673 - protein, 308 aa, Diabrotica virgifera
  misc_feature: Coding regions on vcDNA: vcDNA=SeqID_14370; Strand=+; Position=2-929
  misc_feature: Homolog annotation: Hit_ID=XP_393981.1; Match level="QueryCoverage =99%, HitCoverage=8%, E-value=1e-101, Identity=59%"; Hit description =similar to ENSANGP00000007163 [Apis mellifera]
  misc_feature: Gene Ontology Annotation: Molecular function=molecular_function unknown; Cellular component=PCAF complex; Biological process=signal transduction
  misc_feature (215)..(215): Xaa can be any naturally occurring amino acid
  misc_feature (286)..(286): Xaa can be any naturally occurring amino acid
YVEKRFQDDNELNAQFLELVNYVYTDKQLKATELTSKLEPAFLAGLRCTQPHIRAKFFKVFDEAMPRRLHDRLLYIICSQNWDAIGPHYWIKQCIELLLVTAAPGDGIRMSHESSILPAITSVIPEKQKREEFSRHQLQNPDFYTSEIKEEVLDVDLSNIDSNPLVEEKPVIREETIKMLKKDYESTEIARNITTDRFLLATSQLCHMDTSLAEXVWLSLFPKLWAILEPEQRTTLEKDIIPFITSGTHIIQKDCHPSAINTFVEALYRCTNHIQMAPFLMTYLGXSHNLWHRMALGLEQMAYEDVCA

SEQ ID NO: 34674 - protein, 62 aa, Diabrotica virgifera
  misc_feature: Coding regions on vcDNA: vcDNA=SeqID_14371; Strand=-; Position=1-186
  misc_feature (3)..(58): Xaa can be any naturally occurring amino acid
ITXXXXXXXXXXXXXXXXXXXXXXXXXXXXXXXXXXXXXXXXXXXXXXXXXXXXXXXXTFHS

SEQ ID NO: 34675 - protein, 231 aa, Diabrotica virgifera
  misc_feature: Coding regions on vcDNA: vcDNA=SeqID_14372; Strand=+; Position=5-700
  misc_feature (230)..(230): Xaa can be any naturally occurring amino acid
SLMLEQIAEFLRSQTKCLTNNGNVVEKSLKNLKPDLDFIMTPLRKSTTTPIRPVKSKSCTKVPVLPDKKFNLLRTSSQETENSQNTSSSNEYFKLPPILVPIINKMEEKSSDQGKPGSLTSVGPNIDSSVSSVASSSEVDAAETTCSCISKESDSDNESECDVDIMAEELMKKIPRDDSLVKSTDVEECRIKNCGSADTSSVLSGVTTLSNISNPSNSSGENLSKTFTRXY

SEQ ID NO: 34676 - protein, 113 aa, Diabrotica virgifera
  misc_feature: Coding regions on vcDNA: vcDNA=SeqID_14373; Strand=+; Position=47-388
  misc_feature: Homolog annotation: Hit_ID=BAD18973.2; Match level="QueryCoverage =97%, HitCoverage=48%, E-value=3e-27, Identity=58%"; Hit description =60S ribosomal protein L13 [Antheraea yamamai]
  misc_feature: Pfam annotation: Pfam_ID=Ribosomal_L13e; Match level="Score=-53.2, E -value=5.7e-06, Copies=1"; Pfam description=Ribosomal protein L13e
  misc_feature (17)..(24): Xaa can be any naturally occurring amino acid
NKSVESIQLNAQRLKEXXXXXXXXPIHEKKKIRAGEATEEERRIASQLQGEVLPIKQSSLRTKARVPTEEEKKFEAYVTLRKARADARLVGIRAKRIKDAAENPEDVTKAAAV

SEQ ID NO: 34677 - protein, 34 aa, Diabrotica virgifera
  misc_feature: Coding regions on vcDNA: vcDNA=SeqID_14374; Strand=+; Position=1-102
  misc_feature (15)..(21): Xaa can be any naturally occurring amino acid
PLGITRGIFFGRVSXXXXXXXDPPWVGLKVYNLG

SEQ ID NO: 34678 - protein, 201 aa, Diabrotica virgifera
  misc_feature: Coding regions on vcDNA: vcDNA=SeqID_14375; Strand=+; Position=255-860
  misc_feature: Homolog annotation: Hit_ID=XP_309545.1; Match level="QueryCoverage =65%, HitCoverage=91%, E-value=5e-25, Identity=44%"; Hit description =ENSANGP00000012573 [Anopheles gambiae]
MAQFNRWSVLKLFEVILVLACLVFKRVTDDEASRVFLYLQKISREWSLLNNITWSRVGAAVADVTYGGYLIITGALFLGHIVEELPTTRRITEYILLGIGTILFVVMGSLSFAALDSVPPSLVDNAAIVGTLSLVVAGLFLLDMGGPKKRPPRSQQPKQKKVIETERYKDAAKTDQKESTKPEEIQFKKIEKGVKTEKDKK

SEQ ID NO: 34679 - protein, 309 aa, Diabrotica virgifera
  misc_feature: Coding regions on vcDNA: vcDNA=SeqID_14376; Strand=+; Position=1-928
  misc_feature: Homolog annotation: Hit_ID=XP_311856.1; Match level="QueryCoverage =100%, HitCoverage=18%, E-value=1e-164, Identity=90%"; Hit description=ENSANGP00000018215 [Anopheles gambiae]
  misc_feature: Gene Ontology Annotation: Molecular function=structural molecule activity; Cellular component=clathrin coat; Biological process =intracellular protein transport
  misc_feature: Pfam annotation: Pfam_ID=Clathrin; Match level="Score=287.1, E-value =3e-83, Copies=2"; Pfam description=Region in Clathrin and VPS
  misc_feature (250)..(250): Xaa can be any naturally occurring amino acid
  misc_feature (278)..(278): Xaa can be any naturally occurring amino acid
QMCGMHIVVHADELQDLINYYQDRGYFEELIGLLEAALGLERAHMGMFTELAILYSKYKPAKMREHLELFWSRVNIPKVLRAAEQAHLWAELVFLYDKYEEYDNAVLAMMAHPTEAWREGHFKDIITKVANIELYYRAIQFYLDYKPLLLNDLLLVLAPRMDHTRAVSFFTKTGHLQLVKSYLRSVQNLNNKAINEALNSLLIEEEDFQGLRTSIDAFDNFDNIGLAQKLEKHELTEFRRIAAYLYKGNXRWKQSVELCKKDRLFRDAMEYTSESRNXEIAERVLAWVLDRKAYDCFSACLYPCYDLLR

SEQ ID NO: 34680 - protein, 136 aa, Diabrotica virgifera
  misc_feature: Coding regions on vcDNA: vcDNA=SeqID_14377; Strand=+; Position=1-408
  misc_feature (2)..(54): Xaa can be any naturally occurring amino acid
  misc_feature (78)..(85): Xaa can be any naturally occurring amino acid
  misc_feature (87)..(93): Xaa can be any naturally occurring amino acid
  misc_feature (96)..(102): Xaa can be any naturally occurring amino acid
TXXXXXXXXXXXXXXXXXXXXXXXXXXXXXXXXXXXXXXXXXXXXXXXXXXXXXLGDKGKFFWEIQNPKKRLGPPVGXXXXXXXXDXXXXXXXFVXXXXXXXGYLGSFIPRGGEVTHLVASSYFLFSLLLSLIHHF

SEQ ID NO: 34681 - protein, 266 aa, Diabrotica virgifera
  misc_feature: Coding regions on vcDNA: vcDNA=SeqID_14378; Strand=+; Position=35-830
  misc_feature: Homolog annotation: Hit_ID=XP_315097.1; Match level="QueryCoverage =91%, HitCoverage=60%, E-value=4e-57, Identity=46%"; Hit description =ENSANGP00000011417 [Anopheles gambiae]
  misc_feature: Gene Ontology Annotation: Molecular function=transcriptional activator activity; Cellular component=nucleus; Biological process =regulation of transcription
  misc_feature: Pfam annotation: Pfam_ID=GST_N; Match level="Score=16.1, E-value =0.0031, Copies=1"; Pfam description=Glutathione S-transferase, N -terminal
  misc_feature (235)..(235): Xaa can be any naturally occurring amino acid
MLNFTNKIVTRTLLFSYRPNLVKNGFKNFTTSTSRNIKRGTFRLGLTGITVGALVGTGYSIHYMNKPRAHILNEEITIAQVKEMPSMKPTRFVKNVGDMGLELTLYQYQTCPFCCKVRAFLDYYGISYNLIEVDPVLRQAIKWSPYRKVPILVVKTDDGYQPLIDSTMIVSALASYLFEDNKKDLPEIVKCFPNVSYVDDDGLKKNEIMNRYFIMLNNRKDLQAIEQKSSEERKXWRKWADSVLVHTLSPNVYRTSEEALQSFHWF

SEQ ID NO: 34682 - protein, 248 aa, Diabrotica virgifera
  misc_feature: Coding regions on vcDNA: vcDNA=SeqID_14379; Strand=-; Position=1-744
  misc_feature (21)..(47): Xaa can be any naturally occurring amino acid
  misc_feature (60)..(85): Xaa can be any naturally occurring amino acid
  misc_feature (90)..(184): Xaa can be any naturally occurring amino acid
  misc_feature (190)..(210): Xaa can be any naturally occurring amino acid
  misc_feature (212)..(224): Xaa can be any naturally occurring amino acid
  misc_feature (229)..(243): Xaa can be any naturally occurring amino acid
ALKKKIVDKMKIRPGVFSIQXXXXXXXXXXXXXXXXXXXXXXXXXXXSGGGRVFIFNSKXXXXXXXXXXXXXXXXXXXXXXXXXXKFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIPSHXXXXXXXXXXXXXXXXXXXXXIXXXXXXXXXXXXXDPQGXXXXXXXXXXXXXXXNTNYL

SEQ ID NO: 34683 - protein, 69 aa, Diabrotica virgifera
  misc_feature: Coding regions on vcDNA: vcDNA=SeqID_14380; Strand=+; Position=132-338
  misc_feature (31)..(69): Xaa can be any naturally occurring amino acid
TLIQHRGRNLYYRFELSNKITLLSLRKFILXXXXXXXXXXXXXXXXXXXXXXXXXXXXXXXXXXXXXXX

SEQ ID NO: 34684 - protein, 71 aa, Diabrotica virgifera
  misc_feature: Coding regions on vcDNA: vcDNA=SeqID_14381; Strand=-; Position=0-212
KKRKKKPHPGCPPAGFNLENQGKIFKRWEPALIKLSLLPPNYKPLIPPWGVAIFYYGLEFSNKNYAVIPKG

SEQ ID NO: 34685 - protein, 60 aa, Diabrotica virgifera
  misc_feature: Coding regions on vcDNA: vcDNA=SeqID_14382; Strand=-; Position=2-181
  misc_feature (43)..(50): Xaa can be any naturally occurring amino acid
ARPKLPRPFKIIMGPGGPLYLFQKSHVFKNQGKKMWRISFIKXXXXXXXXNFYILILSPL

SEQ ID NO: 34686 - protein, 175 aa, Diabrotica virgifera
  misc_feature: Coding regions on vcDNA: vcDNA=SeqID_14383; Strand=+; Position=1-529
  misc_feature (48)..(48): Xaa can be any naturally occurring amino acid
FHARRPETAETKDPLTEGTTATPKRRESRDKTTETRRGGRAQRTRAMXQDRQKPRQRRQATQNRQTKGTRGPPKQKRGDYTRQKQRGAKGSDKRERPREKREQRNATKKNTKRTARAHRDKETAWITFYLIVVSSSRLALYQFEGGCPRLHATENLLSVRFPGWKMPLRQFFLLL

SEQ ID NO: 34687 - protein, 241 aa, Diabrotica virgifera
  misc_feature: Coding regions on vcDNA: vcDNA=SeqID_14384; Strand=+; Position=89-812
  misc_feature: Homolog annotation: Hit_ID=XP_393697.1; Match level="QueryCoverage =95%, HitCoverage=86%, E-value=1e-94, Identity=60%"; Hit description =similar to ENSANGP00000010429 [Apis mellifera]
  misc_feature: Gene Ontology Annotation: Cellular component=nuclear lamina; Biological process=torso signaling pathway
  misc_feature (184)..(184): Xaa can be any naturally occurring amino acid
MASFWAVFVFGVAFTLTEHCHGAQYFGKLIGKLSELHHGVSGEVYAVDARTLYIKDFTYDGQGPAAYFYASVHKAADKHGFRLRDETGSGEVIRRYRKEGITLTLPEGKTIHSIKIFYLWCEEFDVNFGDVKVPRGFDYPRPQKIESLKGVHAISSDNIVIVDAQTLLIPNLSYDGEAPDAKFXVGRGSKPTPQGIRVPDENGKEVPLRRYDRKTVVLTLPGDLTVFDIGHFGIWCEMFTV

SEQ ID NO: 34688 - protein, 123 aa, Diabrotica virgifera
  misc_feature: Coding regions on vcDNA: vcDNA=SeqID_14385; Strand=-; Position=551-922
  misc_feature (25)..(25): Xaa can be any naturally occurring amino acid
  misc_feature (43)..(51): Xaa can be any naturally occurring amino acid
  misc_feature (72)..(78): Xaa can be any naturally occurring amino acid
LRSYLTLLPLLLKVPRNGILIAELXRPTVCILCLCFVFVKFIXXXXXXXXXLLHLHTKLVFKCFKMCCMLWXXXXXXXVLNIVIQIRVSKRFKQIILQHDSHSLSSFLISSTIFEKTHHCFVM

SEQ ID NO: 34689 - protein, 85 aa, Diabrotica virgifera
  misc_feature: Coding regions on vcDNA: vcDNA=SeqID_14386; Strand=-; Position=162-419
HAIRALVALPIVRAICYHRLVVEMGRWDLVIFCGLRPQIENDYCNVPLLEPQGLACVVIGMSDFRLGICTYPSLRTMGPIPVEAC

SEQ ID NO: 34690 - protein, 42 aa, Diabrotica virgifera
  misc_feature: Coding regions on vcDNA: vcDNA=SeqID_14387; Strand=+; Position=1-126
  misc_feature (1)..(10): Xaa can be any naturally occurring amino acid
  misc_feature (18)..(26): Xaa can be any naturally occurring amino acid
  misc_feature (28)..(41): Xaa can be any naturally occurring amino acid
XXXXXXXXXXESYFYVNXXXXXXXXXDXXXXXXXXXXXXXXP

SEQ ID NO: 34691 - protein, 86 aa, Diabrotica virgifera
  misc_feature: Coding regions on vcDNA: vcDNA=SeqID_14388; Strand=+; Position=56-316
KAIVDVATLWMYIKLHILIRAFIINFDLNFIVKYSIFYSRIWGQYLICFNKMFIADTCIYSLHIFIPSYCYNPLFSHQNIFEKPVS

SEQ ID NO: 34692 - protein, 61 aa, Diabrotica virgifera
  misc_feature: Coding regions on vcDNA: vcDNA=SeqID_14389; Strand=+; Position=153-335
MKFIIITLLLVLVFSSCNGLNGTIPTILRGAWFSWELGRNTLTELDATSMTDRGTCIDVKN

SEQ ID NO: 34693 - protein, 77 aa, Diabrotica virgifera
  misc_feature: Coding regions on vcDNA: vcDNA=SeqID_14390; Strand=-; Position=0-230
  misc_feature (11)..(23): Xaa can be any naturally occurring amino acid
  misc_feature (25)..(70): Xaa can be any naturally occurring amino acid
KKISPFISLKXXXXXXXXXXXXXFXXXXXXXXXXXXXXXXXXXXXXXXXXXXXXXXXXXXXXXXXXXXXXFYKGSSR

SEQ ID NO: 34694 - protein, 43 aa, Diabrotica virgifera
  misc_feature: Coding regions on vcDNA: vcDNA=SeqID_14391; Strand=-; Position=53-184
PPFFDEEYFEISTADNNKNKRLFPFMYDLPLTSYKRDDYPWCN

SEQ ID NO: 34695 - protein, 134 aa, Diabrotica virgifera
  misc_feature: Coding regions on vcDNA: vcDNA=SeqID_14392; Strand=+; Position=4-408
  misc_feature (2)..(14): Xaa can be any naturally occurring amino acid
  misc_feature (21)..(33): Xaa can be any naturally occurring amino acid
  misc_feature (53)..(64): Xaa can be any naturally occurring amino acid
  misc_feature (66)..(79): Xaa can be any naturally occurring amino acid
  misc_feature (93)..(104): Xaa can be any naturally occurring amino acid
  misc_feature (125)..(131): Xaa can be any naturally occurring amino acid
QXXXXXXXXXXXXXATSMLDXXXXXXXXXXXXXCSTFTILHDLSLNRCEPGWXXXXXXXXXXXXKXXXXXXXXXXXXXXFPYELGLIKIKLPXXXXXXXXXXXXDTGAAALKRIQLLPSAGIGTXXXXXXXGPQ

SEQ ID NO: 34696 - protein, 282 aa, Diabrotica virgifera
  misc_feature: Coding regions on vcDNA: vcDNA=SeqID_14393; Strand=+; Position=3-851
  misc_feature: Homolog annotation: Hit_ID=XP_318380.1; Match level="QueryCoverage =97%, HitCoverage=53%, E-value=2e-82, Identity=54%"; Hit description =ENSANGP00000015883 [Anopheles gambiae]
  misc_feature: Gene Ontology Annotation: Molecular function=oligosaccharyl transferase activity; Cellular component=membrane; Biological process=protein modification
  misc_feature: Pfam annotation: Pfam_ID=Alg6_Alg8; Match level="Score=152.8, E-value= 7.6e-43, Copies=1"; Pfam description=ALG6, ALG8 glycosyltransferase family
  misc_feature (183)..(189): Xaa can be any naturally occurring amino acid
FLTSCLKLLLIPAYRSTDFEVHRNWLSITHSLPVKKWYFEDTSQWTLDYPPLFAWFEYILSFPAYLFDSKMLNVNHLNYSSEKAVLFQRLSVIITDLVYSLGVYMCCCSVKKSWGKEVVLPILLITNCGLLMVDHIHFQYNGIMYGILLISIAYMIQEKYLQSAFWFTILLNMKHIYIYLAPXXXXXXXRHYCLKGPLVIRNIFSRKNLKNVGMLGCTVLGIFVVTFLPFYDQIPQVLSRLFPFKRGLCHAYWAPNLWALYNTVDKVGFVLASKLHKNLGQE

SEQ ID NO: 34697 - protein, 169 aa, Diabrotica virgifera
  misc_feature: Coding regions on vcDNA: vcDNA=SeqID_14394; Strand=+; Position=41-550
  misc_feature (2)..(115): Xaa can be any naturally occurring amino acid
  misc_feature (128)..(134): Xaa can be any naturally occurring amino acid
  misc_feature (144)..(152): Xaa can be any naturally occurring amino acid
  misc_feature (154)..(161): Xaa can be any naturally occurring amino acid
TXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNQILFRFHLQIXXXXXXXPILKYAYSFXXXXXXXXXPXXXXXXXXYIISISHG

SEQ ID NO: 34698 - protein, 21 aa, Diabrotica virgifera
  misc_feature: Coding regions on vcDNA: vcDNA=SeqID_14395; Strand=+; Position=1-63
  misc_feature (4)..(11): Xaa can be any naturally occurring amino acid
HFFXXXXXXXXVYTLLLRFFS

SEQ ID NO: 34699 - protein, 221 aa, Diabrotica virgifera
  misc_feature: Coding regions on vcDNA: vcDNA=SeqID_14396; Strand=+; Position=1-663
  misc_feature (1)..(16): Xaa can be any naturally occurring amino acid
  misc_feature (18)..(37): Xaa can be any naturally occurring amino acid
  misc_feature (42)..(125): Xaa can be any naturally occurring amino acid
  misc_feature (131)..(161): Xaa can be any naturally occurring amino acid
  misc_feature (164)..(206): Xaa can be any naturally occurring amino acid
  misc_feature (211)..(221): Xaa can be any naturally occurring amino acid
XXXXXXXXXXXXXXXXKXXXXXXXXXXXXXXXXXXXXAMLFXXXXXXXXXXXXXXXXXXXXXXXXXXXXXXXXXXXXXXXXXXXXXXXXXXXXXXXXXXXXXXXXXXXXXXXXXXXXXXXXXXXXNYLHLXXXXXXXXXXXXXXXXXXXXXXXXXXXXXXXLLXXXXXXXXXXXXXXXXXXXXXXXXXXXXXXXXXXXXXXXXXXXWKNKXXXXXXXXXXX

SEQ ID NO: 34700 - protein, 285 aa, Diabrotica virgifera
  misc_feature: Coding regions on vcDNA: vcDNA=SeqID_14397; Strand=+; Position=34-888
  misc_feature: Homolog annotation: Hit_ID=XP_311550.1; Match level="QueryCoverage =100%, HitCoverage=68%, E-value=1e-60, Identity=39%"; Hit description= ENSANGP00000024645 [Anopheles gambiae]
  misc_feature: Gene Ontology Annotation: Molecular function=monooxygenase activity; Cellular component=mitochondrion; Biological process=xenobiotic metabolism
  misc_feature: Pfam annotation: Pfam_ID=FMO-like; Match level="Score=-242.3, E-value= 4.5e-11, Copies=1"; Pfam description=Flavin-binding monooxygenase-like
  misc_feature (131)..(137): Xaa can be any naturally occurring amino acid
  misc_feature (270)..(270): Xaa can be any naturally occurring amino acid
  misc_feature (275)..(275): Xaa can be any naturally occurring amino acid
MKIAIIGGGAAGLAALKHSLDEHYECELFEQTGLIGGTWNYNEKIGIDENGLPIHSSMYDGLRTNLPKELMQLEDFPFSKPDYSYLSQPQVLQYIKDYASHFNLLSHVQLFKHVIKVTPLERGKWSVEIKXXXXXXXETKTFDAIFVCIGNYSTPFIPKFPGTENFQGTIIHSHDYRKPDRYKNRKVLIVGKGPSGIDIARIISKVSDNVTICHRSPPNTALQIPEGIKKQFPIQEFRQHSILFSDGSEQNIDDVILCTGYLHNYPFLSXECEIXVENKWVKYLY

SEQ ID NO: 34701 - protein, 102 aa, Diabrotica virgifera
  misc_feature: Coding regions on vcDNA: vcDNA=SeqID_14398; Strand=-; Position=255-563
  misc_feature (12)..(24): Xaa can be any naturally occurring amino acid
LLFSSSELIEMXXXXXXXXXXXXXVIQGIVKTITPLVSADLTICKCLLGPSLPVLNSQTPVEFFILVALLFVFYISIDNYTLHMSSSHLYNQFSLSIEIEWF

SEQ ID NO: 34702 - protein, 77 aa, Diabrotica virgifera
  misc_feature: Coding regions on vcDNA: vcDNA=SeqID_14399; Strand=+; Position=462-695
  misc_feature (7)..(13): Xaa can be any naturally occurring amino acid
  misc_feature (27)..(45): Xaa can be any naturally occurring amino acid
  misc_feature (62)..(69): Xaa can be any naturally occurring amino acid
GEENFNXXXXXXXNRILKNHPTFKYMXXXXXXXXXXXXXXXXXXXQNRMSIYFLHFLLKNDXXXXXXXXVNKLNNIT

SEQ ID NO: 34703 - protein, 76 aa, Diabrotica virgifera
  misc_feature: Coding regions on vcDNA: vcDNA=SeqID_14400; Strand=-; Position=2-229
REYLSERSDDTIFFIWISAVSLLRIVKLLQLSSSSVPIFTLNVIIDFRYNVLERDAANQSMRSCRQEARKVGSDAW

SEQ ID NO: 34704 - protein, 63 aa, Diabrotica virgifera
  misc_feature: Coding regions on vcDNA: vcDNA=SeqID_14401; Strand=-; Position=205-396
  misc_feature (37)..(44): Xaa can be any naturally occurring amino acid
SIEINFLSQPQPFLIFMLKKYHCIPIIILIIHNLLLXXXXXXXXKYQYLTTTKSSFPTSLLHY

SEQ ID NO: 34705 - protein, 125 aa, Diabrotica virgifera
  misc_feature: Coding regions on vcDNA: vcDNA=SeqID_14402; Strand=+; Position=583-958
  misc_feature: Homolog annotation: Hit_ID=AAF87760.1; Match level="QueryCoverage =99%, HitCoverage=33%, E-value=3e-51, Identity=75%"; Hit description =cytochrome oxidase subunit I [Diabrotica virgifera zeae]
  misc_feature: Pfam annotation: Pfam_ID=COX1; Match level="Score=-277.7, E-value =0.081, Copies=1"; Pfam description=Cytochrome C and Quinol oxidase polype
  misc_feature (67)..(67): Xaa can be any naturally occurring amino acid
  misc_feature (102)..(102): Xaa can be any naturally occurring amino acid
  misc_feature (119)..(119): Xaa can be any naturally occurring amino acid
PLPVLAGAITILLTDRNLNTSFFDPAGGGDPILHPEGFGLISHIVRFGTLGIIYAIIAIGLLGFIVXAHHIFTVGMDVDTRAYFTSATIIIAGPTGIKVFRXLATYHGTTITYKPVTLXALGFIF

SEQ ID NO: 34706 - protein, 55 aa, Diabrotica virgifera
  misc_feature: Coding regions on vcDNA: vcDNA=SeqID_14403; Strand=+; Position=43-210
LKVSAISLRHIPSMLIKPKPILWLPRITVMYESITLSAYTSLNQIRSTSQESLCL

SEQ ID NO: 34707 - protein, 75 aa, Diabrotica virgifera
  misc_feature: Coding regions on vcDNA: vcDNA=SeqID_14404; Strand=-; Position=1-225
  misc_feature (1)..(15): Xaa can be any naturally occurring amino acid
  misc_feature (17)..(52): Xaa can be any naturally occurring amino acid
  misc_feature (54)..(74): Xaa can be any naturally occurring amino acid
XXXXXXXXXXXXXXXQXXXXXXXXXXXXXXXXXXXXXXXXXXXXXXXXXXXXLXXXXXXXXXXXXXXXXXXXXXV

SEQ ID NO: 34708 - protein, 304 aa, Diabrotica virgifera
  misc_feature: Coding regions on vcDNA: vcDNA=SeqID_14405; Strand=+; Position=3-914
  misc_feature: Homolog annotation: Hit_ID=AAF87759.1; Match level="QueryCoverage =100%, HitCoverage=69%, E-value=1e-113, Identity=71%"; Hit description=cytochrome oxidase subunit I [Diabrotica virgifera virgifera]
  misc_feature: Pfam annotation: Pfam_ID=COX1; Match level="Score=104.7, E-value=2.3e- 28, Copies=1"; Pfam description=Cytochrome C and Quinol oxidase polyp
  misc_feature (17)..(25): Xaa can be any naturally occurring amino acid
  misc_feature (52)..(52): Xaa can be any naturally occurring amino acid
  misc_feature (97)..(105): Xaa can be any naturally occurring amino acid
  misc_feature (109)..(115): Xaa can be any naturally occurring amino acid
  misc_feature (126)..(133): Xaa can be any naturally occurring amino acid
  misc_feature (154)..(154): Xaa can be any naturally occurring amino acid
  misc_feature (189)..(189): Xaa can be any naturally occurring amino acid
  misc_feature (206)..(206): Xaa can be any naturally occurring amino acid
  misc_feature (209)..(215): Xaa can be any naturally occurring amino acid
  misc_feature (242)..(248): Xaa can be any naturally occurring amino acid
  misc_feature (262)..(262): Xaa can be any naturally occurring amino acid
  misc_feature (270)..(285): Xaa can be any naturally occurring amino acid
NIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXGVNLTFFPSHFLGLIGIPR

SEQ ID NO: 34709 - protein, 40 aa, Diabrotica virgifera
  misc_feature: Coding regions on vcDNA: vcDNA=SeqID_14406; Strand=-; Position=2-121
LSIFSTWFPSSLLSYGDLDKEEGNQVQKANILLLRHLANL

SEQ ID NO: 34710 - protein, 75 aa, Diabrotica virgifera
  misc_feature: Coding regions on vcDNA: vcDNA=SeqID_14407; Strand=-; Position=219-446
  misc_feature (34)..(45): Xaa can be any naturally occurring amino acid
GHILEQEGIPLPTFHFNTKSYIHINFSILSLTMXXXXXXXXXXXXYTVSRTDYIDYSTAWKSVISNNISIHHHYL

SEQ ID NO: 34711 - protein, 55 aa, Diabrotica virgifera
  misc_feature: Coding regions on vcDNA: vcDNA=SeqID_14408; Strand=+; Position=89-256
LFHVQTLKGPNKVGFVGLIIPLHTQFQDLPPNQLHPLISKAMIKYFSPNLNLIIA

SEQ ID NO: 34712 - protein, 266 aa, Diabrotica virgifera
  misc_feature: Coding regions on vcDNA: vcDNA=SeqID_14409; Strand=+; Position=43-840
  misc_feature: Homolog annotation: Hit_ID=XP_319852.1; Match level="QueryCoverage =98%, HitCoverage=81%, E-value=2e-77, Identity=52%"; Hit description =ENSANGP00000015959 [Anopheles gambiae]
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=-90.7, E-value =2.4e-06, Copies=1"; Pfam description=Lipase
MCLKVAGGLLFFSFISNALCQFTLPNNPVKDALFLHNFVSSNLTLQDCVYRPANSQCPDKDVSYILYTKGQKAVVDYTQTDWLRQSIWDPLKEDIMLIHGYAGGDNELPMVVLRDAYIRNGSYNVWIVDWGRLGPPPCYRAGVNNMKTVAKCTGELLTSLRTAGLPTDRLTCVGHSLGSHVCGLISRYVNFRIHRIVALDPAKPFIPPGSRLSSGNALAVHVLHTNAGHYGGGGKGGHVDFCINGGRVQPYCENADIDIQLCSHVW

SEQ ID NO: 34713 - protein, 143 aa, Diabrotica virgifera
  misc_feature: Coding regions on vcDNA: vcDNA=SeqID_14410; Strand=+; Position=1-429
  misc_feature (4)..(10): Xaa can be any naturally occurring amino acid
  misc_feature (25)..(33): Xaa can be any naturally occurring amino acid
  misc_feature (40)..(52): Xaa can be any naturally occurring amino acid
  misc_feature (54)..(60): Xaa can be any naturally occurring amino acid
SFFXXXXXXXGPPPGVTTLKKRRLXXXXXXXXXGGGEPGXXXXXXXXXXXXXWXXXXXXXVFGKGSDPPLPALRGVCPLGSGALSGRRPKIHNPAPLAPKENGGGGGKTKNRGTLGAGGAVLSIPTFCTKRGSGLPAPPAAPG

SEQ ID NO: 34714 - protein, 138 aa, Diabrotica virgifera
  misc_feature: Coding regions on vcDNA: vcDNA=SeqID_14411; Strand=-; Position=1-414
  misc_feature: Homolog annotation: Hit_ID=XP_311512.1; Match level="QueryCoverage =93%, HitCoverage=27%, E-value=6e-22, Identity=39%"; Hit description =ENSANGP00000025366 [Anopheles gambiae]
  misc_feature: Gene Ontology Annotation: Cellular component=membrane; Biological process=signal transduction
  misc_feature (26)..(39): Xaa can be any naturally occurring amino acid
MVSLWSTFVNIHYKKHLLISIILRIXXXXXXXXXXXXXXLKYTDIDYKVFTDASRHYLEGNSPYNRHTYRYSPLVAILLIPNVTLHHSFGKILFCSIDIIVALLIRLIVKNTIKEYECYKQKDSKKSKLQDISKLKNA

SEQ ID NO: 34715 - protein, 66 aa, Diabrotica virgifera; identical to SEQ ID NO: 26808
  misc_feature: Coding regions on vcDNA: vcDNA=SeqID_14412; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34716 - protein, 57 aa, Diabrotica virgifera
  misc_feature: Coding regions on vcDNA: vcDNA=SeqID_14413; Strand=-; Position=0-170
  misc_feature (1)..(56): Xaa can be any naturally occurring amino acid
XXXXXXXXXXXXXXXXXXXXXXXXXXXXXXXXXXXXXXXXXXXXXXXXXXXXXXXXP

SEQ ID NO: 34717 - protein, 64 aa, Diabrotica virgifera
  misc_feature: Coding regions on vcDNA: vcDNA=SeqID_14414; Strand=-; Position=69-263
  misc_feature (2)..(10): Xaa can be any naturally occurring amino acid
  misc_feature (24)..(32): Xaa can be any naturally occurring amino acid
IXXXXXXXXXVKAQPVEIKRSFLXXXXXXXXXIEYLKYISYVPFSFTFNNYSLENYLLININIF

SEQ ID NO: 34718 - protein, 275 aa, Diabrotica virgifera
  misc_feature: Coding regions on vcDNA: vcDNA=SeqID_14415; Strand=+; Position=40-864
  misc_feature: Homolog annotation: Hit_ID=AAK32875.1; Match level="QueryCoverage =96%, HitCoverage=64%, E-value=1e-42, Identity=39%"; Hit description =cyclin B1 [Rana dybowskii]
  misc_feature: Gene Ontology Annotation: Molecular function=cyclin-dependent protein kinase, intrinsic regulator activity; Cellular component=cytosol; Biological process=mitotic anaphase B
  misc_feature: Pfam annotation: Pfam_ID=Cyclin_N; Match level="Score=196.4, E-value =5.8e-56, Copies=1"; Pfam description=Cyclin, N-terminal domain
MAAPRRAAQTVNQENVNSRLAVKSNVTAPLEPLKRPALGELGNTLQDTQKAQNGLAPTKDGFKKPEGTLQPKKETIKTLTNKEKAIPIKPRTILKRQESLVKPLQGKCTQPKEVPRTSTLVNKKLSIVDPDESSKNDPQMVTEYVMDIFKYLRDMELKLAIKDNFLKDHETTSRMRAILVNWLVDVHANFKATLDTLHICIGIVDRYLQANKKVGRNTLQLVGASAMLIACKYEEIYVPELDDFEYVCDHTFTKRQILQMEKGILKGLDFSLGRP

SEQ ID NO: 34719 - protein, 290 aa, Diabrotica virgifera
  misc_feature: Coding regions on vcDNA: vcDNA=SeqID_14416; Strand=+; Position=3-873
  misc_feature: Homolog annotation: Hit_ID=XP_419937.1; Match level="QueryCoverage =67%, HitCoverage=49%, E-value=2e-25, Identity=34%"; Hit description =PREDICTED: similar to thymidylate kinase family LPS-inducible member; thymidylate kinase homologue
  misc_feature: Pfam annotation: Pfam_ID=Thymidylate_kin; Match level="Score=6.3, E -value=4.2e-05, Copies=1"; Pfam description=Thymidylate kinase
  misc_feature (113)..(118): Xaa can be any naturally occurring amino acid
  misc_feature (149)..(154): Xaa can be any naturally occurring amino acid
  misc_feature (271)..(271): Xaa can be any naturally occurring amino acid
  misc_feature (279)..(279): Xaa can be any naturally occurring amino acid
TVLVAFLVLLEHTCSGRYLQTCGPNDNEKTIFNQTDYSVIGPPLLYHDVESVLELLRKPEYKTNIYVQQLLEQYHQAKDRDQQIEAPGNSKKYPLIVIEGMSGTGKTTVSTAXXXXXXGKQIHSPPKEVKALRAALRNTTELDMAYQAXXXXXXGLEVQRMLRDSPVVMDRYWHSYAALAISTAVNNYPDQYQFPPKGDKVYDWPEDLLKPDIVLLLSVDEDIRQQRLNKRRKAHGVIEKPESFTKFLKKCPLFLSHMLTAYKRMHNPGSXVIDGNPTXEEVFNSIYSKV

SEQ ID NO: 34720 - protein, 66 aa, Diabrotica virgifera; identical to SEQ ID NO: 26808
  misc_feature: Coding regions on vcDNA: vcDNA=SeqID_14417; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34721 - protein, 292 aa, Diabrotica virgifera
  misc_feature: Coding regions on vcDNA: vcDNA=SeqID_14418; Strand=+; Position=38-913
  misc_feature: Homolog annotation: Hit_ID=JN0760; Match level="QueryCoverage=11%, HitCoverage=6%, E-value=6e-09, Identity=94%"; Hit description=H+ -transporting two-sector ATPase (EC 3.6.3.14) beta chain precursor - fruit fly (Drosophila
  misc_feature (63)..(258): Xaa can be any naturally occurring amino acid
  misc_feature (272)..(272): Xaa can be any naturally occurring amino acid
IRFCSLPSCRSWTMLGAVARATSSLLAGKSIEKVGSESLKIVSSYNVQKRDFAAKAAAGKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLKDKTSKVALVYXQMNEPPAARARVALTGLTVA

SEQ ID NO: 34722 - protein, 168 aa, Diabrotica virgifera
  misc_feature: Coding regions on vcDNA: vcDNA=SeqID_14419; Strand=+; Position=2-508
  misc_feature: Homolog annotation: Hit_ID=CAE62644.1; Match level="QueryCoverage =95%, HitCoverage=98%, E-value=1e-11, Identity=31%"; Hit description =Hypothetical protein CBG06778 [Caenorhabditis briggsae]
  misc_feature: Pfam annotation: Pfam_ID=TIL; Match level="Score=58.4, E-value=2e-14, Copies=2"; Pfam description=Trypsin Inhibitor like cysteine rich
GKFVLLSVLCLGCVLVFGQNGTTTNAPYIICGPGQHYDNCSNPCTPVPTCQNPNPTLQNCSGFCLPQCVCNANQGLILDASTQKCVEKGKCPSDTTTNAPYTKCGPGQQYNDCTNPCRPVPTCQNPYPTPQNCSGFCLPQCVCDANQGLILDASTQTCVDKRKCPPGF

SEQ ID NO: 34723 - protein, 79 aa, Diabrotica virgifera
  misc_feature: Coding regions on vcDNA: vcDNA=SeqID_14420; Strand=+; Position=362-601
AKAFRLQVKTTTNYGSKILSVPLQIIRKNQEQTQDTTPMVCYGLIRHVNKKPPVKIITKSDPNLNFYNVRKYWKKQNPC

SEQ ID NO: 34724 - protein, 117 aa, Diabrotica virgifera
  misc_feature: Coding regions on vcDNA: vcDNA=SeqID_14421; Strand=-; Position=287-640
SVLQDATKRAVPTELKNYGQTFSILSTDVLKKQRLRLKWKQNIVVKIKCVTLEYVARSDQLLFLRTFQCYTKNFCLYQSKIKTASLRRNKIIPQEFHEWYKSIPVVKKSFHTVTSFF

SEQ ID NO: 34725 - protein, 84 aa, Diabrotica virgifera
  misc_feature: Coding regions on vcDNA: vcDNA=SeqID_14422; Strand=-; Position=152-406
  misc_feature (15)..(23): Xaa can be any naturally occurring amino acid
KKRVFFSPQKYIDLXXXXXXXXXFLSTVYSLHLFIILTIYFLYSLTYSTLFHFHYSTTLAPTFFTHSNPSLPTKLLPPTSFLYT

SEQ ID NO: 34726 - protein, 35 aa, Diabrotica virgifera
  misc_feature: Coding regions on vcDNA: vcDNA=SeqID_14423; Strand=-; Position=1-105
  misc_feature (3)..(35): Xaa can be any naturally occurring amino acid
KKXXXXXXXXXXXXXXXXXXXXXXXXXXXXXXXXX

SEQ ID NO: 34727 - protein, 53 aa, Diabrotica virgifera
  misc_feature: Coding regions on vcDNA: vcDNA=SeqID_14424; Strand=+; Position=1-159
  misc_feature (1)..(32): Xaa can be any naturally occurring amino acid
  misc_feature (35)..(41): Xaa can be any naturally occurring amino acid
XXXXXXXXXXXXXXXXXXXXXXXXXXXXXXXXLAXXXXXXXSFYIIISLNNFL

SEQ ID NO: 34728 - protein, 27 aa, Diabrotica virgifera
  misc_feature: Coding regions on vcDNA: vcDNA=SeqID_14425; Strand=+; Position=3-83
  misc_feature (1)..(6): Xaa can be any naturally occurring amino acid
  misc_feature (19)..(25): Xaa can be any naturally occurring amino acid
XXXXXXDTLLKLYYEIKNXXXXXXXNI

SEQ ID NO: 34729 - protein, 71 aa, Diabrotica virgifera
  misc_feature: Coding regions on vcDNA: vcDNA=SeqID_14426; Strand=-; Position=1-213
  misc_feature (2)..(9): Xaa can be any naturally occurring amino acid
  misc_feature (14)..(71): Xaa can be any naturally occurring amino acid
HXXXXXXXXIGFFXXXXXXXXXXXXXXXXXXXXXXXXXXXXXXXXXXXXXXXXXXXXXXXXXXXXXXXXXX

SEQ ID NO: 34730 - protein, 48 aa, Diabrotica virgifera
  misc_feature: Coding regions on vcDNA: vcDNA=SeqID_14427; Strand=-; Position=1-144
  misc_feature (5)..(23): Xaa can be any naturally occurring amino acid
  misc_feature (26)..(46): Xaa can be any naturally occurring amino acid
KKNGXXXXXXXXXXXXXXXXXXXYHXXXXXXXXXXXXXXXXXXXXXIN

SEQ ID NO: 34731 - protein, 116 aa, Diabrotica virgifera
  misc_feature: Coding regions on vcDNA: vcDNA=SeqID_14428; Strand=+; Position=1-351
  misc_feature (1)..(92): Xaa can be any naturally occurring amino acid
  misc_feature (100)..(110): Xaa can be any naturally occurring amino acid
  misc_feature (114)..(114): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSLHFFXXXXXXXXXXXIINXFF

SEQ ID NO: 34732 - protein, 39 aa, Diabrotica virgifera
  misc_feature: Coding regions on vcDNA: vcDNA=SeqID_14429; Strand=+; Position=1-120
  misc_feature (9)..(9): Xaa can be any naturally occurring amino acid
DDLREYFVXVGKVTDAFIPKPFRAFKFETFLSLCEEDIL

SEQ ID NO: 34733 - protein, 108 aa, Diabrotica virgifera; identical to SEQ ID NO: 27732
  misc_feature: Coding regions on vcDNA: vcDNA=SeqID_14430; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 34734 - protein, 32 aa, Diabrotica virgifera
  misc_feature: Coding regions on vcDNA: vcDNA=SeqID_14431; Strand=-; Position=1-96
  misc_feature (2)..(10): Xaa can be any naturally occurring amino acid
  misc_feature (15)..(32): Xaa can be any naturally occurring amino acid
MXXXXXXXXXLINNXXXXXXXXXXXXXXXXXX

SEQ ID NO: 34735 - protein, 37 aa, Diabrotica virgifera
  misc_feature: Coding regions on vcDNA: vcDNA=SeqID_14432; Strand=+; Position=12-122
NQIYNYSDFSNSFEKPQVRNSKCFSCIPIKNYLHTYL

SEQ ID NO: 34736 - protein, 94 aa, Diabrotica virgifera
  misc_feature: Coding regions on vcDNA: vcDNA=SeqID_14433; Strand=-; Position=219-503
  misc_feature (15)..(26): Xaa can be any naturally occurring amino acid
  misc_feature (28)..(38): Xaa can be any naturally occurring amino acid
  misc_feature (54)..(62): Xaa can be any naturally occurring amino acid
  misc_feature (70)..(78): Xaa can be any naturally occurring amino acid
  misc_feature (80)..(89): Xaa can be any naturally occurring amino acid
YTILSYQYYHHIISXXXXXXXXXXXXEXXXXXXXXXXXSQCQNLKIEISNSYFXXXXXXXXXLSSYPHIXXXXXXXXXKXXXXXXXXXXGYLFY

SEQ ID NO: 34737 - protein, 66 aa, Diabrotica virgifera; identical to SEQ ID NO: 26808
  misc_feature: Coding regions on vcDNA: vcDNA=SeqID_14434; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34738 - protein, 30 aa, Diabrotica virgifera
  misc_feature: Coding regions on vcDNA: vcDNA=SeqID_14435; Strand=-; Position=1-90
  misc_feature (3)..(30): Xaa can be any naturally occurring amino acid
KNXXXXXXXXXXXXXXXXXXXXXXXXXXXX

SEQ ID NO: 34739 - protein, 229 aa, Diabrotica virgifera
  misc_feature: Coding regions on vcDNA: vcDNA=SeqID_14436; Strand=+; Position=1-690
  misc_feature: Homolog annotation: Hit_ID=XP_315708.1; Match level="QueryCoverage =81%, HitCoverage=48%, E-value=3e-41, Identity=45%"; Hit description =ENSANGP00000004349 [Anopheles gambiae]
  misc_feature: Gene Ontology Annotation: Molecular function=transcriptional activator activity; Cellular component=nucleus; Biological process =regulation of cholesterol biosynthesis
  misc_feature: Pfam annotation: Pfam_ID=EMP24_GP25L; Match level="Score=69.8, E -value=7.7e-18, Copies=1"; Pfam description=emp24/gp25L/p24 family
  misc_feature (15)..(21): Xaa can be any naturally occurring amino acid
AFNVVKRFMNGYTLXXXXXXXNDPRKWQPVLLEAIDLDNLPAHFGGNLKDPDGNPRYTTVIKQGGKVPQSYYKKNIEVKNYEQEFTKAVIKKGHKCILDFIVVEEGCHLKWDFKTDEHDIKFGITLKDENGVESPVVRHRRVASHQIDESGVIACQAPATYIVTFDNKYSMFRSKTIYYRIYVTPPLEKLNIVPHDNDLNILQLNLDENLESPKKEQLNNNAVVEPTTA

SEQ ID NO: 34740 - protein, 284 aa, Diabrotica virgifera
  misc_feature: Coding regions on vcDNA: vcDNA=SeqID_14437; Strand=-; Position=0-851
  misc_feature (1)..(281): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCGG

SEQ ID NO: 34741 - protein, 259 aa, Diabrotica virgifera
  misc_feature: Coding regions on vcDNA: vcDNA=SeqID_14438; Strand=+; Position=145-920
  misc_feature: Homolog annotation: Hit_ID=XP_391932.1; Match level="QueryCoverage =98%, HitCoverage=50%, E-value=2e-49, Identity=40%"; Hit description =similar to Transcriptional adaptor 2 (ADA2 homolog, yeast)-like [Apis mellifera]
  misc_feature: Gene Ontology Annotation: Molecular function=transcription co -activator activity; Cellular component=SAGA complex; Biological process=histone acetylation
  misc_feature: Pfam annotation: Pfam_ID=Myb_DNA-binding; Match level="Score=37.9, E -value=3e-08, Copies=1"; Pfam description=Myb-like DNA-binding domain
  misc_feature (88)..(94): Xaa can be any naturally occurring amino acid
  misc_feature (235)..(235): Xaa can be any naturally occurring amino acid
MANTNTDLTEEDAADLQFPKDDDLSTFSSCNIFDSNDSTYCTNCLNEIQSKYILCEKCKVNICLSCFSNGAEFSDHKNDHDYRVLSTXXXXXXXSDWTAEEELKLLDGISNYGNWYHLAQELPNRSVNEIIEHYDYYYLQRNGCERFPKAKVPDAALFPQLVVPYRFQLNHSDEPPRYLSNTIGNKSLAGYNPARSDFEIEYDKNAEDILSNLEIIDEDDPMYDLLTKLQCLLVXAYNRRLRTRYRWHSLIRDHGLSVI

SEQ ID NO: 34742 - protein, 93 aa, Diabrotica virgifera; identical to SEQ ID NO: 27329
  misc_feature: Coding regions on vcDNA: vcDNA=SeqID_14439; Strand=+; Position=480-761
  misc_feature (25)..(55): Xaa can be any naturally occurring amino acid

SEQ ID NO: 34743 - protein, 156 aa, Diabrotica virgifera
  misc_feature: Coding regions on vcDNA: vcDNA=SeqID_14440; Strand=+; Position=20-490
MNKLAVFVLLFAIALQQTSAIFWPRQRRDVQDIQNLVPVEEMPPSRNLRIIAPPERKYGSYSLDVGNAEMTAEDAADPELTEQISILEQFLADKAVEIQKLWAETQVDLAEFSKKFEQLIEEEVANKILLDQEAAQAPKRMMMEYRPRQTRMVKKN

SEQ ID NO: 34744 - protein, 261 aa, Diabrotica virgifera
  misc_feature: Coding regions on vcDNA: vcDNA=SeqID_14441; Strand=+; Position=116-897
  misc_feature: Homolog annotation: Hit_ID=XP_311210.1; Match level="QueryCoverage =98%, HitCoverage=55%, E-value=2e-35, Identity=32%"; Hit description =ENSANGP00000019057 [Anopheles gambiae]
  misc_feature (36)..(44): Xaa can be any naturally occurring amino acid
  misc_feature (98)..(107): Xaa can be any naturally occurring amino acid
  misc_feature (244)..(246): Xaa can be any naturally occurring amino acid
  misc_feature (250)..(250): Xaa can be any naturally occurring amino acid
MDCEITTDSISQSDELPGPPKRKKKCETTVSENDNXXXXXXXXXPRKKRYCKMTVKEGETYCGEHKKISSDVPETEVTKDSPIRIICPLDGKHTCYAXXXXXXXXXXNARPKPTAPYILKGINNCSSDETDMDNSYNLLSTFSEADIVKTIAKVNEIYQKLIKEKITEKQLKNNLLEEEMAKPDYGPKTKKHLQQVSSILGLIKEYGMMKPATCYIEFGAGRGQLSFWLAKMIEDDNTSKNFAXXXRASXKHKKDNKLAQT

SEQ ID NO: 34745 - protein, 263 aa, Diabrotica virgifera
  misc_feature: Coding regions on vcDNA: vcDNA=SeqID_14442; Strand=+; Position=76-864
  misc_feature: Homolog annotation: Hit_ID=EAA07254.3; Match level="QueryCoverage =86%, HitCoverage=23%, E-value=2e-72, Identity=56%"; Hit description =ENSANGP00000010240 [Anopheles gambiae str. PEST] ref|XP_559030.1| ENSANGP00000010240 [Anopheles gambiae st
  misc_feature: Gene Ontology Annotation: Molecular function=valine-tRNA ligase activity; Cellular component=mitochondrion; Biological process =reproduction
  misc_feature: Pfam annotation: Pfam_ID=tRNA-synt_1; Match level="Score=-167.8, E -value=2e-07, Copies=1"; Pfam description=tRNA synthetases class I (I, L, M and
  misc_feature (242)..(242): Xaa can be any naturally occurring amino acid
MLRILDNKLIIRCKHLNKLQIRSYVINNQKNLELDQAYVPHKVENVTKPNYFKPQQKQSRPFILVLPPPNITGTLHIGHALTATIQDVLVRWKQMQGFETLWIPGTDHAGIATQVVVEKLLWSENKQTRHDIGRELFIEKVHEWRREKSPIIREQLQRLGVLLDWDREVFTLDEQRTKAVQEAFIKLFEEGLIYRSKSLVNWSCALKSAISDIEVEQLSLTGATNISVPGYEEPIEFGILTXFAYLIDGTEEEIVVATTRPET

SEQ ID NO: 34746 - protein, 84 aa, Diabrotica virgifera
  misc_feature: Coding regions on vcDNA: vcDNA=SeqID_14443; Strand=+; Position=140-394
NRFENFSFIEYRTFGKYRLCQFLLPLILMHNWYLYGAWLNVLIPTFLTVNCFKRIITNQFIYNLIHASVMIHSFYYNERNIIRK

SEQ ID NO: 34747 - protein, 239 aa, Diabrotica virgifera
  misc_feature: Coding regions on vcDNA: vcDNA=SeqID_14444; Strand=+; Position=148-864
  misc_feature: Homolog annotation: Hit_ID=EAA08449.3; Match level="QueryCoverage =96%, HitCoverage=54%, E-value=1e-79, Identity=58%"; Hit description =ENSANGP00000020326 [Anopheles gambiae str. PEST] ref|XP_562868.1| ENSANGP00000020326 [Anopheles gambiae st
  misc_feature: Gene Ontology Annotation: Molecular function=transcription co -activator activity; Cellular component=SAGA complex; Biological process=histone acetylation
  misc_feature: Pfam annotation: Pfam_ID=Myb_DNA-binding; Match level="Score=36.4, E -value=8.6e-08, Copies=1"; Pfam description=Myb-like DNA-binding domain
  misc_feature (203)..(203): Xaa can be any naturally occurring amino acid
  misc_feature (221)..(221): Xaa can be any naturally occurring amino acid
MTDLFTKVNCTYCQEEINSVRVKCCVCADFDICLPCFSVGAEIGPHKNDHSYKFVDHCAASVFGGRGGWTGKEHLQLLEAVELYGFGNWELISQHVESRTPEEVKEEYIARYLDGNIGRATLASVIANKPVLTDHVSEDDGPLSPKVVARLPPLDVTLEEARLLGYRPHRDDYEREYNMEAEQLVSKLVLDPDQDTEMEIALXLSIVDMYARRLRERARRXRLVREYQLVANTLMKKIL

SEQ ID NO: 34748 - protein, 40 aa, Diabrotica virgifera
  misc_feature: Coding regions on vcDNA: vcDNA=SeqID_14445; Strand=+; Position=4-126
  misc_feature (18)..(18): Xaa can be any naturally occurring amino acid
  misc_feature (26)..(34): Xaa can be any naturally occurring amino acid
QRNFIGRVQSIIKIATSXVDLSYNWXXXXXXXXXRLFKFT

SEQ ID NO: 34749 - protein, 291 aa, Diabrotica virgifera
  misc_feature: Coding regions on vcDNA: vcDNA=SeqID_14446; Strand=+; Position=1-873
  misc_feature: Homolog annotation: Hit_ID=NP_728384.1; Match level="QueryCoverage =100%, HitCoverage=55%, E-value=3e-80, Identity=50%"; Hit description= CG1753-PB, isoform B [Drosophila melanogaster] ref|NP_608424.1| CG1753-PA, isoform A [Drosophila
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=182.3, E-value=1.1e- 51, Copies=1"; Pfam description=Pyridoxal-phosphate dependent enzyme
  misc_feature (241)..(241): Xaa can be any naturally occurring amino acid
IEDAEKLGTLKPGMTIIETTSGNTGIALAWVCAIKDYKCILVLPDKASKEKEDIMKAFGATVVRVPMDEPDISEHGKYGKTHYIHKQTPNSIILDQFSNPSNAVAHYDNTAEEIYYQCDGQVDMIVFAAGTGGTMTGIGRKFKEISPNTIIIGADPHSSFFAEPPEINKTDVKFSEVEGIGDHIVPVTCDRHNIDKWYKLYDKESLVMARRLIKEEGLLVGLSSGVIMAGALKAVKDFNLXKGKKVVVVFPDGTRNYLTKFIVDQWMEQRNLLPVTNPNGHWWWDINIMQL

SEQ ID NO: 34750 - protein, 98 aa, Diabrotica virgifera
  misc_feature: Coding regions on vcDNA: vcDNA=SeqID_14447; Strand=+; Position=246-542
  misc_feature (33)..(39): Xaa can be any naturally occurring amino acid
  misc_feature (76)..(82): Xaa can be any naturally occurring amino acid
IGPHTFLKHRRKHSDRCNFSTHIHTYISTNIFXXXXXXXVIFLSSISFEWYNRFSKFNMRWKGNYLCYQEPQRSGXXXXXXXEFWGRERKTGFKWEGP

SEQ ID NO: 34751 - protein, 84 aa, Diabrotica virgifera
  misc_feature: Coding regions on vcDNA: vcDNA=SeqID_14448; Strand=+; Position=384-638
YLFKNYSYITKTCPYNILNGLLSPLSSHGYQPHLKPHLLTTTHPSTEQTKTTRPIPPTIDTTQTLNLIYKQQLKQCSDYPLDHY

SEQ ID NO: 34752 - protein, 96 aa, Diabrotica virgifera
  misc_feature: Coding regions on vcDNA: vcDNA=SeqID_14449; Strand=+; Position=291-581
  misc_feature (57)..(57): Xaa can be any naturally occurring amino acid
LDKNNFPNVNKNDSKSSTFYLTCLKAMYFLADENNRTTYDTCRATPDLMKGMIGEPXHSSIPQGFLQNVHYQSTNDPKYVSNKILLRCLYSYVFSL

SEQ ID NO: 34753 - protein, 85 aa, Diabrotica virgifera
  misc_feature: Coding regions on vcDNA: vcDNA=SeqID_14450; Strand=+; Position=150-407
ERYYTYRPVCSRNVLTPKMKYIFLGGLCTEEWNPFVYHSCIVFTDQLLGLVKPYPVLRSVHLPYTVGSIYYTIQMIVVLKIFIVL

SEQ ID NO: 34754 - protein, 58 aa, Diabrotica virgifera
  misc_feature: Coding regions on vcDNA: vcDNA=SeqID_14451; Strand=-; Position=1-174
  misc_feature (2)..(23): Xaa can be any naturally occurring amino acid
  misc_feature (27)..(57): Xaa can be any naturally occurring amino acid
KXXXXXXXXXXXXXXXXXXXXXXINKXXXXXXXXXXXXXXXXXXXXXXXXXXXXXXXF

SEQ ID NO: 34755 - protein, 50 aa, Diabrotica virgifera
  misc_feature: Coding regions on vcDNA: vcDNA=SeqID_14452; Strand=-; Position=167-319
LCNHTSVISINNRYYIVIRLISLVEAENYFCISWKVLAFSIRNNRRGQDE

SEQ ID NO: 34756 - protein, 70 aa, Diabrotica virgifera
  misc_feature: Coding regions on vcDNA: vcDNA=SeqID_14453; Strand=+; Position=27-239
KKCKEMYLGNEAFSNMRLWKMSLFFHAELQLIVCHTYLKTPCFNYFQFCTFTININCKSKTPQEHSPEPY

SEQ ID NO: 34757 - protein, 27 aa, Diabrotica virgifera
  misc_feature: Coding regions on vcDNA: vcDNA=SeqID_14454; Strand=-; Position=1-81
  misc_feature (3)..(3): Xaa can be any naturally occurring amino acid
  misc_feature (5)..(26): Xaa can be any naturally occurring amino acid
YIXKXXXXXXXXXXXXXXXXXXXXXXN

SEQ ID NO: 34758 - protein, 195 aa, Diabrotica virgifera
  misc_feature: Coding regions on vcDNA: vcDNA=SeqID_14455; Strand=-; Position=266-852
  misc_feature: Homolog annotation: Hit_ID=XP_312124.1; Match level="QueryCoverage =95%, HitCoverage=70%, E-value=1e-31, Identity=42%"; Hit description =ENSANGP00000023417 [Anopheles gambiae]
  misc_feature (49)..(49): Xaa can be any naturally occurring amino acid
  misc_feature (112)..(112): Xaa can be any naturally occurring amino acid
ICIASLLTKDNHVSDEIITDIVLANKCYYALRSQMASNIPRNIKSTVYXTLISPVLTYDSETCPPTQNDQELFIRCQRKIIRRIYGGIQEQGLWRRRYNFELYRNFGEPDVXFIKVARLRWIGHVIRREEDAIVRKVFDRRGPIAQRARGRPILRYQVNIDTHLKSIGIRARRRVARDRGEWRIVLKKALAHKEL

SEQ ID NO: 34759 - protein, 129 aa, Diabrotica virgifera
  misc_feature: Coding regions on vcDNA: vcDNA=SeqID_14456; Strand=-; Position=1-387
  misc_feature (1)..(7): Xaa can be any naturally occurring amino acid
  misc_feature (10)..(17): Xaa can be any naturally occurring amino acid
  misc_feature (29)..(41): Xaa can be any naturally occurring amino acid
  misc_feature (44)..(129): Xaa can be any naturally occurring amino acid
XXXXXXXSTXXXXXXXXPIINLIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34760 - protein, 51 aa, Diabrotica virgifera
  misc_feature: Coding regions on vcDNA: vcDNA=SeqID_14457; Strand=-; Position=1-153
  misc_feature (4)..(34): Xaa can be any naturally occurring amino acid
  misc_feature (36)..(51): Xaa can be any naturally occurring amino acid
PQFXXXXXXXXXXXXXXXXXXXXXXXXXXXXXXXEXXXXXXXXXXXXXXXX

SEQ ID NO: 34761 - protein, 34 aa, Diabrotica virgifera; identical to SEQ ID NO: 27603
  misc_feature: Coding regions on vcDNA: vcDNA=SeqID_14458; Strand=-; Position=80-184

SEQ ID NO: 34762 - protein, 62 aa, Diabrotica virgifera
  misc_feature: Coding regions on vcDNA: vcDNA=SeqID_14459; Strand=+; Position=175-360
  misc_feature (55)..(62): Xaa can be any naturally occurring amino acid
NRHWKINIPNNFSAKTCDSILYISSFRKTKFSTSISSIERIKYLYIITIRYFKEXXXXXXXX

SEQ ID NO: 34763 - protein, 83 aa, Diabrotica virgifera
  misc_feature: Coding regions on vcDNA: vcDNA=SeqID_14460; Strand=+; Position=3-254
  misc_feature (6)..(22): Xaa can be any naturally occurring amino acid
  misc_feature (25)..(41): Xaa can be any naturally occurring amino acid
RPLLNXXXXXXXXXXXXXXXXXYYXXXXXXXXXXXXXXXXXLTEKYKCTKELSHPHFLQIYKERATYLLNKDTRKSRQYYYLR

SEQ ID NO: 34764 - protein, 48 aa, Diabrotica virgifera
  misc_feature: Coding regions on vcDNA: vcDNA=SeqID_14461; Strand=+; Position=174-320
  misc_feature (25)..(32): Xaa can be any naturally occurring amino acid
ENPPSPPGGKRKPPLKKFFRDFFPXXXXXXXXFVSPPPGGTPPREGFF

SEQ ID NO: 34765 - protein, 218 aa, Diabrotica virgifera
  misc_feature: Coding regions on vcDNA: vcDNA=SeqID_14462; Strand=+; Position=51-707
  misc_feature: Homolog annotation: Hit_ID=AAR88539.1; Match level="QueryCoverage =54%, HitCoverage=17%, E-value=1e-10, Identity=31%"; Hit description =RE44946p [Drosophila melanogaster]
MDSEPASAWDLDLGILINMVKQFPYLYNSRHENFKNTALRERTWCNIAERLKVPVGDCQRIWKNLRDKWSKEKRITMQNPAISSEWEFYEVLKFLQPFVRRRRRARLKPNRTNLQNASLKNEIEETFEESINPDDIVKKMWNRNLGVQVCPENVTFLESEMEEAAESEEITLDFVDDPPPKEETVIRYQTSEEAFGAYVACRLMDFSVEERQTKEDLE

SEQ ID NO: 34766 - protein, 93 aa, Diabrotica virgifera
  misc_feature: Coding regions on vcDNA: vcDNA=SeqID_14463; Strand=-; Position=1-279
RHNSTSDYIVCATSPILIQDEIGDFCFIANSKALSASRHCTSVKSTYHHSGSLVRQRQRPETESSVSSSAILLSHYSPISGTSSSTLVHKCSI

SEQ ID NO: 34767 - protein, 59 aa, Diabrotica virgifera
  misc_feature: Coding regions on vcDNA: vcDNA=SeqID_14464; Strand=-; Position=2-178
  misc_feature (2)..(20): Xaa can be any naturally occurring amino acid
  misc_feature (36)..(47): Xaa can be any naturally occurring amino acid
  misc_feature (50)..(59): Xaa can be any naturally occurring amino acid
SXXXXXXXXXXXXXXXXXXXSKIRGPSKLISGRASXXXXXXXXXXXXPVXXXXXXXXXX

SEQ ID NO: 34768 - protein, 260 aa, Diabrotica virgifera
  misc_feature: Coding regions on vcDNA: vcDNA=SeqID_14465; Strand=+; Position=1-780
  misc_feature (27)..(35): Xaa can be any naturally occurring amino acid
  misc_feature (72)..(81): Xaa can be any naturally occurring amino acid
GLFSKKKSSDKEQDGKPSKEEINKSKXXXXXXXXXDLTAKPESKDFSKIETDRLQDSKKSKEESGSFFGLFXXXXXXXXXXKSIEEEIPHKLSTEVLQNMKQSSDFLDTEVKVYHDVRPELDKSFTDDNFKPVTLSPIDTSFTLTTETTKHEDHIKHERHIKTEETQKSSQYTTDEAFAETLADESPKRTITTTVTKQEIPHGERTTKVKTEVLTGTIQLSPDVLNDIEKLEKEINMKLEELRKQTDSTDDLRKQPPHYS

SEQ ID NO: 34769 - protein, 35 aa, Diabrotica virgifera
  misc_feature: Coding regions on vcDNA: vcDNA=SeqID_14466; Strand=-; Position=1-105
  misc_feature (3)..(32): Xaa can be any naturally occurring amino acid
ITXXXXXXXXXXXXXXXXXXXXXXXXXXXXXXKKM

SEQ ID NO: 34770 - protein, 125 aa, Diabrotica virgifera
  misc_feature: Coding regions on vcDNA: vcDNA=SeqID_14467; Strand=+; Position=2-376
  misc_feature (3)..(57): Xaa can be any naturally occurring amino acid
  misc_feature (59)..(69): Xaa can be any naturally occurring amino acid
  misc_feature (74)..(79): Xaa can be any naturally occurring amino acid
  misc_feature (83)..(89): Xaa can be any naturally occurring amino acid
  misc_feature (94)..(102): Xaa can be any naturally occurring amino acid
LIXXXXXXXXXXXXXXXXXXXXXXXXXXXXXXXXXXXXXXXXXXXXXXXXXXXXXXXPXXXXXXXXXXXPIKFXXXXXXHGGXXXXXXXLFYIXXXXXXXXXPNIFRYPEKIFPLPRNTPPIFFS

SEQ ID NO: 34771 - protein, 24 aa, Diabrotica virgifera
  misc_feature: Coding regions on vcDNA: vcDNA=SeqID_14468; Strand=-; Position=0-71
  misc_feature (4)..(23): Xaa can be any naturally occurring amino acid
RFSXXXXXXXXXXXXXXXXXXXXV

SEQ ID NO: 34772 - protein, 171 aa, Diabrotica virgifera
  misc_feature: Coding regions on vcDNA: vcDNA=SeqID_14469; Strand=+; Position=386-897
  misc_feature: Homolog annotation: Hit_ID=NP_503046.1; Match level="QueryCoverage =98%, HitCoverage=48%, E-value=7e-26, Identity=40%"; Hit description =transposase (4S113) [Caenorhabditis elegans] gb|AAK77207.1| Hypothetical protein
  misc_feature (83)..(83): Xaa can be any naturally occurring amino acid
  misc_feature (154)..(154): Xaa can be any naturally occurring amino acid
MYRTITRYNDTGSITKRYGGGRKKSATSPEMVRKVKARLQRNPRRSGNQMAKELKISQPSMQRILKKELNVKPYKIQKAHNLXTKAKKKVRLERAKELLRLHGRGEFSNIVFSDEKNFPIERFKNSQNDRVYLTERTYESLSLRTATWSNFPCXVMVWAAVTADGRYPIIF

SEQ ID NO: 34773 - protein, 66 aa, Diabrotica virgifera; identical to SEQ ID NO: 26808
  misc_feature: Coding regions on vcDNA: vcDNA=SeqID_14470; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34774 - protein, 235 aa, Diabrotica virgifera
  misc_feature: Coding regions on vcDNA: vcDNA=SeqID_14471; Strand=+; Position=193-900
  misc_feature (34)..(233): Xaa can be any naturally occurring amino acid
LGRTPMLSNKARERIFFSPFYNIYRSLFFKDILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVN

SEQ ID NO: 34775 - protein, 79 aa, Diabrotica virgifera
  misc_feature: Coding regions on vcDNA: vcDNA=SeqID_14472; Strand=+; Position=3-242
  misc_feature (3)..(42): Xaa can be any naturally occurring amino acid
  misc_feature (49)..(59): Xaa can be any naturally occurring amino acid
  misc_feature (69)..(69): Xaa can be any naturally occurring amino acid
  misc_feature (73)..(79): Xaa can be any naturally occurring amino acid
GRXXXXXXXXXXXXXXXXXXXXXXXXXXXXXXXXXXXXXXXXHAYIFFXXXXXXXXXXXLFISFFSIKXIYIXXXXXXX

SEQ ID NO: 34776 - protein, 119 aa, Diabrotica virgifera
  misc_feature: Coding regions on vcDNA: vcDNA=SeqID_14473; Strand=+; Position=3-362
FEVNTMSKTIVVLALVCCIVVHVQCESIIYCPDPANPGYLQFEEQITSSFPTTIPVHFPSSGTELEISCLLIDCDDNVTAKITAGIGFQVTVDELVFESWEPSTCKIQIYTSHADLTSA

SEQ ID NO: 34777 - protein, 31 aa, Diabrotica virgifera
  misc_feature: Coding regions on vcDNA: vcDNA=SeqID_14474; Strand=-; Position=0-92
FFLPLPGAAAATPGKGKKKEEKKQEKKPQTP

SEQ ID NO: 34778 - protein, 87 aa, Diabrotica virgifera
  misc_feature: Coding regions on vcDNA: vcDNA=SeqID_14475; Strand=-; Position=246-509
LVVNFLDSSLLVVTVFVLFLYVSLITPMLCLSTPPSFSFFHTSFLRILSNAFSISMKHVCISQFLLITFTLTCLIMNIISLACFCPS

SEQ ID NO: 34779 - protein, 80 aa, Diabrotica virgifera
  misc_feature: Coding regions on vcDNA: vcDNA=SeqID_14476; Strand=-; Position=3-242
  misc_feature (4)..(15): Xaa can be any naturally occurring amino acid
  misc_feature (17)..(27): Xaa can be any naturally occurring amino acid
  misc_feature (47)..(60): Xaa can be any naturally occurring amino acid
  misc_feature (67)..(79): Xaa can be any naturally occurring amino acid
VNIXXXXXXXXXXXXFXXXXXXXXXXXNQPGSHRFKLRSCKIVKVEXXXXXXXXXXXXXXSNIEVAXXXXXXXXXXXXXC

SEQ ID NO: 34780 - protein, 40 aa, Diabrotica virgifera
  misc_feature: Coding regions on vcDNA: vcDNA=SeqID_14477; Strand=-; Position=1-120
  misc_feature (2)..(26): Xaa can be any naturally occurring amino acid
  misc_feature (30)..(38): Xaa can be any naturally occurring amino acid
PXXXXXXXXXXXXXXXXXXXXXXXXXIGSXXXXXXXXXFY

SEQ ID NO: 34781 - protein, 250 aa, Diabrotica virgifera
  misc_feature: Coding regions on vcDNA: vcDNA=SeqID_14478; Strand=+; Position=143-888
  misc_feature: Homolog annotation: Hit_ID=XP_395876.1; Match level="QueryCoverage =100%, HitCoverage=54%, E-value=1e-105, Identity=75%"; Hit description=similar to p70 ribosomal protein S6 kinase [Apis mellifera]
  misc_feature: Gene Ontology Annotation: Molecular function=ribosomal protein S6 kinase activity; Cellular component=nucleus; Biological process =positive regulation of cell growth
  misc_feature: Pfam annotation: Pfam_ID=Pkinase; Match level="Score=89.3, E-value =9.8e-24, Copies=1"; Pfam description=Protein kinase domain
  misc_feature (103)..(109): Xaa can be any naturally occurring amino acid
  misc_feature (210)..(210): Xaa can be any naturally occurring amino acid
  misc_feature (219)..(219): Xaa can be any naturally occurring amino acid
  misc_feature (230)..(230): Xaa can be any naturally occurring amino acid
  misc_feature (243)..(243): Xaa can be any naturally occurring amino acid
MAGVFDLELHDVETVEVDDSDDAIEIEEDEYDQNPNINAIVESDDTETVHLTEQIVNPGQEKTGPHDFELRKVLGKGGYGKVFQVRKITGKDANTVFAMKVLXXXXXXXNQKDTAHTKAERNILEEVKHPFIVDLIYAFQTGGKLYLILEYLSGGELFMHLEREGIFLEDTACFYLSEIILALEHLHGQGIIYRDLKPENILLDAHGHVXLTDFGLCKXHINEGILTHTXFCGTIEYMAPEIXTRHGHGK

SEQ ID NO: 34782 - protein, 35 aa, Diabrotica virgifera
  misc_feature: Coding regions on vcDNA: vcDNA=SeqID_14479; Strand=+; Position=2-106
  misc_feature (4)..(11): Xaa can be any naturally occurring amino acid
  misc_feature (13)..(23): Xaa can be any naturally occurring amino acid
  misc_feature (27)..(27): Xaa can be any naturally occurring amino acid
IFLXXXXXXXXFXXXXXXXXXXXIIYXYNLFTRGD

SEQ ID NO: 34783 - protein, 81 aa, Diabrotica virgifera
  misc_feature: Coding regions on vcDNA: vcDNA=SeqID_14480; Strand=-; Position=2-244
EHLKGLSILISFDIAILVEIIISVLMVLSENNEHMVVFRVLPTNSTLCCCVFFYCFNPYPGKWGSIGPKRHVFYMEVKCLA

SEQ ID NO: 34784 - protein, 173 aa, Diabrotica virgifera
  misc_feature: Coding regions on vcDNA: vcDNA=SeqID_14481; Strand=+; Position=8-529
  misc_feature: Homolog annotation: Hit_ID=BAB32480.1; Match level="QueryCoverage =99%, HitCoverage=72%, E-value=8e-28, Identity=37%"; Hit description =cuticle protein [Bombyx mori]
  misc_feature: Gene Ontology Annotation: Molecular function=structural constituent of eye lens
  misc_feature: Pfam annotation: Pfam_ID=Chitin_bind_4; Match level="Score=44.6, E -value=2.9e-10, Copies=1"; Pfam description=Insect cuticle protein
  misc_feature (128)..(136): Xaa can be any naturally occurring amino acid
MFSKILSVLAFTALAQAGVLDYSHGHATSYASSNLGGSEHGHGYSAPVLSHAYAAPVAHGYSAPVLAHGHSAHHDVDYNAYPKYEFNYGVQDGHTGDHKTQHEVRDGDVVKGSYTVAEPDGTLRTVHXXXXXXXXXNAVVEKSGHPVHPAPAHGHGKVLLAAPAVHHAPLYHH

SEQ ID NO: 34785 - protein, 108 aa, Diabrotica virgifera; identical to SEQ ID NO: 30327
  misc_feature: Coding regions on vcDNA: vcDNA=SeqID_14482; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(92): Xaa can be any naturally occurring amino acid
  misc_feature (98)..(105): Xaa can be any naturally occurring amino acid

SEQ ID NO: 34786 - protein, 102 aa, Diabrotica virgifera
  misc_feature: Coding regions on vcDNA: vcDNA=SeqID_14483; Strand=-; Position=54-362
  misc_feature (86)..(95): Xaa can be any naturally occurring amino acid
LLTSAIFSCSLSSIVLCVPHSRLRYSCRSSTIFSFIYFPLSESVALLRCLQLQIMFWFFCTPMSAVRSLSVAGDSLSAHIPFAGAXXXXXXXXXXALSAASG

SEQ ID NO: 34787 - protein, 97 aa, Diabrotica virgifera
  misc_feature: Coding regions on vcDNA: vcDNA=SeqID_14484; Strand=+; Position=250-543
LNWNNDAAVVLYCNEIENGYSFLVKQNNSIWTLRVARYEFVWLRTVAVTNCRRYELSLLRIVAVASCPLPVVRLRTVTLRDVIEPGKTLPPLSPKRS

SEQ ID NO: 34788 - protein, 68 aa, Diabrotica virgifera
  misc_feature: Coding regions on vcDNA: vcDNA=SeqID_14485; Strand=+; Position=27-233
  misc_feature (1)..(8): Xaa can be any naturally occurring amino acid
XXXXXXXXKGMVVALTLCDNSDLCDMLQSEKYWNLVDMIDVYSLIKKFIMRLTEQCSVLHCTYSEKDI

SEQ ID NO: 34789 - protein, 22 aa, Diabrotica virgifera
  misc_feature: Coding regions on vcDNA: vcDNA=SeqID_14486; Strand=-; Position=0-65
  misc_feature (1)..(19): Xaa can be any naturally occurring amino acid
XXXXXXXXXXXXXXXXXXXLFT

SEQ ID NO: 34790 - protein, 127 aa, Diabrotica virgifera
  misc_feature: Coding regions on vcDNA: vcDNA=SeqID_14487; Strand=+; Position=16-396
  misc_feature: Pfam annotation: Pfam_ID=GRP; Match level="Score=-18.5, E-value =0.0048, Copies=1"; Pfam description=Glycine rich protein family
  misc_feature (50)..(50): Xaa can be any naturally occurring amino acid
QAPAHIPPKRKLLFKAAARRRANAEDKTTATDTISAETQTKEKRGRAQGXGGGGHDYGGGGDTGGGDDGGHEEGGGDDQGGHQEHHEKTDTGAKKAAGTDPGTKEGPEPGEKEAQDPGKGHGRKPYP

SEQ ID NO: 34791 - protein, 17 aa, Diabrotica virgifera
  misc_feature: Coding regions on vcDNA: vcDNA=SeqID_14488; Strand=-; Position=1-51
  misc_feature (2)..(12): Xaa can be any naturally occurring amino acid
YXXXXXXXXXXXPFIQL

SEQ ID NO: 34792 - protein, 42 aa, Diabrotica virgifera
  misc_feature: Coding regions on vcDNA: vcDNA=SeqID_14489; Strand=+; Position=3-128
  misc_feature (2)..(14): Xaa can be any naturally occurring amino acid
  misc_feature (26)..(33): Xaa can be any naturally occurring amino acid
  misc_feature (38)..(38): Xaa can be any naturally occurring amino acid
TXXXXXXXXXXXXXCDLDVGFKLYWXXXXXXXXVRLLXFYMI

SEQ ID NO: 34793 - protein, 61 aa, Diabrotica virgifera
  misc_feature: Coding regions on vcDNA: vcDNA=SeqID_14490; Strand=-; Position=0-182
  misc_feature (4)..(27): Xaa can be any naturally occurring amino acid
  misc_feature (30)..(58): Xaa can be any naturally occurring amino acid
KNGXXXXXXXXXXXXXXXXXXXXXXXXNLXXXXXXXXXXXXXXXXXXXXXXXXXXXXXLFT

SEQ ID NO: 34794 - protein, 297 aa, Diabrotica virgifera
  misc_feature: Coding regions on vcDNA: vcDNA=SeqID_14491; Strand=+; Position=1-894
  misc_feature (2)..(256): Xaa can be any naturally occurring amino acid
  misc_feature (258)..(271): Xaa can be any naturally occurring amino acid
  misc_feature (275)..(275): Xaa can be any naturally occurring amino acid
  misc_feature (278)..(278): Xaa can be any naturally occurring amino acid
  misc_feature (283)..(289): Xaa can be any naturally occurring amino acid
  misc_feature (295)..(296): Xaa can be any naturally occurring amino acid
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRXWIXVYNWXXXXXXXVCRLLXXT

SEQ ID NO: 34795 - protein, 176 aa, Diabrotica virgifera
  misc_feature: Coding regions on vcDNA: vcDNA=SeqID_14492; Strand=+; Position=309-835
  misc_feature: Homolog annotation: Hit_ID=XP_310340.1; Match level="QueryCoverage =100%, HitCoverage=28%, E-value=7e-64, Identity=66%"; Hit description= ENSANGP00000015190 [Anopheles gambiae] gb|EAA06052.1| ENSANGP00000015190 [Anopheles gambiae
  misc_feature: Pfam annotation: Pfam_ID=GMC_oxred_N; Match level="Score=-122.2, E -value=0.00068, Copies=1"; Pfam description=GMC oxidoreductase
  misc_feature (27)..(27): Xaa can be any naturally occurring amino acid
  misc_feature (114)..(114): Xaa can be any naturally occurring amino acid
  misc_feature (154)..(154): Xaa can be any naturally occurring amino acid
  misc_feature (160)..(160): Xaa can be any naturally occurring amino acid
MSAIAAPLYGLGAEAVSSLAVFLPTLXAALAYFQYEQLDPESRPIDVPTEELLDTHDFIMVGAGSAGAEVANRLSEIDRWKVLLLEAGGDETEISYVPLVAGYLQLSALDWKYXSEPQGQACLPMNNGRCNWPRGEDIRGSSVLNYMLYLRGTXKDYDIXESMGNPGWSHSDVLYY

SEQ ID NO: 34796 - protein, 46 aa, Diabrotica virgifera
  misc_feature: Coding regions on vcDNA: vcDNA=SeqID_14493; Strand=-; Position=783-923
GSYVLSVLYYGMEPWTLKKINVRRLETFEMWMYRRVLNISSVDSIN

SEQ ID NO: 34797 - protein, 164 aa, Diabrotica virgifera
  misc_feature: Coding regions on vcDNA: vcDNA=SeqID_14494; Strand=-; Position=3-494
  misc_feature: Homolog annotation: Hit_ID=NP_998242.1; Match level="QueryCoverage =99%, HitCoverage=23%, E-value=7e-43, Identity=53%"; Hit description =ubiquitin-like, containing PHD and RING finger domains, 1 [Danio rerio] gb|AAH58055.1|
  misc_feature: Pfam annotation: Pfam_ID=YDG_SRA; Match level="Score=-32.6, E-value =0.0011, Copies=1"; Pfam description=YDG/SRA domain
TGSGGRDLSGNKRVNVQSMDQEFKRGNMALALNCNAPLDKNGAEATDWRAGLPVRVVRKGNPKINSKFSPKDGLRYDGIYKVVKYYPEKGESGFLVYRYLLRRDDPNPAPWEEGGHEDEIVYPDNYSEKQGEKEKKGKPSKGKKRKASEDEMDDVEGKENKEKP

SEQ ID NO: 34798 - protein, 323 aa, Diabrotica virgifera
  misc_feature: Coding regions on vcDNA: vcDNA=SeqID_14495; Strand=+; Position=1-970
  misc_feature: Homolog annotation: Hit_ID=AAF87759.1; Match level="QueryCoverage =99%, HitCoverage=72%, E-value=1e-119, Identity=71%"; Hit description= cytochrome oxidase subunit I [Diabrotica virgifera virgifera]
  misc_feature: Pfam annotation: Pfam_ID=COX1; Match level="Score=166.2, E-value=7e -47, Copies=1"; Pfam description=Cytochrome C and Quinol oxidase polyp
  misc_feature (9)..(9): Xaa can be any naturally occurring amino acid
  misc_feature (31)..(31): Xaa can be any naturally occurring amino acid
  misc_feature (33)..(46): Xaa can be any naturally occurring amino acid
  misc_feature (54)..(54): Xaa can be any naturally occurring amino acid
  misc_feature (79)..(87): Xaa can be any naturally occurring amino acid
  misc_feature (114)..(114): Xaa can be any naturally occurring amino acid
  misc_feature (159)..(167): Xaa can be any naturally occurring amino acid
  misc_feature (171)..(177): Xaa can be any naturally occurring amino acid
  misc_feature (188)..(195): Xaa can be any naturally occurring amino acid
  misc_feature (216)..(216): Xaa can be any naturally occurring amino acid
  misc_feature (228)..(228): Xaa can be any naturally occurring amino acid
  misc_feature (251)..(251): Xaa can be any naturally occurring amino acid
  misc_feature (268)..(268): Xaa can be any naturally occurring amino acid
  misc_feature (271)..(278): Xaa can be any naturally occurring amino acid
  misc_feature (304)..(310): Xaa can be any naturally occurring amino acid
  misc_feature (320)..(320): Xaa can be any naturally occurring amino acid
IIIGGFGNXLVPLIIGAPDIAFPRINNIRFXLXXXXXXXXXXXXXXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVXTRAYFTSATIIIAVPTGIKVFRXLATYHGTTITYSPVTLXALXXXXXXXXGGLTGVVLANSSIDIVLHDTYYVVAXXXXXXXIGAVFAIIAXFIQ

SEQ ID NO: 34799 - protein, 195 aa, Diabrotica virgifera
  misc_feature: Coding regions on vcDNA: vcDNA=SeqID_14496; Strand=+; Position=1-585
  misc_feature: Homolog annotation: Hit_ID=NP_033436.1; Match level="QueryCoverage =100%, HitCoverage=19%, E-value=4e-70, Identity=66%"; Hit description= topoisomerase (DNA) III alpha [Mus musculus] emb|CAI35266.1| topoisomerase (DNA) III alpha [Mus
  misc_feature: Gene Ontology Annotation: Molecular function=electron transporter activity; Cellular component=nucleus; Biological process=electron transport
  misc_feature: Pfam annotation: Pfam_ID=Topoisom_bac; Match level="Score=-126.7, E -value=3.9e-06, Copies=1"; Pfam description=DNA topoisomerase
  misc_feature (182)..(182): Xaa can be any naturally occurring amino acid
VDVRQELDLRTGAAFTRLQTLRLQKVFPQKLADKLISYGSCQFPTLGFVVERYQAIEDFIAEPFWRIKMSRTVGDITSDFNWKRDRLFDKNACEAILDICKENPVATVENVEGKEKSKWRPLPLDTVEMEKNVSRKLKINAKDTMQIAERLYTQGFISYPRTETNIFPKELNLGSLVQQQLXDNRWGTFAQRIID

SEQ ID NO: 34800 - protein, 215 aa, Diabrotica virgifera
  misc_feature: Coding regions on vcDNA: vcDNA=SeqID_14497; Strand=+; Position=21-668
  misc_feature: Homolog annotation: Hit_ID=BAC98835.1; Match level="QueryCoverage =81%, HitCoverage=64%, E-value=3e-16, Identity=27%"; Hit description =juvenile hormone acid methyltransferase [Bombyx mori]
MIPELWLVGNIVTVRLTRIHLDKYKHLLQWKKSESILEFGCGDGQVSEKLLLPVLPKDYKEYVAMDNSKEMLDHYKQHVNIPRLQAVHRDISTKPLETCWRSRFDHVFELFVMHMVQNPRSAIENIQSMLKPGGQAFLTFFERMPVHKTFEALEKHPKWGKYGTFLSNYNTNSNPKLEYESDLKAAGFKNYVIHAEEPVGCTFDDEESYKSKCVL

SEQ ID NO: 34801 - protein, 67 aa, Diabrotica virgifera
  misc_feature: Coding regions on vcDNA: vcDNA=SeqID_14498; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
VPFXXXXXXXXXXXTNLAHTGLNXXXXXXXXSNXXXXXXXXXXXXXXPTSRSXXXXXXXXXXXXXXV

SEQ ID NO: 34802 - protein, 152 aa, Diabrotica virgifera
  misc_feature: Coding regions on vcDNA: vcDNA=SeqID_14499; Strand=-; Position=0-455
  misc_feature (4)..(24): Xaa can be any naturally occurring amino acid
  misc_feature (29)..(68): Xaa can be any naturally occurring amino acid
  misc_feature (80)..(88): Xaa can be any naturally occurring amino acid
  misc_feature (91)..(98): Xaa can be any naturally occurring amino acid
  misc_feature (109)..(150): Xaa can be any naturally occurring amino acid
SPHXXXXXXXXXXXXXXXXXXXXXLYRVXXXXXXXXXXXXXXXXXXXXXXXXXXXXXXXXXXXXXXXXDYNAIARSKYPXXXXXXXXXRDXXXXXXXXVFNHQVKKMFXXXXXXXXXXXXXXXXXXXXXXXXXXXXXXXXXXXXXXXXXXYS

SEQ ID NO: 34803 - protein, 192 aa, Diabrotica virgifera
  misc_feature: Coding regions on vcDNA: vcDNA=SeqID_14500; Strand=+; Position=147-725
  misc_feature: Homolog annotation: Hit_ID=XP_311545.1; Match level="QueryCoverage =99%, HitCoverage=87%, E-value=9e-37, Identity=41%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=50.5, E-value=4.9e- 12, Copies=1"; Pfam description=Glutathione S-transferase, N-terminal
  misc_feature (115)..(124): Xaa can be any naturally occurring amino acid
MPTYKVRYFDIAGRGEPIRMMLSYGQIPFIDERISNEDWSKIKPTTPLGQVPVLEIDGKQIPHCIPICRYLASIVNLSGSDATENLAIDVAVETLVDLGNLAYEAKRETDVAKKXXXXXXXXXXLSLFLGKLEEYAQKHGGYIALPRLSWADIVFTCSYEALMNRTGVDSFNSYPSLQKVKNNVLAQPGIKE

SEQ ID NO: 34804 - protein, 313 aa, Diabrotica virgifera
  misc_feature: Coding regions on vcDNA: vcDNA=SeqID_14501; Strand=+; Position=2-940
  misc_feature: Homolog annotation: Hit_ID=AAF87760.1; Match level="QueryCoverage =99%, HitCoverage=70%, E-value=1e-115, Identity=70%"; Hit description= cytochrome oxidase subunit I [Diabrotica virgifera zeae]
  misc_feature: Pfam annotation: Pfam_ID=COX1; Match level="Score=41.1, E-value=1.3e -12, Copies=1"; Pfam description=Cytochrome C and Quinol oxidase polyp
  misc_feature (29)..(37): Xaa can be any naturally occurring amino acid
  misc_feature (41)..(47): Xaa can be any naturally occurring amino acid
  misc_feature (58)..(65): Xaa can be any naturally occurring amino acid
  misc_feature (86)..(86): Xaa can be any naturally occurring amino acid
  misc_feature (121)..(121): Xaa can be any naturally occurring amino acid
  misc_feature (138)..(138): Xaa can be any naturally occurring amino acid
  misc_feature (141)..(147): Xaa can be any naturally occurring amino acid
  misc_feature (194)..(194): Xaa can be any naturally occurring amino acid
  misc_feature (202)..(218): Xaa can be any naturally occurring amino acid
  misc_feature (248)..(248): Xaa can be any naturally occurring amino acid
  misc_feature (262)..(262): Xaa can be any naturally occurring amino acid
  misc_feature (264)..(271): Xaa can be any naturally occurring amino acid
  misc_feature (287)..(287): Xaa can be any naturally occurring amino acid
  misc_feature (290)..(290): Xaa can be any naturally occurring amino acid
  misc_feature (292)..(292): Xaa can be any naturally occurring amino acid
AGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAYFHYVLSIGAVFAIIAGFIQXFPLFTGIXXXXXXXXXXXXXXXXXVNLTFFPQHFLGLIGIPRRYSDYPDVFILXNIVSSIGSLISLIXVXXXXXXXXEAFSFSRKRLRPLRIXSSXDXLQFNPSAEHRYSEFAILSSNK

SEQ ID NO: 34805 - protein, 90 aa, Diabrotica virgifera
  misc_feature: Coding regions on vcDNA: vcDNA=SeqID_14502; Strand=+; Position=2-271
  misc_feature (14)..(19): Xaa can be any naturally occurring amino acid
PRVRLLNYFLRELXXXXXXHNRNKLIQHEFSLFLTVQTTVFQTLQNNGIRSAPETLEKKQARGYAATKGTKDRTRKGKVKVENQKVGLIP

SEQ ID NO: 34806 - protein, 129 aa, Diabrotica virgifera
  misc_feature: Coding regions on vcDNA: vcDNA=SeqID_14503; Strand=+; Position=2-391
  misc_feature (1)..(28): Xaa can be any naturally occurring amino acid
  misc_feature (30)..(68): Xaa can be any naturally occurring amino acid
  misc_feature (71)..(78): Xaa can be any naturally occurring amino acid
  misc_feature (82)..(90): Xaa can be any naturally occurring amino acid
  misc_feature (93)..(104): Xaa can be any naturally occurring amino acid
XXXXXXXXXXXXXXXXXXXXXXXXXXXXFXXXXXXXXXXXXXXXXXXXXXXXXXXXXXXXXXXXXXXXSLXXXXXXXXMRIXXXXXXXXXIIXXXXXXXXXXXXFVLKYEFKLFKCSNDENIRIKKLCI

SEQ ID NO: 34807 - protein, 42 aa, Diabrotica virgifera
  misc_feature: Coding regions on vcDNA: vcDNA=SeqID_14504; Strand=+; Position=1-129
  misc_feature (5)..(29): Xaa can be any naturally occurring amino acid
  misc_feature (32)..(32): Xaa can be any naturally occurring amino acid
VKKLXXXXXXXXXXXXXXXXXXXXXXXXXFIXIIYLLAVITK

SEQ ID NO: 34808 - protein, 69 aa, Diabrotica virgifera
  misc_feature: Coding regions on vcDNA: vcDNA=SeqID_14505; Strand=+; Position=80-289
LAYSTISLPPPICCVTCLLHELSPDALEAYHSYLIHRKLLPMVLSKMTGSTLEILCSMMPALHIPMTST

SEQ ID NO: 34809 - protein, 199 aa, Diabrotica virgifera
  misc_feature: Coding regions on vcDNA: vcDNA=SeqID_14506; Strand=-; Position=0-596
  misc_feature (7)..(19): Xaa can be any naturally occurring amino acid
  misc_feature (23)..(168): Xaa can be any naturally occurring amino acid
  misc_feature (171)..(171): Xaa can be any naturally occurring amino acid
  misc_feature (176)..(176): Xaa can be any naturally occurring amino acid
  misc_feature (182)..(182): Xaa can be any naturally occurring amino acid
  misc_feature (190)..(191): Xaa can be any naturally occurring amino acid
  misc_feature (193)..(194): Xaa can be any naturally occurring amino acid
PYIFLLXXXXXXXXXXXXXKFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIXYPLFXFFFPFXIKRFVLLXXMXXGRVKG

SEQ ID NO: 34810 - protein, 66 aa, Diabrotica virgifera
  misc_feature: Coding regions on vcDNA: vcDNA=SeqID_14507; Strand=-; Position=1-198
  misc_feature (3)..(9): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
SFXXXXXXXIKIETNLAHTGLNXXXXXXXXRTXXXXXXXXXXXXXIQHRGRXXXXXXXXXXXXXLL

SEQ ID NO: 34811 - protein, 160 aa, Diabrotica virgifera
  misc_feature: Coding regions on vcDNA: vcDNA=SeqID_14508; Strand=-; Position=95-577
  misc_feature (27)..(33): Xaa can be any naturally occurring amino acid
  misc_feature (91)..(97): Xaa can be any naturally occurring amino acid
KNMNERGILVGHYAHCQFSKYTLLRLXXXXXXXILIDTLAIMYISHRGMRRRFRPRDVILQDNYCSQSSTPSFSSCMYSTGTGCLTCYKAXXXXXXXAVISFSYLALSSSSKSSYFPLVCYSPSALLLLNSLVSSITPYSGCSSFNFLRAHHEIYHNLSR

SEQ ID NO: 34812 - protein, 154 aa, Diabrotica virgifera
  misc_feature: Coding regions on vcDNA: vcDNA=SeqID_14509; Strand=+; Position=3-467
  misc_feature (122)..(126): Xaa can be any naturally occurring amino acid
LFEDFWNIGDLTKQRYYIKTCMGVVKPKYSLHNANSTRSLNVSYHFTIHAEKIRVCKRFYTATLDIGHSFLSTVNKLSNSSGIIPEDRRGHHGNTGRCLSDDVKDIVREHINSYPRKESHYXXXXXSKEYLDGDLNLALMYRQYKEWCHQSVPK

SEQ ID NO: 34813 - protein, 29 aa, Diabrotica virgifera
  misc_feature: Coding regions on vcDNA: vcDNA=SeqID_14510; Strand=-; Position=1-90
EGHTKGYIFIDRVEFIYYCSKLHKYFDND

SEQ ID NO: 34814 - protein, 64 aa, Diabrotica virgifera
  misc_feature: Coding regions on vcDNA: vcDNA=SeqID_14511; Strand=-; Position=1-192
  misc_feature (12)..(62): Xaa can be any naturally occurring amino acid
LRYYFYIKKNGXXXXXXXXXXXXXXXXXXXXXXXXXXXXXXXXXXXXXXXXXXXXXXXXXXXKL

SEQ ID NO: 34815 - protein, 45 aa, Diabrotica virgifera
  misc_feature: Coding regions on vcDNA: vcDNA=SeqID_14512; Strand=-; Position=1-135
  misc_feature (4)..(4): Xaa can be any naturally occurring amino acid
  misc_feature (9)..(36): Xaa can be any naturally occurring amino acid
  misc_feature (39)..(45): Xaa can be any naturally occurring amino acid
HPPXHSSLXXXXXXXXXXXXXXXXXXXXXXXXXXXXYMXXXXXXX

SEQ ID NO: 34816 - protein, 103 aa, Diabrotica virgifera
  misc_feature: Coding regions on vcDNA: vcDNA=SeqID_14513; Strand=-; Position=509-820
VSNPQLVGSGKPKKKKRSNNGKFSLFSSITKKLSILNKFESRKLIDRIKNFNMAFADYVYPYWLLGELRIIHGFWVYIGIHDLCRNWLRTFLLHGMLRLLVLK

SEQ ID NO: 34817 - protein, 167 aa, Diabrotica virgifera
  misc_feature: Coding regions on vcDNA: vcDNA=SeqID_14514; Strand=+; Position=96-596
LLNYTGFTLASLLTFIVTREVVPGGGPLGRAPPFTPPFLGFRHGEGNPDHTFLPSWVAGLPKMPPDLVTGSALGSAPSPKISPPTFPPTFSKTWRIHSPKGPASGALTCALTWALTPVTTPGFSNPPGSPPASPRSSPATPWVSNCPESWPALCLAPALTPPLAKPF

SEQ ID NO: 34818 - protein, 299 aa, Diabrotica virgifera
  misc_feature: Coding regions on vcDNA: vcDNA=SeqID_14515; Strand=-; Position=2-898
  misc_feature (4)..(24): Xaa can be any naturally occurring amino acid
  misc_feature (27)..(27): Xaa can be any naturally occurring amino acid
  misc_feature (33)..(297): Xaa can be any naturally occurring amino acid
YINXXXXXXXXXXXXXXXXXXXXXVKXLKLGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTS

SEQ ID NO: 34819 - protein, 313 aa, Diabrotica virgifera
  misc_feature: Coding regions on vcDNA: vcDNA=SeqID_14516; Strand=+; Position=43-981
  misc_feature: Homolog annotation: Hit_ID=XP_396504.1; Match level="QueryCoverage =97%, HitCoverage=92%, E-value=1e-139, Identity=75%"; Hit description= similar to ENSANGP00000003345 [Apis mellifera]
  misc_feature: Gene Ontology Annotation: Molecular function=receptor binding; Cellular component=cytosol; Biological process=negative regulation of TGFbeta receptor signaling pathway
  misc_feature: Pfam annotation: Pfam_ID=WD40; Match level="Score=143.9, E-value=3.7e- 40, Copies=6"; Pfam description=WD domain, G-beta repeat
  misc_feature (277)..(277): Xaa can be any naturally occurring amino acid
  misc_feature (281)..(281): Xaa can be any naturally occurring amino acid
  misc_feature (297)..(297): Xaa can be any naturally occurring amino acid
MKVNMANLRQTPLTCSGHTRPVVHLDFSEVTDSGYYLISACKDGKPMLRQGDTGDWIGTFEGHKGAVWGVALNSEATRAASGAADFTGKVWDAISGEELHSFQHNHIVKSVDFSRDSSCMVTGSNEKLVRIFDLNKPEASPEVFSGHTAGIRHVQFFRNDTHLISCADDKTLRVWNRGTGTEVQKVDFSSTPNSLEVSKDGSVLTVSYSNRVIFLDAETLTKIREFSIPSTVNSASLHPDKSIFVAGGDDLKVYKFDYTTGTEIESFKGHFGPVHCXKFSXRWRVYASGSEDGTLRXWQTTGGKTYGLWEMRD

SEQ ID NO: 34820 - protein, 79 aa, Diabrotica virgifera
  misc_feature: Coding regions on vcDNA: vcDNA=SeqID_14517; Strand=+; Position=106-345
QLQLHLGMALDLPYSSFAYSFLSLCIIHYRGLSLFYHQCLIHCYYLHIPHLKIHQYVIFIVLIFLGHQISFFILYLCNN

SEQ ID NO: 34821 - protein, 250 aa, Diabrotica virgifera
  misc_feature: Coding regions on vcDNA: vcDNA=SeqID_14518; Strand=+; Position=3-755
  misc_feature: Homolog annotation: Hit_ID=XP_317284.1; Match level="QueryCoverage =98%, HitCoverage=50%, E-value=1e-107, Identity=70%"; Hit description= ENSANGP00000021851 [Anopheles gambiae]
  misc_feature: Gene Ontology Annotation: Molecular function=serine-type endopeptidase activity; Cellular component=brush border; Biological process=cytoskeleton organization and biogenesis
  misc_feature: Pfam annotation: Pfam_ID=Trypsin; Match level="Score=259.2, E-value =7.2e-75, Copies=1"; Pfam description=Trypsin
  misc_feature (228)..(235): Xaa can be any naturally occurring amino acid
VGACGAKNGYQDQKRIVGGHNAEVNEWPWIAALFNGGKQFCGGSLIDNNHILSAAHCVAHMSSWDVARLTVRLGDHNIKSNSETRHIEKRVKRVVRHRGFDSRTLYNDIAILTLDSPVDFNQQIRSVCLPTSSTDPTGKTGTVIGWGSLRESGPQPAVLQEVNIPIWNNLNCKSKYGPAAPGGIVEHMLCAGEANRDSCSGDSGGPLMINDGKWVQVGIVSWGIGCGXXXXXXXXTRVEKFLPWIQKNLK

SEQ ID NO: 34822 - protein, 135 aa, Diabrotica virgifera
  misc_feature: Coding regions on vcDNA: vcDNA=SeqID_14519; Strand=+; Position=92-499
  misc_feature: Pfam annotation: Pfam_ID=zf-CCHC; Match level="Score=30.9, E-value =3.9e-06, Copies=1"; Pfam description=Zinc knuckle
  misc_feature (14)..(44): Xaa can be any naturally occurring amino acid
IVVIVPVSPMTFLXXXXXXXXXXXXXXXXXXXXXXXXXXXXXXXFTLVFDNTIYRIFISQDSLVCFRCKKPGHIASQCSETLAQLNPNQVNEASVSSATNISLQAPNDTNPSQCEQMSISNVLATKYMHQIRTVP

SEQ ID NO: 34823 - protein, 184 aa, Diabrotica virgifera
  misc_feature: Coding regions on vcDNA: vcDNA=SeqID_14520; Strand=+; Position=124-678
  misc_feature: Homolog annotation: Hit_ID=XP_393613.1; Match level="QueryCoverage =100%, HitCoverage=99%, E-value=3e-46, Identity=46%"; Hit description= similar to ENSANGP00000010049 [Apis mellifera]
  misc_feature: Gene Ontology Annotation: Molecular function=protein binding; Biological process=glutamate transport
  misc_feature: Pfam annotation: Pfam_ID=PRA1; Match level="Score=125.1, E-value=1.7e- 34, Copies=1"; Pfam description=PRA1 family protein
MHKKQASSDSLEIAPLRTLDDFLLEAARFQIPNVKDLEKWGNRVTQNLLYYQTNYFLMSILIFIIVGVIHPIKMACGVLATAVLFMIFLYVTNEKVTAAQFKRKHPIISLIIVFAGAYFIAYMLQSLMVFLLGVLLPVAAIFVHASLRLRNLKNKIVNKVENLGLRTTPMGFFLEEMGLESDLF

SEQ ID NO: 34824 - protein, 62 aa, Diabrotica virgifera
  misc_feature: Coding regions on vcDNA: vcDNA=SeqID_14521; Strand=-; Position=1-186
  misc_feature (4)..(62): Xaa can be any naturally occurring amino acid
KKLXXXXXXXXXXXXXXXXXXXXXXXXXXXXXXXXXXXXXXXXXXXXXXXXXXXXXXXXXXX

SEQ ID NO: 34825 - protein, 64 aa, Diabrotica virgifera
  misc_feature: Coding regions on vcDNA: vcDNA=SeqID_14522; Strand=-; Position=2-193
GVPRNPCISSPSKVCLIHPLQFSLRRSTQLIGAFQWFVLHLHYLLPCEQNSSHLLDQNDSHSPY

SEQ ID NO: 34826 - protein, 62 aa, Diabrotica virgifera
  misc_feature: Coding regions on vcDNA: vcDNA=SeqID_14523; Strand=-; Position=0-185
  misc_feature (1)..(59): Xaa can be any naturally occurring amino acid
XXXXXXXXXXXXXXXXXXXXXXXXXXXXXXXXXXXXXXXXXXXXXXXXXXXXXXXXXXXLFT

SEQ ID NO: 34827 - protein, 93 aa, Diabrotica virgifera
  misc_feature: Coding regions on vcDNA: vcDNA=SeqID_14524; Strand=+; Position=424-705
  misc_feature (25)..(35): Xaa can be any naturally occurring amino acid
  misc_feature (39)..(45): Xaa can be any naturally occurring amino acid
YLSKTYRMTPNTTLHLHPRGIRRYXXXXXXXXXXXHLSXXXXXXXDRWRYNRKTTVYWRHLSTVLKNVSNKCCLLFHGESNSAIKNGCSYLRL

SEQ ID NO: 34828 - protein, 171 aa, Diabrotica virgifera
  misc_feature: Coding regions on vcDNA: vcDNA=SeqID_14525; Strand=+; Position=323-835
  misc_feature: Homolog annotation: Hit_ID=XP_394679.1; Match level="QueryCoverage =84%, HitCoverage=28%, E-value=4e-29, Identity=47%"; Hit description =similar to Orexin receptor type 2 (Ox2r) (Hypocretin receptor type 2) [Apis mellifera]
  misc_feature: Gene Ontology Annotation: Molecular function=neuropeptide receptor activity; Cellular component=integral to plasma membrane; Biological process=feeding behavior
  misc_feature: Pfam annotation: Pfam_ID=7tm_1; Match level="Score=-39.6, E-value =2.7e-05, Copies=1"; Pfam description=7 transmembrane receptor (rhodopsin f
LEQKIWDFFAIKNFVVIGLYIPVLLVAATANLLFIAIVIKHRYMRRASTYLLINLSIADLLITLFAMPNAMWSAYTPLYSLGKVGCKLLTYIQCVSVSTSILTITAMSLHRYFAITKPLFGLIYPSFNRCSTAIVIIFLWILSMAIFSPLLWVNQLEEDVLPMPGNAITVY

SEQ ID NO: 34829 - protein, 80 aa, Diabrotica virgifera
  misc_feature: Coding regions on vcDNA: vcDNA=SeqID_14526; Strand=+; Position=77-319
  misc_feature (5)..(10): Xaa can be any naturally occurring amino acid
SSISXXXXXXTTSGDSSSSESHKLLSISCSSAADNGFRDILFALSTFTVIQYNFTGLVVVDTDIGIKRLVADALFISKYV

SEQ ID NO: 34830 - protein, 38 aa, Diabrotica virgifera
  misc_feature: Coding regions on vcDNA: vcDNA=SeqID_14527; Strand=+; Position=1-114
  misc_feature (5)..(15): Xaa can be any naturally occurring amino acid
  misc_feature (18)..(24): Xaa can be any naturally occurring amino acid
HIFLXXXXXXXXXXXLSXXXXXXXLIYHINSFTRGDYK

SEQ ID NO: 34831 - protein, 237 aa, Diabrotica virgifera
  misc_feature: Coding regions on vcDNA: vcDNA=SeqID_14528; Strand=+; Position=1-711
  misc_feature (93)..(99): Xaa can be any naturally occurring amino acid
HYLLERLYLNYETKENDEKTKSNYQSNIVFASSHFKAQNRVLQLKHSFENKYIPKEKSNSDKSRETKLPNKSMSNKFDKLNGTNNIFESQVEXXXXXXXVMYGANKVSKPKEYEEKGRNQENELASRIQKFFGKTSSNIDTESYSDTEIPSNNVIPHEEHEKIQESELASRIQTFFGKNSSNADKDTYSDIEVSSNNVTPHEENQQNHENELASRIQKFFGKTSSTIKETYSDIEIP

SEQ ID NO: 34832 - protein, 33 aa, Diabrotica virgifera
  misc_feature: Coding regions on vcDNA: vcDNA=SeqID_14529; Strand=-; Position=0-98
  misc_feature (2)..(12): Xaa can be any naturally occurring amino acid
  misc_feature (22)..(30): Xaa can be any naturally occurring amino acid
FXXXXXXXXXXXNQPGSHRFKXXXXXXXXXEQT

SEQ ID NO: 34833 - protein, 80 aa, Diabrotica virgifera
  misc_feature: Coding regions on vcDNA: vcDNA=SeqID_14530; Strand=-; Position=2-241
  misc_feature (24)..(80): Xaa can be any naturally occurring amino acid
KKIFPLVPALRVNFISYKPKKIVXXXXXXXXXXXXXXXXXXXXXXXXXXXXXXXXXXXXXXXXXXXXXXXXXXXXXXXXX

SEQ ID NO: 34834 - protein, 55 aa, Diabrotica virgifera
  misc_feature: Coding regions on vcDNA: vcDNA=SeqID_14531; Strand=-; Position=93-260
FEAYNFSSCSKRFAVSFFHIKFIYISIFQFPLIIYIFLIIIHRPHLCPEKVLGIL

SEQ ID NO: 34835 - protein, 66 aa, Diabrotica virgifera
  misc_feature: Coding regions on vcDNA: vcDNA=SeqID_14532; Strand=+; Position=577-777
  misc_feature (44)..(45): Xaa can be any naturally occurring amino acid
LGGQPVRISKGSDYPKVSLISNSKLSLSLILSRKSFSLDSGQYXXDSVDYEIIEVSLCLTFISKSG

SEQ ID NO: 34836 - protein, 94 aa, Diabrotica virgifera
  misc_feature: Coding regions on vcDNA: vcDNA=SeqID_14533; Strand=+; Position=2-286
  misc_feature: Homolog annotation: Hit_ID=XP_393213.1; Match level="QueryCoverage =80%, HitCoverage=6%, E-value=5e-26, Identity=69%"; Hit description =similar to ENSANGP00000014350 [Apis mellifera]
  misc_feature: Gene Ontology Annotation: Molecular function=cysteine-type endopeptidase activity; Cellular component=cytoskeleton; Biological process=proteolysis and peptidolysis
  misc_feature: Pfam annotation: Pfam_ID=Y_phosphatase; Match level="Score=-30.8, E -value=5.2e-05, Copies=1"; Pfam description=Protein-tyrosine phosphatase
TAAANGNTNGPPKLEVNPVVVHCSPGTGRTGVVIACDIAIREFEQTRLVDIPKIVYRIRRDRASAVQTKEQYTFIYRVVSLYATKLTGGALESL

SEQ ID NO: 34837 - protein, 73 aa, Diabrotica virgifera
  misc_feature: Coding regions on vcDNA: vcDNA=SeqID_14534; Strand=-; Position=119-340
  misc_feature (24)..(31): Xaa can be any naturally occurring amino acid
QNLPREKPGNYFHNCKSTSRGRNXXXXXXXXKFHKICPMKGHRKSDHRTLHKILRIFHFTSSSLPVQIRGGSE

SEQ ID NO: 34838 - protein, 77 aa, Diabrotica virgifera
  misc_feature: Coding regions on vcDNA: vcDNA=SeqID_14535; Strand=-; Position=2-232
  misc_feature (9)..(9): Xaa can be any naturally occurring amino acid
  misc_feature (13)..(13): Xaa can be any naturally occurring amino acid
  misc_feature (15)..(15): Xaa can be any naturally occurring amino acid
  misc_feature (20)..(77): Xaa can be any naturally occurring amino acid
YFLITAIKXIIYXNXFDTKXXXXXXXXXXXXXXXXXXXXXXXXXXXXXXXXXXXXXXXXXXXXXXXXXXXXXXXXXX

SEQ ID NO: 34839 - protein, 191 aa, Diabrotica virgifera
  misc_feature: Coding regions on vcDNA: vcDNA=SeqID_14536; Strand=-; Position=42-617
  misc_feature: Homolog annotation: Hit_ID=XP_393034.1; Match level="QueryCoverage =100%, HitCoverage=71%, E-value=2e-53, Identity=60%"; Hit description= similar to 60S ribosomal protein L7a (Surfeit locus protein 3) (PLA-X polypeptide) [Apis
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L7Ae; Match level="Score=26.6, E -value=7.5e-05, Copies=1"; Pfam description=Ribosomal protein L7Ae/L30e/S12e/Gadd
VPPPINQFFQTLGKQTAPQFFKVLEKSRPGPPLQKKNRLKGKAEAKVSKKGGAPAKKPNPLKGGAHPVFKRVGQKKAPLVVFAPEVGPIGLVLFLPPLCGKKGVPFSIVKGKARLGLFVRGKTCSFVAFSQVGFGGRAHFHKLLGGIKTNFHARVEEIRGPGGGGFLGSKFSARFFKLGGAQGKELAPKQG

SEQ ID NO: 34840 - protein, 308 aa, Diabrotica virgifera
  misc_feature: Coding regions on vcDNA: vcDNA=SeqID_14537; Strand=-; Position=1-924
  misc_feature (4)..(308): Xaa can be any naturally occurring amino acid
ITAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34841 - protein, 127 aa, Diabrotica virgifera
  misc_feature: Coding regions on vcDNA: vcDNA=SeqID_14538; Strand=+; Position=335-720
  misc_feature: Homolog annotation: Hit_ID=AAN61295.1; Match level="QueryCoverage =92%, HitCoverage=72%, E-value=1e-25, Identity=50%"; Hit description =cytochrome oxidase subunit III [Cicindela trifasciata]
  misc_feature: Pfam annotation: Pfam_ID=COX3; Match level="Score=-139.5, E-value =9.2e-08, Copies=1"; Pfam description=Cytochrome c oxidase subunit III
  misc_feature (34)..(34): Xaa can be any naturally occurring amino acid
  misc_feature (41)..(41): Xaa can be any naturally occurring amino acid
  misc_feature (58)..(58): Xaa can be any naturally occurring amino acid
  misc_feature (85)..(85): Xaa can be any naturally occurring amino acid
  misc_feature (106)..(106): Xaa can be any naturally occurring amino acid
EYFNLLKKFTAFNPLELPLLNTLLLLTSESTVPXAHHTLIXNSFSRGLQGLFFTDTLXFIVLFDEDMTILDHLYAISDSIYAIFXFIATGLHVLHVIIDTTFLLLXLILHYLHHLSSTHQLRYEATS

SEQ ID NO: 34842 - protein, 270 aa, Diabrotica virgifera
  misc_feature: Coding regions on vcDNA: vcDNA=SeqID_14539; Strand=+; Position=29-838
  misc_feature: Homolog annotation: Hit_ID=BAB32477.1; Match level="QueryCoverage =100%, HitCoverage=99%, E-value=3e-23, Identity=35%"; Hit description= cuticle protein [Bombyx mori]
  misc_feature: Pfam annotation: Pfam_ID=Chitin_bind_4; Match level="Score=27.9, E -value=2.6e-05, Copies=1"; Pfam description=Insect cuticle protein
  misc_feature (84)..(90): Xaa can be any naturally occurring amino acid
  misc_feature (196)..(201): Xaa can be any naturally occurring amino acid
  misc_feature (236)..(240): Xaa can be any naturally occurring amino acid
  misc_feature (243)..(244): Xaa can be any naturally occurring amino acid
  misc_feature (247)..(247): Xaa can be any naturally occurring amino acid
MVFKVVTLTLLVACAQAIRYDGHAATSSIVFNDNHNSVQHIQSAHPAPSHGYAAPIAHYSAPSPVSHYAAPVPVAQYAAPAPVXXXXXXXIKVAAPVLLKSSGPSHGASSYSSLSFGSDNGYYNQHSAPVAHYAAPAAKIAAPLLIKAPAKVAVAPVAYAQVAPAYNHGGYSHGGYSHHEEEYAHPKYEFAYGVEXXXXXXIHSHKEVRDGDVTHGEYSLHEADGTVRTVKYSVDXXXXXNAXXERXWHANHAHPTKSFLSCCPSPSYYH

SEQ ID NO: 34843 - protein, 89 aa, Diabrotica virgifera
  misc_feature: Coding regions on vcDNA: vcDNA=SeqID_14540; Strand=-; Position=47-316
VQFHTWHSVIVAGMEISNWYFIVVRSFILVFRFLGHIISYSGAQISSFRGERYMYVFHVNGTVPISGYYDMTSFILKNFSLPHFERARG

SEQ ID NO: 34844 - protein, 18 aa, Diabrotica virgifera
  misc_feature: Coding regions on vcDNA: vcDNA=SeqID_14541; Strand=-; Position=2-55
  misc_feature (1)..(16): Xaa can be any naturally occurring amino acid
XXXXXXXXXXXXXXXXLI

SEQ ID NO: 34845 - protein, 92 aa, Diabrotica virgifera
  misc_feature: Coding regions on vcDNA: vcDNA=SeqID_14542; Strand=+; Position=24-302
MTLTIKLVAIFAFAAAATGSPLTTFGKRTPVLPTPSKEPDSYQPFQTQLPMELELPKEEANPVPFYAPEPSTDLKAPQESQEPDYYQAQQTI

SEQ ID NO: 34846 - protein, 130 aa, Diabrotica virgifera
  misc_feature: Coding regions on vcDNA: vcDNA=SeqID_14543; Strand=+; Position=190-574
  misc_feature: Homolog annotation: Hit_ID=XP_395683.1; Match level="QueryCoverage =100%, HitCoverage=34%, E-value=3e-19, Identity=44%"; Hit description= similar to CG10576-PA [Apis mellifera]
  misc_feature (18)..(18): Xaa can be any naturally occurring amino acid
  misc_feature (42)..(42): Xaa can be any naturally occurring amino acid
  misc_feature (51)..(51): Xaa can be any naturally occurring amino acid
  misc_feature (91)..(91): Xaa can be any naturally occurring amino acid
  misc_feature (102)..(102): Xaa can be any naturally occurring amino acid
KELKKGIAFPTSVSENPXICSLSPDAMESDLVISQQNESMTXLDISDICDXYHILAHTIKCKASTNKPVTGLSLHVILTEPYASPCALKMXLPESETYAITXELNPKPHESYNYQPLESMLSHMLKHCNI

SEQ ID NO: 34847 - protein, 66 aa, Diabrotica virgifera; identical to SEQ ID NO: 26808
  misc_feature: Coding regions on vcDNA: vcDNA=SeqID_14544; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34848 - protein, 78 aa, Diabrotica virgifera
  misc_feature: Coding regions on vcDNA: vcDNA=SeqID_14545; Strand=-; Position=2-235
  misc_feature (3)..(13): Xaa can be any naturally occurring amino acid
  misc_feature (15)..(26): Xaa can be any naturally occurring amino acid
  misc_feature (28)..(28): Xaa can be any naturally occurring amino acid
  misc_feature (34)..(42): Xaa can be any naturally occurring amino acid
  misc_feature (45)..(52): Xaa can be any naturally occurring amino acid
  misc_feature (57)..(57): Xaa can be any naturally occurring amino acid
  misc_feature (64)..(77): Xaa can be any naturally occurring amino acid
ILXXXXXXXXXXXLXXXXXXXXXXXXPXWLTPVXXXXXXXXXSNXXXXXXXXPIINXNPTSRSXXXXXXXXXXXXXXV

SEQ ID NO: 34849 - protein, 304 aa, Diabrotica virgifera
  misc_feature: Coding regions on vcDNA: vcDNA=SeqID_14546; Strand=-; Position=39-953
  misc_feature (4)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
  misc_feature (80)..(256): Xaa can be any naturally occurring amino acid
  misc_feature (276)..(281): Xaa can be any naturally occurring amino acid
NIIXXXXXXXXXXSFXXXXXXXXXXXNQPGSHGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKEESLSVSGRYFYPGLNGXXXXXXYVADKDGYRASGPHLPQPVQALH

SEQ ID NO: 34850 - protein, 131 aa, Diabrotica virgifera
  misc_feature: Coding regions on vcDNA: vcDNA=SeqID_14547; Strand=-; Position=2-393
  misc_feature: Homolog annotation: Hit_ID=XP_309915.1; Match level="QueryCoverage =99%, HitCoverage=26%, E-value=1e-18, Identity=40%"; Hit description =ENSANGP00000015117 [Anopheles gambiae]
  misc_feature (25)..(25): Xaa can be any naturally occurring amino acid
KSILFNIYIDVREFKYLGTTITDNXDNNGSQEIINRIQAGIRCLFALKNLIKPKQLTRRTKIQVYKTTIRPVVMYGSETWTMTKPNEERLRVWERKILRKGKSFGSVLDEASGQYRIRTNKELEELYPDAN

SEQ ID NO: 34851 - protein, 61 aa, Diabrotica virgifera
  misc_feature: Coding regions on vcDNA: vcDNA=SeqID_14548; Strand=-; Position=633-818
MASCQICFSVTNLTSNKHSNIILLYLYHVKNKFDFSIKLPIIYVNNIYMTTTRIKCSGKTS

SEQ ID NO: 34852 - protein, 277 aa, Diabrotica virgifera
  misc_feature: Coding regions on vcDNA: vcDNA=SeqID_14549; Strand=+; Position=3-836
  misc_feature (2)..(233): Xaa can be any naturally occurring amino acid
  misc_feature (235)..(248): Xaa can be any naturally occurring amino acid
  misc_feature (259)..(266): Xaa can be any naturally occurring amino acid
HXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIKVIIXXXXXXXXCSTFKILLDLS

SEQ ID NO: 34853 - protein, 67 aa, Diabrotica virgifera
  misc_feature: Coding regions on vcDNA: vcDNA=SeqID_14550; Strand=-; Position=2-202
  misc_feature (3)..(10): Xaa can be any naturally occurring amino acid
  misc_feature (12)..(12): Xaa can be any naturally occurring amino acid
  misc_feature (17)..(45): Xaa can be any naturally occurring amino acid
  misc_feature (48)..(48): Xaa can be any naturally occurring amino acid
  misc_feature (56)..(67): Xaa can be any naturally occurring amino acid
VIXXXXXXXXYXVITPXXXXXXXXXXXXXXXXXXXXXXXXXXXXXKKXKLLTLKIXXXXXXXXXXXX

SEQ ID NO: 34854 - protein, 71 aa, Diabrotica virgifera
  misc_feature: Coding regions on vcDNA: vcDNA=SeqID_14551; Strand=-; Position=291-506
TSAPCTINSSITYLQHIHHYKFIPVLTHSSHQILPLPRITNFSSTLSLFIVENVSTHTFILSYSSSLCIYL

SEQ ID NO: 34855 - protein, 85 aa, Diabrotica virgifera
  misc_feature: Coding regions on vcDNA: vcDNA=SeqID_14552; Strand=-; Position=225-482
  misc_feature (14)..(25): Xaa can be any naturally occurring amino acid
KTCPDWCPDMRNAXXXXXXXXXXXXHGPIHVGKFHSAQHLVKLIALLIMLKHRCICILNWQRFSMLVAYCSETAVLLIVPYAFRI

SEQ ID NO: 34856 - protein, 88 aa, Diabrotica virgifera
  misc_feature: Coding regions on vcDNA: vcDNA=SeqID_14553; Strand=-; Position=90-356
SELKRPRRNFDYMLFSLYRVYCRISSVSILEYPSLSLDHQLNCITPTTGMFFISIYLKSMHSIILYCSLSYHITTSYEILESLILHSS

SEQ ID NO: 34857 - protein, 75 aa, Diabrotica virgifera
  misc_feature: Coding regions on vcDNA: vcDNA=SeqID_14554; Strand=-; Position=1-225
  misc_feature (2)..(75): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXX

SEQ ID NO: 34858 - protein, 70 aa, Diabrotica virgifera
  misc_feature: Coding regions on vcDNA: vcDNA=SeqID_14555; Strand=-; Position=1-210
  misc_feature (3)..(18): Xaa can be any naturally occurring amino acid
  misc_feature (20)..(44): Xaa can be any naturally occurring amino acid
  misc_feature (46)..(70): Xaa can be any naturally occurring amino acid
PQXXXXXXXXXXXXXXXXDXXXXXXXXXXXXXXXXXXXXXXXXXEXXXXXXXXXXXXXXXXXXXXXXXXX

SEQ ID NO: 34859 - protein, 157 aa, Diabrotica virgifera
  misc_feature: Coding regions on vcDNA: vcDNA=SeqID_14556; Strand=-; Position=27-501
  misc_feature: Homolog annotation: Hit_ID=NP_740797.1; Match level="QueryCoverage =92%, HitCoverage=72%, E-value=5e-18, Identity=33%"; Hit description =predicted CDS, reverse transcriptase family member (1C450) [Caenorhabditis elegans]
  misc_feature (25)..(25): Xaa can be any naturally occurring amino acid
  misc_feature (110)..(110): Xaa can be any naturally occurring amino acid
TGIIKQTELNRRKGLAWAAYGKLRXVFRSDILMWLKRKIFDQCVLPVLTYQAEILTLTRKVINKIQVAQRAMERPMLNISLRDRVSNTIHRRKTGVTDALQRFTTLKWNXEGHFGRFKDGRWTKKILEWRPRHDDYANRDRPRTRWSGSEYSRSDTM

SEQ ID NO: 34860 - protein, 221 aa, Diabrotica virgifera
  misc_feature: Coding regions on vcDNA: vcDNA=SeqID_14557; Strand=+; Position=37-703
  misc_feature: Homolog annotation: Hit_ID=AAF97940.2; Match level="QueryCoverage =100%, HitCoverage=48%, E-value=8e-38, Identity=38%"; Hit description= cytochrome P450 CYP6N4v1 [Aedes albopictus]
  misc_feature (148)..(154): Xaa can be any naturally occurring amino acid
  misc_feature (186)..(186): Xaa can be any naturally occurring amino acid
MSVFLTLLGYGIALLLVAAVSFYAYFLYSYTYWSKKGVPYLEPKFPYGNCTSLLAKVKGYSVGMVDSCYKKMREQGWKVGGFFTIARPTLLVLDPEYVRDILVKDFSNFVDRGFYYVKHDKISESLFVVDETNWKNIRTKLTPTFTTXXXXXXXPLITHACGQMTKFMEQLAEKKQDIDIRECLAXFTTDVIVSCALGLDSNCFTDKESKFRNIGKSVLQF

SEQ ID NO: 34861 - protein, 66 aa, Diabrotica virgifera
  misc_feature: Coding regions on vcDNA: vcDNA=SeqID_14558; Strand=-; Position=1-198
  misc_feature (3)..(13): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
SFXXXXXXXXXXXNQPGSPGLNXXXXXXXXRTXXXXXXXXXXXXXIQHRGRXXXXXXXXXXXXXLL

SEQ ID NO: 34862 - protein, 165 aa, Diabrotica virgifera
  misc_feature: Coding regions on vcDNA: vcDNA=SeqID_14559; Strand=-; Position=53-548
  misc_feature: Homolog annotation: Hit_ID=XP_394668.1; Match level="QueryCoverage =92%, HitCoverage=19%, E-value=5e-60, Identity=76%"; Hit description =similar to ENSANGP00000009739 [Apis mellifera]
  misc_feature (15)..(15): Xaa can be any naturally occurring amino acid
RAGPYYVQGLQPFFXGGYNEAKRYLRETLKMANAEDLNRLTSFSLVLLGHIFLSLGNSRESRNMVTPAMQLASKMPDVHVQLWASAILKDLHRICGDSQRENEAYQRHVNFSQMLLTDHFQASQMPEHNLIMWTQGNFPSNTTNEPSTSGALLRPRGRPRGRPRE

SEQ ID NO: 34863 - protein, 42 aa, Diabrotica virgifera
  misc_feature: Coding regions on vcDNA: vcDNA=SeqID_14560; Strand=+; Position=3-128
  misc_feature (7)..(17): Xaa can be any naturally occurring amino acid
  misc_feature (20)..(27): Xaa can be any naturally occurring amino acid
  misc_feature (37)..(42): Xaa can be any naturally occurring amino acid
KLTFFYXXXXXXXXXXXYRXXXXXXXXSYNKFIQFGXXXXXX

SEQ ID NO: 34864 - protein, 96 aa, Diabrotica virgifera
  misc_feature: Coding regions on vcDNA: vcDNA=SeqID_14561; Strand=-; Position=4-294
KRQMSITISLKRETFDQCVLLVMTYGAETFTLTSTTFKTLQIAQRKMERSILSKLLRVRVRNEELRRRTGVTDVISRIGTLKWNWAGYVARISDEM

SEQ ID NO: 34865 - protein, 276 aa, Diabrotica virgifera
  misc_feature: Coding regions on vcDNA: vcDNA=SeqID_14562; Strand=+; Position=2-827
  misc_feature: Homolog annotation: Hit_ID=XP_393150.1; Match level="QueryCoverage =100%, HitCoverage=97%, E-value=1e-115, Identity=45%"; Hit description=similar to CG33196-PB [Apis mellifera]
  misc_feature: Gene Ontology Annotation: Molecular function=protein binding; Cellular component=integral to plasma membrane; Biological process =cell differentiation
  misc_feature (191)..(191): Xaa can be any naturally occurring amino acid
  misc_feature (201)..(201): Xaa can be any naturally occurring amino acid
  misc_feature (264)..(264): Xaa can be any naturally occurring amino acid
  misc_feature (266)..(266): Xaa can be any naturally occurring amino acid
CGQNAECRVVSHTPNCVCLANFQGNPFIQCLPKIEPTVIEKPTPCIPSPCGINAECREQNGAGACICIRDYIGNPYEGCRPECTLNSDCPSNKACINNKCKDPCPGTCGLNAECQVINHLPACVCITGFTGDAFKNCRVVEIIEENPNPCQPSPCGLNSQCREVNSQAVCSCLPEYTGSPPNCRPECTVSXECAHNRACLXQKCIDPCPGTCGLNTKCDVINHSPICSCQNGRTGDPFTRCYPIPPPVPDIIEVKNPCVPSPCXTXSQCRDVGRAP

SEQ ID NO: 34866 - protein, 208 aa, Diabrotica virgifera
  misc_feature: Coding regions on vcDNA: vcDNA=SeqID_14563; Strand=-; Position=135-760
  misc_feature: Homolog annotation: Hit_ID=NP_777225.1; Match level="QueryCoverage =75%, HitCoverage=25%, E-value=2e-27, Identity=44%"; Hit description =p97 protein [Bos taurus] dbj|BAA20065.1| bucentaur [Bos taurus]
  misc_feature (102)..(102): Xaa can be any naturally occurring amino acid
YYTHIIQDIYEKLETTIANIPNKELNLICGDFNAKVGNTTQNDDIKNVLGKFGIGQRNERGDPLIEFAITNNYSIMNTRFKHHVRRLYTWKSPGDRSRNQIXYYILTNIRWRSSIQTVRSYPGAICGSDHTLLVAKVKLKLKVPNKRKETNRIELRKKDDLVQEVHKIMPSIRNGTSQEIWETFKHCVTTPIDHPKIKSCKTETLDNI

SEQ ID NO: 34867 - protein, 79 aa, Diabrotica virgifera; identical to SEQ ID NO: 27306
  misc_feature: Coding regions on vcDNA: vcDNA=SeqID_14564; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 34868 - protein, 69 aa, Diabrotica virgifera
  misc_feature: Coding regions on vcDNA: vcDNA=SeqID_14565; Strand=+; Position=268-477
FFSSFLLLIIILINKCRNLHNKKEFISKIASYLIPYSLSQLDFNAWFLHFCGTPHNMPPALHIRVSLLI

SEQ ID NO: 34869 - protein, 254 aa, Diabrotica virgifera
  misc_feature: Coding regions on vcDNA: vcDNA=SeqID_14566; Strand=+; Position=1-765
  misc_feature: Homolog annotation: Hit_ID=XP_395320.1; Match level="QueryCoverage =86%, HitCoverage=31%, E-value=6e-47, Identity=42%"; Hit description =similar to ENSANGP00000013132 [Apis mellifera]
  misc_feature: Gene Ontology Annotation: Molecular function=molecular_function unknown; Cellular component=cellular_component unknown; Biological process=biological_process unknown
PTRPLISADDYIINLSNLDIIDVSLLENLMIETFKSDTILENKIAILHYLLVHMEDVETASELICWHSATPFTIDYPELLKEFLLATSYASVQKNLPLNAAKLATLLPITTLRLGFDMELKNNDYLINLRQEVLWNASMMVISPQLRITPYKSDLWVKLWDHLAKLSKPGLRFRSSQVLDKLRISLDCYQPEALSRCSTPLSPSGGAASTFADFLSGTRNQTDFLPFYEMDSCTASRQGAYYLCELEGVKHAFC

SEQ ID NO: 34870 - protein, 42 aa, Diabrotica virgifera
  misc_feature: Coding regions on vcDNA: vcDNA=SeqID_14567; Strand=+; Position=41-166
FYWRVQSNNKDCDPHVGFKVNIGVAPQLFTPVQLLKFYWTWA

SEQ ID NO: 34871 - protein, 131 aa, Diabrotica virgifera
  misc_feature: Coding regions on vcDNA: vcDNA=SeqID_14568; Strand=-; Position=423-818
LFLRPSPLLAAPQLLWDIPSMVLFLFWSPVLPPFSVERASRRGNKVSWEVKFHFHSKWQCYRFSWTEFFSPSFISHTPGTSGQFAFSAISSHKNKTAIIFISITSCKSDCVSIGCTIYNSSDDPLTFTFYT

SEQ ID NO: 34872 - protein, 233 aa, Diabrotica virgifera
  misc_feature: Coding regions on vcDNA: vcDNA=SeqID_14569; Strand=+; Position=102-799
  misc_feature: Homolog annotation: Hit_ID=XP_397305.1; Match level="QueryCoverage =94%, HitCoverage=39%, E-value=4e-80, Identity=68%"; Hit description =similar to chromosome 14 open reading frame 10 [Apis mellifera]
  misc_feature (226)..(226): Xaa can be any naturally occurring amino acid
MNLDIADKQKPDDNTEEIEDTHFQKYLSEWKKKDVRTDEGIPKFFNKIPKEHEPLRVKLREESRSNLFKRKSLQLLDNNELKELWVLLDQNQSNPEEQLISYTDFQKVANLAGAKVKPYFTSVLFAKLQQGDPQGRVSIMSLFNYVMRKVCLDQTRIGLSLYDATGQGYLTEVDLENYITELLPTLPQLEGLEKSFHTFYVYTAVRKFLFFLGVVRTGRVRILDIXACSFLDD

SEQ ID NO: 34873 - protein, 57 aa, Diabrotica virgifera
  misc_feature: Coding regions on vcDNA: vcDNA=SeqID_14570; Strand=-; Position=3-173
  misc_feature (24)..(31): Xaa can be any naturally occurring amino acid
LKDRPQPGSHRFNLRSGKILKVEXXXXXXXXPNNKLYSNIEVAIFIIDLTSPIKLRC

SEQ ID NO: 34874 - protein, 184 aa, Diabrotica virgifera
  misc_feature: Coding regions on vcDNA: vcDNA=SeqID_14571; Strand=+; Position=3-557
  misc_feature: Homolog annotation: Hit_ID=EAL42176.1; Match level="QueryCoverage =97%, HitCoverage=44%, E-value=1e-48, Identity=47%"; Hit description =ENSANGP00000026362 [Anopheles gambiae str. PEST] ref|XP_560906.1| ENSANGP00000026362 [Anopheles gambiae st
SVQVVGKEATKWGTILSCAVPYESFPTQDGYFTIGTGSEPQFKDFCERIQSPDLPQNEKYLTNKLRVQNREELVPLLRTILKTKTNKEWADIFLGASFPCGPVNTMKDTFEDPHVKAIDLVKTLDHPVAGQIKVVGPAVKYGEGGNFVKSAPPTLGQHTKQVLSEILGFSDASIEDFKRRQVVE

SEQ ID NO: 34875 - protein, 23 aa, Diabrotica virgifera
  misc_feature: Coding regions on vcDNA: vcDNA=SeqID_14572; Strand=+; Position=1-69
  misc_feature (1)..(13): Xaa can be any naturally occurring amino acid
XXXXXXXXXXXXXRFLLQAGNEG

SEQ ID NO: 34876 - protein, 259 aa, Diabrotica virgifera
  misc_feature: Coding regions on vcDNA: vcDNA=SeqID_14573; Strand=+; Position=59-838
MDNPNDNAASEPSLEDKSSAPGEDEKKNESTSNTLENINLTTHEEDDPETDDDDPLKEGETAPLLAPNEDSKESKPDTPTSKPLALNLDNPGNQQIGTELVTKSDNTMSKPSNDNPFNKPLIDDPAIKPPTDNPLNKPLNGDPASKSLNDNPLNKPFIGDPPSKSPTAPNLENPGNQQNGTGFVSKLKSVAENFLSSSDSSRPTEYDPESLDNEESTPLLSGIPLNRRFLDRLWLVLFIILIVLAVSIGALLIWLGTQI

SEQ ID NO: 34877 - protein, 251 aa, Diabrotica virgifera
  misc_feature: Coding regions on vcDNA: vcDNA=SeqID_14574; Strand=-; Position=1-753
  misc_feature (1)..(247): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRVL

SEQ ID NO: 34878 - protein, 70 aa, Diabrotica virgifera
  misc_feature: Coding regions on vcDNA: vcDNA=SeqID_14575; Strand=+; Position=11-223
  misc_feature: Homolog annotation: Hit_ID=AAM88602.1; Match level="QueryCoverage =95%, HitCoverage=56%, E-value=6e-22, Identity=76%"; Hit description =NADH dehydrogenase subunit I [Monolepta citrinella]
RRILIIISSLPLIVCVLVSIAFLTLLEREVLGYIHLRKGPNKAGFLGLIQPFSEDIRLFTKEQIYPPILN

SEQ ID NO: 34879 - protein, 55 aa, Diabrotica virgifera
  misc_feature: Coding regions on vcDNA: vcDNA=SeqID_14576; Strand=-; Position=1-165
  misc_feature (5)..(55): Xaa can be any naturally occurring amino acid
GLPLXXXXXXXXXXXXXXXXXXXXXXXXXXXXXXXXXXXXXXXXXXXXXXXXXXX

SEQ ID NO: 34880 - protein, 38 aa, Diabrotica virgifera
  misc_feature: Coding regions on vcDNA: vcDNA=SeqID_14577; Strand=-; Position=1-114
  misc_feature (1)..(13): Xaa can be any naturally occurring amino acid
  misc_feature (23)..(37): Xaa can be any naturally occurring amino acid
XXXXXXXXXXXXXFYLRINSYEXXXXXXXXXXXXXXXV

SEQ ID NO: 34881 - protein, 99 aa, Diabrotica virgifera
  misc_feature: Coding regions on vcDNA: vcDNA=SeqID_14578; Strand=+; Position=50-349
STAETLDNSSSDEATTSTPDRKRGAAALCIAGVTVHLPLQAPSMSPYLLHVYSLTYDLLPTDTLIVPSLTKSHVSVNATSYMLTACDYLDSLDKILLAI

SEQ ID NO: 34882 - protein, 243 aa, Diabrotica virgifera
  misc_feature: Coding regions on vcDNA: vcDNA=SeqID_14579; Strand=-; Position=117-848
  misc_feature: Homolog annotation: Hit_ID=CAD56930.1; Match level="QueryCoverage =84%, HitCoverage=46%, E-value=3e-14, Identity=28%"; Hit description =kinectin [Mus musculus]
  misc_feature: Gene Ontology Annotation: Molecular function=molecular_function unknown; Cellular component=endoplasmic reticulum; Biological process=microtubule-based movement
GTIKQKNSQLIQKELEEQKTKNNQFSSEIISKEQDSQKQFMQRLFPDIEALKTLNSSDWQDQCAKLIEKYVRSLKEEQQHSSQHSSPQKSSEVIKLQAQIEHYKNTIDDTEGLLNELQKRVEQEEMTWRGQLAAKEAELENLKASHLSQLQSKLVNLENLLSKEVEEKKKLLEECQLLKSQKTQRSTQADSTATIEKLSEEVNHLREQLRLEQTKNGDVGVCIKAQNCNNSSNGPSFLDVSII

SEQ ID NO: 34883 - protein, 231 aa, Diabrotica virgifera
  misc_feature: Coding regions on vcDNA: vcDNA=SeqID_14580; Strand=+; Position=208-900
  misc_feature: Homolog annotation: Hit_ID=AAT38512.1; Match level="QueryCoverage =89%, HitCoverage=41%, E-value=7e-38, Identity=37%"; Hit description =pheromone-degrading enzyme [Phyllopertha diversa]
  misc_feature: Gene Ontology Annotation: Molecular function=monooxygenase activity; Cellular component=extracellular space; Biological process =leukotriene metabolism
  misc_feature (46)..(52): Xaa can be any naturally occurring amino acid
MAVVLALFVGAIVAAISYWWMGIYRIRSKLHWIPEIPRLPLIGNAXXXXXXXEILGKFEDYLSKHNGLCTIELATYKFIVTSDPTFLEFLLGKTDILNKSDEYQFLGNWLGKGLLTAAAPKWKRSRKMLTPSFHFSILDVFVDTFDSNAAILVDLLDKETNKDSFDIFPYVKNCTMDVICETSMGVSIHAQKNPKSDYVRAVAELCRLLILRTYSPLKPSIFFIALLLTIN

SEQ ID NO: 34884 - protein, 63 aa, Diabrotica virgifera
  misc_feature: Coding regions on vcDNA: vcDNA=SeqID_14581; Strand=-; Position=0-188
  misc_feature (3)..(19): Xaa can be any naturally occurring amino acid
  misc_feature (25)..(55): Xaa can be any naturally occurring amino acid
KNXXXXXXXXXXXXXXXXXLLFYHXXXXXXXXXXXXXXXXXXXXXXXXXXXXXXXEKNVSFLR

SEQ ID NO: 34885 - protein, 275 aa, Diabrotica virgifera
  misc_feature: Coding regions on vcDNA: vcDNA=SeqID_14582; Strand=+; Position=2-827
  misc_feature: Homolog annotation: Hit_ID=NP_766240.1; Match level="QueryCoverage =96%, HitCoverage=31%, E-value=3e-59, Identity=45%"; Hit description =RIKEN cDNA 4632411B12 [Mus musculus] dbj|BAC26771.1| unnamed protein product [Mus musculus]
  misc_feature (227)..(227): Xaa can be any naturally occurring amino acid
WTISTEHCYARPWDWRPEASFLRPTKTLFMPKLIPTKPAIPETEELIDVEAEVEVPVPNYDVAKAKTLMNECENQAIAARTDIEVDWEELVSKSNWTSNQNKVFNGMVNILNYFNLSKLAYSGSQNEPLLRRTVIDKGVQRVRRLLASVSWELKLIQWLHQTMIENLPAPYLGSYLDILQTLKSKLPNFVDKMMHVSSANRTNTLSNANLAPLLEKPWDPVSTSLNXYKPKKLPGTPIILIVPSGTAVSKMVQKWTKLLTNLATVITIQTSFGST

SEQ ID NO: 34886 - protein, 68 aa, Diabrotica virgifera
  misc_feature: Coding regions on vcDNA: vcDNA=SeqID_14583; Strand=-; Position=187-393
IYVLEVVMIDLRQEAGMICFIYDILKILKFLRKSSDILTAAFQFRILYLSLDNVRAYYSSSYQSFNRK

SEQ ID NO: 34887 - protein, 132 aa, Diabrotica virgifera
  misc_feature: Coding regions on vcDNA: vcDNA=SeqID_14584; Strand=+; Position=57-455
  misc_feature (39)..(45): Xaa can be any naturally occurring amino acid
  misc_feature (56)..(64): Xaa can be any naturally occurring amino acid
IVPTVETSRTLWNAPQKQLNGYVNWTLIFRFIHYILVFXXXXXXXCIYRTVKVHTXXXXXXXXXGTRSLRLLPFNYEPQITSTRYTLLLKLACLSLRDHFTTVTRYKGSAAQSCRFQNGESRFAGLLKYPSA

SEQ ID NO: 34888 - protein, 47 aa, Diabrotica virgifera
  misc_feature: Coding regions on vcDNA: vcDNA=SeqID_14585; Strand=-; Position=1-141
  misc_feature (2)..(30): Xaa can be any naturally occurring amino acid
  misc_feature (34)..(44): Xaa can be any naturally occurring amino acid
DXXXXXXXXXXXXXXXXXXXXXXXXXXXXXINNXXXXXXXXXXXKKM

SEQ ID NO: 34889 - protein, 107 aa, Diabrotica virgifera
  misc_feature: Coding regions on vcDNA: vcDNA=SeqID_14586; Strand=-; Position=1-321
  misc_feature (77)..(83): Xaa can be any naturally occurring amino acid
FPLEHRASTVILHFCRSCAFSLTSFQVRPTFSASLIIVFFHVFIGLPCFRFPEGWNSNACFVMSVSGFRRVWYDPPXXXXXXXFLYVLVLASFLFHKSEFVLLLGQN

SEQ ID NO: 34890 - protein, 147 aa, Diabrotica virgifera
  misc_feature: Coding regions on vcDNA: vcDNA=SeqID_14587; Strand=+; Position=2-445
VNSDSSTICQLFYFPNKTMSITNYIVILASILIASTAAQRGFYAGSSPKGIPGVAARFRPGGSLYNPPQDVGTSSRFGDSRFGAGLNRGNQGPVSFTGNQGVASSFGAGNSISGPVVTGRFFNIIIHNQWRTYVYDPFADAWYPKRY

SEQ ID NO: 34891 - protein, 113 aa, Diabrotica virgifera
  misc_feature: Coding regions on vcDNA: vcDNA=SeqID_14588; Strand=+; Position=135-476
  misc_feature: Homolog annotation: Hit_ID=CAA10770.1; Match level="QueryCoverage =96%, HitCoverage=32%, E-value=1e-09, Identity=31%"; Hit description =reverse transcriptase-like [Bos taurus]
VRKAFELWLYRRILKIPWTTHTINENGLRRIDGVLLKIIKVRKVSYLGHIIRNEKYRLAQLVVQGMIEGKRGPGRRQISWFRNIRDWTGLDSTYLFRTALDRDIFVSVVANLH

SEQ ID NO: 34892 - protein, 79 aa, Diabrotica virgifera
  misc_feature: Coding regions on vcDNA: vcDNA=SeqID_14589; Strand=-; Position=630-869
  misc_feature (55)..(61): Xaa can be any naturally occurring amino acid
LPSFCSFFWARALPLWLISYWKGKRPFLKVDYKFFFNAIGILTHRLRDETSRRRXXXXXXXDYIFQNGTCPLFVMVIYL

SEQ ID NO: 34893 - protein, 81 aa, Diabrotica virgifera
  misc_feature: Coding regions on vcDNA: vcDNA=SeqID_14590; Strand=-; Position=2-244
  misc_feature (1)..(15): Xaa can be any naturally occurring amino acid
  misc_feature (18)..(28): Xaa can be any naturally occurring amino acid
  misc_feature (38)..(45): Xaa can be any naturally occurring amino acid
  misc_feature (48)..(61): Xaa can be any naturally occurring amino acid
  misc_feature (67)..(80): Xaa can be any naturally occurring amino acid
XXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 34894 - protein, 40 aa, Diabrotica virgifera
  misc_feature: Coding regions on vcDNA: vcDNA=SeqID_14591; Strand=-; Position=0-119
  misc_feature (3)..(3): Xaa can be any naturally occurring amino acid
  misc_feature (5)..(33): Xaa can be any naturally occurring amino acid
  misc_feature (35)..(36): Xaa can be any naturally occurring amino acid
ITXNXXXXXXXXXXXXXXXXXXXXXXXXXXXXXKXXKLFT

SEQ ID NO: 34895 - protein, 247 aa, Diabrotica virgifera
  misc_feature: Coding regions on vcDNA: vcDNA=SeqID_14592; Strand=+; Position=94-837
  misc_feature: Homolog annotation: Hit_ID=CAG32411.1; Match level="QueryCoverage =60%, HitCoverage=31%, E-value=1e-18, Identity=34%"; Hit description =hypothetical protein [Gallus gallus]
  misc_feature: Gene Ontology Annotation: Cellular component=spliceosome complex; Biological process=mRNA processing
  misc_feature: Pfam annotation: Pfam_ID=tRNA_int_endo; Match level="Score=-32.4, E -value=0.07, Copies=1"; Pfam description=tRNA intron endonuclease, catalytic C
MEHDSPRAQKNCKLSPGLEFPIIFTEDNEIYKIKATFNGFSVKIDETEDNKKVVGMGYFGKGNYSRSYPIFNNNGRHSILRDRQYQIRQYWGQANQSKETDVFVVPDSDGEYEKYFNELEPKCVKDTSGLEEVVFLGLEEAFFLSHCVEVLEISHNSCVLNSEKLWSLFTDTDLYFPYNYAVYNYFRAKNWVVKPGIKFGGDFVLYKQGPMFYHASYVVVVDVLNNKLQRIQELCRRPLGNTSLLCF

SEQ ID NO: 34896 - protein, 280 aa, Diabrotica virgifera
  misc_feature: Coding regions on vcDNA: vcDNA=SeqID_14593; Strand=+; Position=42-882
  misc_feature: Homolog annotation: Hit_ID=EAL28302.1; Match level="QueryCoverage =93%, HitCoverage=49%, E-value=2e-63, Identity=43%"; Hit description =GA19386-PA [Drosophila pseudoobscura]
  misc_feature: Gene Ontology Annotation: Biological process=reproduction
  misc_feature: Pfam annotation: Pfam_ID=GMC_oxred_N; Match level="Score=205.7, E -value=8.9e-59, Copies=1"; Pfam description=GMC oxidoreductase
  misc_feature (104)..(104): Xaa can be any naturally occurring amino acid
HKITNDKLLSLFLGSAGSVVANRLSANPNWTVLALEAGINENFLNDIPITAWFQSKYPYDWGFKTEKQPNACLSTIDGTCLIANGKAVGGTSVTNFMVYNRGNXYHSNDGPLNIEPPGWESPLVDLFIKAGEELGYSQNDPDGKEQLGFSKIRGTERRGRRCSTATAFIKPILNRSNFNLQSGARVTKILIDPTTKKAHGVEYIKYGIKHTVHARKEIILSAGTIMSPQLLMTSGVGPQDHLTQKGITCLKDSKVGYNLQDHIGVVFQALFVNESVTFTD

SEQ ID NO: 34897 - protein, 85 aa, Diabrotica virgifera
  misc_feature: Coding regions on vcDNA: vcDNA=SeqID_14594; Strand=+; Position=277-534
  misc_feature (69)..(74): Xaa can be any naturally occurring amino acid
VSSFCNDNPITISVVYNNSNSERVLLAFLRPSRKQNRNLELSHPTTPENCTPMTNVRMARPGTVLTDIXXXXXXYATRRCQVVFA

SEQ ID NO: 34898 - protein, 258 aa, Diabrotica virgifera
  misc_feature: Coding regions on vcDNA: vcDNA=SeqID_14595; Strand=+; Position=148-921
  misc_feature: Homolog annotation: Hit_ID=S47891; Match level="QueryCoverage=78%, HitCoverage=43%, E-value=9e-40, Identity=42%"; Hit description =exuperantia protein - fruit fly (Drosophila virilis)
  misc_feature (103)..(110): Xaa can be any naturally occurring amino acid
  misc_feature (232)..(232): Xaa can be any naturally occurring amino acid
NLFWPAFCESANSGDERESSVPVVPENPAKGIPTGKYKLVGWGIDTTGRRLIDEIIQIAAFTPESQFSQYVMPFGDLNPTYSRRHGIRVVNTIRYRRLKDVNXXXXXXXXSEISALQDFLKWLETVKGNDVDGIILIYYELRKASPGMLLESLRRHNMIERFQKVVKGFANGFNIAQAKCGNTTKSFNLHIMSKVLLNRGAEHFNSAVDRARASFDIAAHLAQGEREEFKGXAASKDCTGTESHLMESVCPYVNPIDA

SEQ ID NO: 34899 - protein, 185 aa, Diabrotica virgifera
  misc_feature: Coding regions on vcDNA: vcDNA=SeqID_14596; Strand=-; Position=226-783
  misc_feature: Homolog annotation: Hit_ID=XP_307144.1; Match level="QueryCoverage =96%, HitCoverage=47%, E-value=5e-29, Identity=37%"; Hit description =ENSANGP00000024852 [Anopheles gambiae]
  misc_feature (16)..(16): Xaa can be any naturally occurring amino acid
  misc_feature (123)..(123): Xaa can be any naturally occurring amino acid
VAARIIAGNRAYYINXVLKSKILLRAAKIGVYKTIIRPTITYKRDMDSEPETQRETTKLLVLERKILRNIYGPCREERTGEWRWRRRHSDELQTIYGDENIIRYIKANRIRWAGHVPRSSDEXTSERHILGKADGRRSVVRPRKRWKDAVASGLRKMGVQQWEIAAQDRQQWREIVNAAKTHMEL

SEQ ID NO: 34900 - protein, 61 aa, Diabrotica virgifera
  misc_feature: Coding regions on vcDNA: vcDNA=SeqID_14597; Strand=-; Position=1-183
  misc_feature (1)..(7): Xaa can be any naturally occurring amino acid
  misc_feature (13)..(38): Xaa can be any naturally occurring amino acid
  misc_feature (47)..(61): Xaa can be any naturally occurring amino acid
XXXXXXXITASRXXXXXXXXXXXXXXXXXXXXXXXXXXVKKCELFNXXXXXXXXXXXXXXX

SEQ ID NO: 34901 - protein, 76 aa, Diabrotica virgifera
  misc_feature: Coding regions on vcDNA: vcDNA=SeqID_14598; Strand=+; Position=239-469
IIQAIYYSTGLSKTRTNIYFRFHTGLSIRLSLSEYSSSVIRINRMTNKVSNETSYPKDGIKVEDIILGLAVPELQP

SEQ ID NO: 34902 - protein, 111 aa, Diabrotica virgifera
  misc_feature: Coding regions on vcDNA: vcDNA=SeqID_14599; Strand=-; Position=254-590
  misc_feature (69)..(69): Xaa can be any naturally occurring amino acid
NFQFVTYAICPLERRYGSQVWTLTKENIDKVTKAQRSMERQMRHIKLKDRKRNVWIRGVTKVKDVKERXRQADERWNKQIIYWRPWEHKRGRGGPQMRWSDELKSMPDQDG

SEQ ID NO: 34903 - protein, 295 aa, Diabrotica virgifera
  misc_feature: Coding regions on vcDNA: vcDNA=SeqID_14600; Strand=-; Position=3-886
  misc_feature: Homolog annotation: Hit_ID=AAF87760.1; Match level="QueryCoverage =99%, HitCoverage=66%, E-value=1e-120, Identity=76%"; Hit description= cytochrome oxidase subunit I [Diabrotica virgifera zeae]
  misc_feature: Pfam annotation: Pfam_ID=COX1; Match level="Score=58.8, E-value=1.6e -14, Copies=1"; Pfam description=Cytochrome C and Quinol oxidase polyp
  misc_feature (7)..(7): Xaa can be any naturally occurring amino acid
  misc_feature (16)..(22): Xaa can be any naturally occurring amino acid
  misc_feature (71)..(71): Xaa can be any naturally occurring amino acid
  misc_feature (106)..(106): Xaa can be any naturally occurring amino acid
  misc_feature (123)..(123): Xaa can be any naturally occurring amino acid
  misc_feature (126)..(132): Xaa can be any naturally occurring amino acid
  misc_feature (179)..(179): Xaa can be any naturally occurring amino acid
  misc_feature (186)..(202): Xaa can be any naturally occurring amino acid
  misc_feature (233)..(233): Xaa can be any naturally occurring amino acid
  misc_feature (249)..(256): Xaa can be any naturally occurring amino acid
  misc_feature (277)..(277): Xaa can be any naturally occurring amino acid
IIFDPAXGGDPILYHXXXXXXXHPEVYILILPGLGLISHIVRQERRKKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 34904 - protein, 48 aa, Diabrotica virgifera
  misc_feature: Coding regions on vcDNA: vcDNA=SeqID_14601; Strand=-; Position=2-145
ILMFLSHSTGFNFSMQHIVYPSNSIPKTIAWFYRYRVIEIIKSSSDAW

SEQ ID NO: 34905 - protein, 34 aa, Diabrotica virgifera; identical to SEQ ID NO: 27603
  misc_feature: Coding regions on vcDNA: vcDNA=SeqID_14602; Strand=-; Position=80-184

SEQ ID NO: 34906 - protein, 112 aa, Diabrotica virgifera
  misc_feature: Coding regions on vcDNA: vcDNA=SeqID_14603; Strand=+; Position=157-492
  misc_feature: Homolog annotation: Hit_ID=AAV34856.1; Match level="QueryCoverage =99%, HitCoverage=36%, E-value=2e-43, Identity=79%"; Hit description =ribosomal protein SA [Bombyx mori]
  misc_feature: Gene Ontology Annotation: Molecular function=structural constituent of ribosome; Cellular component=cytosolic small ribosomal subunit (sensu Eukarya); Biological process=ribosomal small subunit assembly and maintenance
  misc_feature: Pfam annotation: Pfam_ID=Ribosomal_S2; Match level="Score=54.2, E -value=3.8e-13, Copies=1"; Pfam description=Ribosomal protein S2
VARAIVAIEHPGEVFVISSRPYGQRAVLKFAAHTGATPIAGKFTPGAFTNQIQAEFREPRLLIVPDPAFDHQPITEASYVNIPDIVWCSIDSPVRLADIAMPGNYKGSPMIG

SEQ ID NO: 34907 - protein, 150 aa, Diabrotica virgifera
  misc_feature: Coding regions on vcDNA: vcDNA=SeqID_14604; Strand=-; Position=312-764
  misc_feature (141)..(147): Xaa can be any naturally occurring amino acid
FSITQIAFLRFYQNKVTVNHSTGTVYVERETHNERFIFFYYLFMVGTYRVAKKSGNTSPSRKQLERFLQIPVGRGPSMRPIPQWQQHCCQIPRLPGNPMNSISSGTPRTFLEPWNPQGTLTTLHMPFPTPKCHNFRVIATXXXXXXXNNL

SEQ ID NO: 34908 - protein, 110 aa, Diabrotica virgifera
  misc_feature: Coding regions on vcDNA: vcDNA=SeqID_14605; Strand=+; Position=318-650
  misc_feature (37)..(44): Xaa can be any naturally occurring amino acid
  misc_feature (83)..(90): Xaa can be any naturally occurring amino acid
DMVEIHTLIIFSQSFPNSRFLWKGKFSIIDKYHRLNXXXXXXXXSPHHVPERVQKFNHFKLILSKKKTIRIFKQCIMFIYTNXXXXXXXXNTFRLFVHISKMNPSFRIFC

SEQ ID NO: 34909 - protein, 132 aa, Diabrotica virgifera
  misc_feature: Coding regions on vcDNA: vcDNA=SeqID_14606; Strand=-; Position=276-674
  misc_feature (5)..(5): Xaa can be any naturally occurring amino acid
  misc_feature (54)..(61): Xaa can be any naturally occurring amino acid
NSFSXKAIKDVEQKINTQSHEVQCFLLRRINILCEKFLKTLDAVNGLKTVCYLXXXXXXXXKRTAEQLRTDNDEKQVLIELLKQENHSLQNMKMNTEKKLNTLQQALVEKDSLIEELHAKNVRNFCISVIFC

SEQ ID NO: 34910 - protein, 66 aa, Diabrotica virgifera; identical to SEQ ID NO: 26808
  misc_feature: Coding regions on vcDNA: vcDNA=SeqID_14607; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34911 - protein, 97 aa, Diabrotica virgifera
  misc_feature: Coding regions on vcDNA: vcDNA=SeqID_14608; Strand=-; Position=26-319
FVVFQYISLSLVHIKQQYYNIRFVPTILSSSLLKRYHEQRILAKGPPRLPSLSTPSSSQAFQTKSAVGPSGPTALPFFIVGQFLDLVSHFPCRSYGV

SEQ ID NO: 34912 - protein, 260 aa, Diabrotica virgifera
  misc_feature: Coding regions on vcDNA: vcDNA=SeqID_14609; Strand=+; Position=84-866
  misc_feature: Homolog annotation: Hit_ID=XP_395910.1; Match level="QueryCoverage =96%, HitCoverage=58%, E-value=1e-32, Identity=30%"; Hit description =similar to RIKEN cDNA 3830405G04 [Apis mellifera]
MYTPTSVSLSGPAFSFLLYENTKSRFHQEGFLLGEIIKKETKTITDSDQQQVNISKIIKINSVVPFPQSHYIYNGTGKINKDKVREFLGNQFSKVVAWYKYQKCPNTKLTLRDKIIHRQLLELFDISAEMFTCCLLTTEPSDNAATHLFSQIFVRCNSLGCDNIPIVIPNLSESNNMYKSSETSSETFKKILGDIKIDKRNTQGLVIINKIQNALQKHIDTLVTDLAESERYLYELEKEVSQQEIYKKVKKKNSETFGFF

SEQ ID NO: 34913 - protein, 109 aa, Diabrotica virgifera
  misc_feature: Coding regions on vcDNA: vcDNA=SeqID_14610; Strand=-; Position=2-328
  misc_feature (5)..(24): Xaa can be any naturally occurring amino acid
  misc_feature (30)..(43): Xaa can be any naturally occurring amino acid
  misc_feature (46)..(56): Xaa can be any naturally occurring amino acid
  misc_feature (66)..(73): Xaa can be any naturally occurring amino acid
  misc_feature (76)..(89): Xaa can be any naturally occurring amino acid
  misc_feature (95)..(108): Xaa can be any naturally occurring amino acid
SFKGXXXXXXXXXXXXXXXXXXXXRIFYLXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 34914 - protein, 167 aa, Diabrotica virgifera
  misc_feature: Coding regions on vcDNA: vcDNA=SeqID_14611; Strand=+; Position=3-506
  misc_feature (2)..(24): Xaa can be any naturally occurring amino acid
  misc_feature (38)..(45): Xaa can be any naturally occurring amino acid
  misc_feature (64)..(84): Xaa can be any naturally occurring amino acid
  misc_feature (100)..(111): Xaa can be any naturally occurring amino acid
  misc_feature (129)..(135): Xaa can be any naturally occurring amino acid
FXXXXXXXXXXXXXXXXXXXXXXXPHCVRLFHFYNQKXXXXXXXXSWTINSTSYIYYSLMYNTXXXXXXXXXXXXXXXXXXXXXIRFSLYLILQEINYTXXXXXXXXXXXXISLLLHIFRHELPLPILXXXXXXXQIYDYTFPSFTICDYSSSHTIIFTYYQSLITI

SEQ ID NO: 34915 - protein, 138 aa, Diabrotica virgifera
  misc_feature: Coding regions on vcDNA: vcDNA=SeqID_14612; Strand=+; Position=118-534
  misc_feature: Homolog annotation: Hit_ID=BAA75470.1; Match level="QueryCoverage =94%, HitCoverage=19%, E-value=3e-23, Identity=44%"; Hit description =prophenoloxidase [Tenebrio molitor]
  misc_feature (49)..(49): Xaa can be any naturally occurring amino acid
  misc_feature (105)..(105): Xaa can be any naturally occurring amino acid
KLHIKPKKNAQTELDVPGAYIPNQYTNVGNPIISRLAEEIPSVKIPVTXISIPPLREIEEIITDENFSPIVPKHRKNAVQQINIFIPTRDVDDLLPKHVYTRHRXDPYLYNYALSDVPLHKAHTQNEQIPSIITSFPY

SEQ ID NO: 34916 - protein, 128 aa, Diabrotica virgifera
  misc_feature: Coding regions on vcDNA: vcDNA=SeqID_14613; Strand=+; Position=488-871
RQPSLFLLIRVVPHSKHELDISDTQYGFRNGMGTREALFSFNVLTQRCLDVNRSLYVCFIDYNKAFDKVKHDRLMEILKTRNLDERDLRLITHLYYNRRAIVRIEKKHLKKWNKERSQARLHTITSII

SEQ ID NO: 34917 - protein, 118 aa, Diabrotica virgifera
  misc_feature: Coding regions on vcDNA: vcDNA=SeqID_14614; Strand=+; Position=535-888
  misc_feature (28)..(34): Xaa can be any naturally occurring amino acid
  misc_feature (73)..(73): Xaa can be any naturally occurring amino acid
  misc_feature (75)..(75): Xaa can be any naturally occurring amino acid
  misc_feature (81)..(81): Xaa can be any naturally occurring amino acid
  misc_feature (86)..(86): Xaa can be any naturally occurring amino acid
  misc_feature (101)..(102): Xaa can be any naturally occurring amino acid
  misc_feature (110)..(110): Xaa can be any naturally occurring amino acid
TSTFTINYVNSFSKQVTIIFQLIICVFXXXXXXXSFCIFHIHQFYHKSTSFKPRDSATVEPHSQLCLSHHVPXNXANRNSXVNRNXTLLNNLHNLPKHIYXXSLGYLIFXQLTNVIWL

SEQ ID NO: 34918 - protein, 121 aa, Diabrotica virgifera
  misc_feature: Coding regions on vcDNA: vcDNA=SeqID_14615; Strand=-; Position=538-903
  misc_feature (5)..(20): Xaa can be any naturally occurring amino acid
  misc_feature (28)..(37): Xaa can be any naturally occurring amino acid
  misc_feature (40)..(58): Xaa can be any naturally occurring amino acid
  misc_feature (62)..(72): Xaa can be any naturally occurring amino acid
  misc_feature (74)..(91): Xaa can be any naturally occurring amino acid
LLPIXXXXXXXXXXXXXXXXDELKNKFXXXXXXXXXXDKXXXXXXXXXXXXXXXXXXXINFXXXXXXXXXXXSXXXXXXXXXXXXXXXXXXLIKEFGNIFFTCLLKTCLFVLNIKSRLPTD

SEQ ID NO: 34919 - protein, 77 aa, Diabrotica virgifera
  misc_feature: Coding regions on vcDNA: vcDNA=SeqID_14616; Strand=-; Position=444-677
SVFLIYFHIHDISHFNMRGRIIVILMIHLLKTFLRVIYSRIYKKCEEQVSWTKIGFRNALPLGSREALLSVQVLMQR

SEQ ID NO: 34920 - protein, 64 aa, Diabrotica virgifera
  misc_feature: Coding regions on vcDNA: vcDNA=SeqID_14617; Strand=-; Position=127-321
FNQRVQQAPLPVSKLISLSSGGTYAALSDPTRTNPGVQLRIATNEMVGMPCIPRNLLNCYGCVV

SEQ ID NO: 34921 - protein, 80 aa, Diabrotica virgifera
  misc_feature: Coding regions on vcDNA: vcDNA=SeqID_14618; Strand=-; Position=2-241
  misc_feature (4)..(13): Xaa can be any naturally occurring amino acid
  misc_feature (17)..(25): Xaa can be any naturally occurring amino acid
  misc_feature (37)..(44): Xaa can be any naturally occurring amino acid
  misc_feature (47)..(60): Xaa can be any naturally occurring amino acid
  misc_feature (66)..(79): Xaa can be any naturally occurring amino acid
NINXXXXXXXXXXGPFXXXXXXXXXIETTLAHTGLNXXXXXXXXSNXXXXXXXXXXXXXXPTSRSXXXXXXXXXXXXXXV

SEQ ID NO: 34922 - protein, 86 aa, Diabrotica virgifera
  misc_feature: Coding regions on vcDNA: vcDNA=SeqID_14619; Strand=-; Position=352-612
  misc_feature (65)..(73): Xaa can be any naturally occurring amino acid
SIEKLHLWLHFSEDAIFLCIGGVSINLSSSLWGRYLIAILEKKVQVVFIKSNIKVMLLKGKQLYXXXXXXXXXALLQANKINSIYF

SEQ ID NO: 34923 - protein, 252 aa, Diabrotica virgifera
  misc_feature: Coding regions on vcDNA: vcDNA=SeqID_14620; Strand=+; Position=127-882
  misc_feature: Homolog annotation: Hit_ID=XP_419379.1; Match level="QueryCoverage =88%, HitCoverage=28%, E-value=3e-23, Identity=29%"; Hit description =PREDICTED: similar to minichromosome maintenance protein 8 isoform 1; DNA replication
  misc_feature (79)..(86): Xaa can be any naturally occurring amino acid
  misc_feature (176)..(189): Xaa can be any naturally occurring amino acid
  misc_feature (236)..(236): Xaa can be any naturally occurring amino acid
MKPRNNYKKTKKYTGNDPSDVRSLPNYGYPGLRIYFPDDNDIKIELLKKRLEILKSFFRQNHSSESLETIGRDRFFTLXXXXXXXXEEIISEWPEFKEELLDNSEYTLKCMGLSMHDLVSKHYEEQNEPNSILFDTILVRICNVEPIMQLRDLRVNYFGKMVTIRGTVIKATQVKXXXXXXXXXXXXXXGTQVLRQPDGVYTVPSKCQTKDCRARSNFSVDHDSPFNKVISWQSIXIPEPLWADQYETARTP

SEQ ID NO: 34924 - protein, 68 aa, Diabrotica virgifera
  misc_feature: Coding regions on vcDNA: vcDNA=SeqID_14621; Strand=-; Position=522-728
  misc_feature (27)..(34): Xaa can be any naturally occurring amino acid
EMGESESFTKKANISQNQIKKLKNTCXXXXXXXXNHNKHDPHGGSGGNIKILNRNPAIFREMNIRSKN

SEQ ID NO: 34925 - protein, 34 aa, Diabrotica virgifera
  misc_feature: Coding regions on vcDNA: vcDNA=SeqID_14622; Strand=+; Position=1-102
  misc_feature (2)..(19): Xaa can be any naturally occurring amino acid
  misc_feature (25)..(33): Xaa can be any naturally occurring amino acid
QXXXXXXXXXXXXXXXXXXAVITKXXXXXXXXXT

SEQ ID NO: 34926 - protein, 236 aa, Diabrotica virgifera
  misc_feature: Coding regions on vcDNA: vcDNA=SeqID_14623; Strand=+; Position=1-708
  misc_feature (3)..(22): Xaa can be any naturally occurring amino acid
  misc_feature (25)..(123): Xaa can be any naturally occurring amino acid
  misc_feature (126)..(134): Xaa can be any naturally occurring amino acid
  misc_feature (138)..(179): Xaa can be any naturally occurring amino acid
  misc_feature (184)..(193): Xaa can be any naturally occurring amino acid
  misc_feature (209)..(234): Xaa can be any naturally occurring amino acid
SPXXXXXXXXXXXXXXXXXXXXLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIPXXXXXXXXXHIFXXXXXXXXXXXXXXXXXXXXXXXXXXXXXXXXXXXXXXXXXXLAKIXXXXXXXXXXLSHLSSKNMSFCIQYXXXXXXXXXXXXXXXXXXXXXXXXXXLI

SEQ ID NO: 34927 - protein, 46 aa, Diabrotica virgifera
  misc_feature: Coding regions on vcDNA: vcDNA=SeqID_14624; Strand=+; Position=2-142
  misc_feature (1)..(26): Xaa can be any naturally occurring amino acid
XXXXXXXXXXXXXXXXXXXXXXXXXXIEIILSLGIEDIIIIEKLDS

SEQ ID NO: 34928 - protein, 56 aa, Diabrotica virgifera
  misc_feature: Coding regions on vcDNA: vcDNA=SeqID_14625; Strand=+; Position=38-208
  misc_feature (9)..(23): Xaa can be any naturally occurring amino acid
  misc_feature (42)..(54): Xaa can be any naturally occurring amino acid
RILSLRYQXXXXXXXXXXXXXXXIITKFFSINSLYIKSFIAXXXXXXXXXXXXXTH

SEQ ID NO: 34929 - protein, 80 aa, Diabrotica virgifera
  misc_feature: Coding regions on vcDNA: vcDNA=SeqID_14626; Strand=+; Position=329-568
SGYNVFKKSLESYNRFGKFETSKMAKFLSGPISMQASLVCRFGTMLQWFKTILICILRATNIEYEGNWAIEIMIIPYTVY

SEQ ID NO: 34930 - protein, 71 aa, Diabrotica virgifera
  misc_feature: Coding regions on vcDNA: vcDNA=SeqID_14627; Strand=+; Position=341-556
  misc_feature (14)..(20): Xaa can be any naturally occurring amino acid
ELLTSLSAQYVRVXXXXXXXLCITLSGIDVGSYNKRRLAIFTDTGSRGIVSNLSKLEIDGIHFSLADIKYL

SEQ ID NO: 34931 - protein, 195 aa, Diabrotica virgifera; identical to SEQ ID NO: 21868
  misc_feature: Coding regions on vcDNA: vcDNA=SeqID_14628; Strand=+; Position=153-740
  misc_feature: Homolog annotation: Hit_ID=AAP93585.1; Match level="QueryCoverage =86%, HitCoverage=100%, E-value=5e-65, Identity=67%"; Hit description= putative thioredoxin perxidase [Apis mellifera ligustica]
  misc_feature: Gene Ontology Annotation: Molecular function=electron transporter activity; Cellular component=mitochondrion; Biological process =phospholipid metabolism
  misc_feature: Pfam annotation: Pfam_ID=GSHPx; Match level="Score=203.3, E-value =4.8e-58, Copies=1"; Pfam description=Glutathione peroxidase

SEQ ID NO: 34932 - protein, 66 aa, Diabrotica virgifera
  misc_feature: Coding regions on vcDNA: vcDNA=SeqID_14629; Strand=-; Position=2-199
  misc_feature (3)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGXNXXXXXXXXSNXXXXXXXXXXXXXXPTSRSXXXXXXXXXXXXXXV

SEQ ID NO: 34933 - protein, 181 aa, Diabrotica virgifera
  misc_feature: Coding regions on vcDNA: vcDNA=SeqID_14630; Strand=+; Position=13-555
  misc_feature: Homolog annotation: Hit_ID=XP_307915.1; Match level="QueryCoverage =92%, HitCoverage=27%, E-value=1e-11, Identity=25%"; Hit description =ENSANGP00000021871 [Anopheles gambiae]
  misc_feature: Gene Ontology Annotation: Molecular function=DNA binding; Cellular component=nucleus; Biological process=regulation of transcription, DNA-dependent
  misc_feature (21)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (30)..(30): Xaa can be any naturally occurring amino acid
  misc_feature (50)..(50): Xaa can be any naturally occurring amino acid
  misc_feature (59)..(59): Xaa can be any naturally occurring amino acid
  misc_feature (63)..(63): Xaa can be any naturally occurring amino acid
  misc_feature (69)..(69): Xaa can be any naturally occurring amino acid
  misc_feature (81)..(81): Xaa can be any naturally occurring amino acid
  misc_feature (115)..(115): Xaa can be any naturally occurring amino acid
PLRGPGQNRTFAGRARNRTRXQXPXRNGSXPAQETKGRRTKEHRGARQRXQQPRDERGXSNTXTAQAKXHRRPGATRETSXGERETQPTNNTRGKHGERESDRRARQRRTHRAEXKRRKKRNRQRDPRRTKNRARRKAGNRRKRRRRGTNRRAQSPKPQRTPRNRGNNNERETRRPTTKPP

SEQ ID NO: 34934 - protein, 69 aa, Diabrotica virgifera
  misc_feature: Coding regions on vcDNA: vcDNA=SeqID_14631; Strand=+; Position=594-800
  misc_feature: Homolog annotation: Hit_ID=XP_314867.1; Match level="QueryCoverage =73%, HitCoverage=6%, E-value=1e-09, Identity=54%"; Hit description =ENSANGP00000005174 [Anopheles gambiae]
EFLNPIHHTAEQLVEQPILEETTNVIKHLKNNKAPGTNGITAELIKNGGHVLWKSIHKLIERIWTLEVI

SEQ ID NO: 34935 - protein, 262 aa, Diabrotica virgifera
  misc_feature: Coding regions on vcDNA: vcDNA=SeqID_14632; Strand=+; Position=2-790
  misc_feature: Homolog annotation: Hit_ID=NP_609060.1; Match level="QueryCoverage =100%, HitCoverage=26%, E-value=3e-90, Identity=61%"; Hit description= CG11070-PA [Drosophila melanogaster] gb|AAF52416.2| CG11070-PA [Drosophila melanogaster]
  misc_feature: Gene Ontology Annotation: Molecular function=protein binding; Cellular component=nucleus; Biological process=ubiquitin cycle
  misc_feature: Pfam annotation: Pfam_ID=U-box; Match level="Score=146.0, E-value =8.9e-41, Copies=1"; Pfam description=U-box domain
ANMAKLKEMQQQQESEEWVNMNERERTQNTSYMHHIGNLARFDNILGKDTIGMLEKLTSKINLVFTHSTMVDRIAAMLNYFLLNLVGPNKKNFKVKDAKEYHFDPADTVLEICKIYVNLKESAAFCLAVSQDGRSYSPSLFSLAEDVLVRIGGGPLIGELKEVAAKVAEKSSEYKANEEVLAEAPEHFLDPIMSTLMADPVILPSSKQIVDRSTIARHLLSDQTDPFNRSPLSMDQVIPNTELAQEIRNWIDERRRKAANQS

SEQ ID NO: 34936 - protein, 180 aa, Diabrotica virgifera
  misc_feature: Coding regions on vcDNA: vcDNA=SeqID_14633; Strand=-; Position=141-683
  misc_feature (100)..(107): Xaa can be any naturally occurring amino acid
  misc_feature (124)..(134): Xaa can be any naturally occurring amino acid
  misc_feature (138)..(148): Xaa can be any naturally occurring amino acid
  misc_feature (165)..(176): Xaa can be any naturally occurring amino acid
GLSIFKTIFPKLSKADNYKELISNMLGSFKVMSCRMYLKVHMLHAHLVQFKDNFGANSEEQGERFHQDVMNFEQLYEGEYNENMIGYYICGLIRDSPYVXXXXXXXXSLFVFSFVFMGFTYAVXXXXXXXXXXXQNLXXXXXXXXXXXELFHKILNLVLVSTKVXXXXXXXXXXXXVRLK

SEQ ID NO: 34937 - protein, 206 aa, Diabrotica virgifera
  misc_feature: Coding regions on vcDNA: vcDNA=SeqID_14634; Strand=+; Position=158-775
  misc_feature: Homolog annotation: Hit_ID=AAL13362.1; Match level="QueryCoverage =98%, HitCoverage=95%, E-value=3e-46, Identity=45%"; Hit description =LD37206p [Drosophila melanogaster]
  misc_feature: Pfam annotation: Pfam_ID=2OG-FeII_Oxy; Match level="Score=19.0, E -value=0.0038, Copies=1"; Pfam description=2OG-Fe(II) oxygenase superfamily
  misc_feature (11)..(25): Xaa can be any naturally occurring amino acid
  misc_feature (153)..(153): Xaa can be any naturally occurring amino acid
  misc_feature (166)..(166): Xaa can be any naturally occurring amino acid
  misc_feature (168)..(168): Xaa can be any naturally occurring amino acid
  misc_feature (187)..(187): Xaa can be any naturally occurring amino acid
  misc_feature (192)..(192): Xaa can be any naturally occurring amino acid
  misc_feature (204)..(206): Xaa can be any naturally occurring amino acid
MDVSQYRVNEXXXXXXXXXXXXXXXEESHIIKQVYAVPKPKWTSLSNRRLQDYGGIPHEKGMIPERIPSWLQAYLNKIAELQIFEQCKPNQVLVNEYLPGQGIMPHSDGPLFYPTISTISCGSHTVLEFVTNDESRKKVCNIFLEPRSLIIIXDDLYSKYLHSISXRXFDSINDCANKDCCQLDSCXSELEXSTRISLTIQNVXXX

SEQ ID NO: 34938 - protein, 72 aa, Diabrotica virgifera
  misc_feature: Coding regions on vcDNA: vcDNA=SeqID_14635; Strand=-; Position=381-599
  misc_feature (16)..(27): Xaa can be any naturally occurring amino acid
EKTFFQGGGPPPEPPXXXXXXXXXXXXNPKMGTQKGPPLLNFSGKTPEALGPGKIKGPPWGKAPSGGGPLPL

SEQ ID NO: 34939 - protein, 99 aa, Diabrotica virgifera
  misc_feature: Coding regions on vcDNA: vcDNA=SeqID_14636; Strand=-; Position=2-298
LSEMVQINRNHHRCTKVYKPPYLRTVPLPKIFHTRNAVQPDMNNSIKKSLMKEVIIFCVGLYRVLHNDSLLYKRMSANASFPRYGVLKLSSQTANSFIA

SEQ ID NO: 34940 - protein, 73 aa, Diabrotica virgifera
  misc_feature: Coding regions on vcDNA: vcDNA=SeqID_14637; Strand=+; Position=1-222
  misc_feature (2)..(41): Xaa can be any naturally occurring amino acid
  misc_feature (43)..(50): Xaa can be any naturally occurring amino acid
LXXXXXXXXXXXXXXXXXXXXXXXXXXXXXXXXXXXXXXXXRXXXXXXXXDRNQPGSPRFKLKSCKILKGKQI

SEQ ID NO: 34941 - protein, 93 aa, Diabrotica virgifera
  misc_feature: Coding regions on vcDNA: vcDNA=SeqID_14638; Strand=-; Position=249-530
LLERKNMWEHSHSTEQFETSTPPKVATPQYMVHILYFNRTWRLQVDAARYNRIHAQRATCFPARKCQALASSMGTDQLRKQEMNIQHDKSDMT

SEQ ID NO: 34942 - protein, 17 aa, Diabrotica virgifera
  misc_feature: Coding regions on vcDNA: vcDNA=SeqID_14639; Strand=-; Position=1-51
  misc_feature (2)..(16): Xaa can be any naturally occurring amino acid
EXXXXXXXXXXXXXXXA

SEQ ID NO: 34943 - protein, 262 aa, Diabrotica virgifera
  misc_feature: Coding regions on vcDNA: vcDNA=SeqID_14640; Strand=-; Position=60-848
  misc_feature (3)..(25): Xaa can be any naturally occurring amino acid
  misc_feature (39)..(58): Xaa can be any naturally occurring amino acid
  misc_feature (62)..(70): Xaa can be any naturally occurring amino acid
  misc_feature (73)..(79): Xaa can be any naturally occurring amino acid
  misc_feature (84)..(90): Xaa can be any naturally occurring amino acid
  misc_feature (92)..(104): Xaa can be any naturally occurring amino acid
  misc_feature (106)..(128): Xaa can be any naturally occurring amino acid
  misc_feature (133)..(223): Xaa can be any naturally occurring amino acid
  misc_feature (227)..(261): Xaa can be any naturally occurring amino acid
RAXXXXXXXXXXXXXXXXXXXXXXXIGVFLVFLKTFKLXXXXXXXXXXXXXXXXXXXXTLHXXXXXXXXXLCXXXXXXXPRPFXXXXXXXGXXXXXXXXXXXXXGXXXXXXXXXXXXXXXXXXXXXXXNIILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNLXXXXXXXXXXXXXXXXXXXXXXXXXXXXXXXXXXXP

SEQ ID NO: 34944 - protein, 26 aa, Diabrotica virgifera
  misc_feature: Coding regions on vcDNA: vcDNA=SeqID_14641; Strand=-; Position=2-79
  misc_feature (11)..(25): Xaa can be any naturally occurring amino acid
KWDQKIIELIXXXXXXXXXXXXXXXD

SEQ ID NO: 34945 - protein, 264 aa, Diabrotica virgifera
  misc_feature: Coding regions on vcDNA: vcDNA=SeqID_14642; Strand=+; Position=9-800
  misc_feature: Homolog annotation: Hit_ID=NP_999764.1; Match level="QueryCoverage =98%, HitCoverage=19%, E-value=1e-20, Identity=33%"; Hit description =scavenger receptor cysteine-rich protein [Strongylocentrotus purpuratus] gb|AAD05493.1| scavenger
  misc_feature: Pfam annotation: Pfam_ID=TIL; Match level="Score=60.7, E-value=4e-15, Copies=3"; Pfam description=Trypsin Inhibitor like cysteine rich
MEKVLFVLMALCLCQGSLGQLCRCPRGEIWNNCASCDPEATCQNRIPEAPGICPAVCQQRCECDSKNGLIRDQISGACVPIDKCPGCSRGEIWNECASCNPEPTCQNRTSQIPKICPDVCYPRCECDANAGFIRDAISGQCIPREQCPAGQCGPLEVLNECASPCAPERTCRNQSPDVPDSCILPCEQRCECDEKRGLIRDEETGKCIDIRKCQAGHCGPLEVFNECASPCVPERTCQRQSPIGPDACILSCETRCECDEKQGL

SEQ ID NO: 34946 - protein, 35 aa, Diabrotica virgifera
  misc_feature: Coding regions on vcDNA: vcDNA=SeqID_14643; Strand=+; Position=2-109
  misc_feature (1)..(9): Xaa can be any naturally occurring amino acid
  misc_feature (14)..(14): Xaa can be any naturally occurring amino acid
  misc_feature (18)..(30): Xaa can be any naturally occurring amino acid
XXXXXXXXXYRVYXLFIXXXXXXXXXXXXXWRDYK

SEQ ID NO: 34947 - protein, 77 aa, Diabrotica virgifera
  misc_feature: Coding regions on vcDNA: vcDNA=SeqID_14644; Strand=-; Position=559-792
ESVIDNSKFITILQSMSQGIRHHQCYLIAVVSLSTCFIALVVSSACISNPITHCLMVSIAWDASAFIYWMVWEDLVI

SEQ ID NO: 34948 - protein, 97 aa, Diabrotica virgifera
  misc_feature: Coding regions on vcDNA: vcDNA=SeqID_14645; Strand=+; Position=412-705
  misc_feature (15)..(22): Xaa can be any naturally occurring amino acid
LYRRSLKYSIEHLRXXXXXXXXFPSYCCSITCCLTLLSRIPCFPNNLISTIYRLPSAVEILHQPHVAPKDMDLDPPDESPSQHLLSSHLTETTSIIF

SEQ ID NO: 34949 - protein, 52 aa, Diabrotica virgifera
  misc_feature: Coding regions on vcDNA: vcDNA=SeqID_14646; Strand=-; Position=1-156
  misc_feature (4)..(16): Xaa can be any naturally occurring amino acid
  misc_feature (21)..(49): Xaa can be any naturally occurring amino acid
DQKXXXXXXXXXXXXXVITPXXXXXXXXXXXXXXXXXXXXXXXXXXXXXKKM

SEQ ID NO: 34950 - protein, 96 aa, Diabrotica virgifera
  misc_feature: Coding regions on vcDNA: vcDNA=SeqID_14647; Strand=-; Position=1-288
  misc_feature (7)..(26): Xaa can be any naturally occurring amino acid
  misc_feature (49)..(96): Xaa can be any naturally occurring amino acid
SYFLKPXXXXXXXXXXXXXXXXXXXXINFYRTSIGVFLVLLKKFEAFYXXXXXXXXXXXXXXXXXXXXXXXXXXXXXXXXXXXXXXXXXXXXXXXX

SEQ ID NO: 34951 - protein, 223 aa, Diabrotica virgifera
  misc_feature: Coding regions on vcDNA: vcDNA=SeqID_14648; Strand=+; Position=2-673
  misc_feature: Homolog annotation: Hit_ID=XP_317674.1; Match level="QueryCoverage =99%, HitCoverage=15%, E-value=4e-59, Identity=55%"; Hit description =ENSANGP00000018543 [Anopheles gambiae]
  misc_feature: Gene Ontology Annotation: Molecular function=ATPase activity; Cellular component=nucleus; Biological process=mitotic chromosome condensation
  misc_feature: Pfam annotation: Pfam_ID=SMC_C; Match level="Score=174.0, E-value =3.2e-49, Copies=1"; Pfam description=SMC family, C-terminal domain
MITLGGDADFEMVDTYDPFSEGIQFNVRPPKKSWKKISNLSGGEKTLSSLALVFALHYYKPSPLYVMDEIDAALDFKNVSIVGNYIKQRTKNAQFIIISLRSNMFELCDNLIGIYKTYDCTKSITIDPRVYDEQTKHNEKRVSLGSTNEESRRTSVPASGTGDSGDKNPERNVSNEVVDEQRSNLMEVDNVIQSTNNARDSSGLSSSMSENENSLQESQVPEI

SEQ ID NO: 34952 - protein, 232 aa, Diabrotica virgifera
  misc_feature: Coding regions on vcDNA: vcDNA=SeqID_14649; Strand=-; Position=1-696
  misc_feature (3)..(232): Xaa can be any naturally occurring amino acid
INXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34953 - protein, 91 aa, Diabrotica virgifera
  misc_feature: Coding regions on vcDNA: vcDNA=SeqID_14650; Strand=+; Position=20-295
  misc_feature: Homolog annotation: Hit_ID=NP_722593.1; Match level="QueryCoverage =87%, HitCoverage=19%, E-value=3e-31, Identity=77%"; Hit description =CG2674-PJ, isoform J [Drosophila melanogaster] ref|NP_524923.1| CG2674-PC, isoform C [Drosophila
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_C; Match level="Score=55.7, E -value=1.3e-13, Copies=1"; Pfam description=S-adenosylmethionine synthetase, C-te
MLYRYNKIYTFKLSYAIGLAEPLSITVFDYGTSKLTQKELLDIVNKNFDLRPGKIVKELNLRQPIYQKTSTYGHFGRDGFTWEQPKTLQLN

SEQ ID NO: 34954 - protein, 35 aa, Diabrotica virgifera
  misc_feature: Coding regions on vcDNA: vcDNA=SeqID_14651; Strand=-; Position=1-105
  misc_feature (2)..(35): Xaa can be any naturally occurring amino acid
CXXXXXXXXXXXXXXXXXXXXXXXXXXXXXXXXXX

SEQ ID NO: 34955 - protein, 196 aa, Diabrotica virgifera
  misc_feature: Coding regions on vcDNA: vcDNA=SeqID_14652; Strand=-; Position=3-590
  misc_feature (5)..(11): Xaa can be any naturally occurring amino acid
  misc_feature (29)..(29): Xaa can be any naturally occurring amino acid
  misc_feature (38)..(196): Xaa can be any naturally occurring amino acid
KSTDXXXXXXXPIINLIQHRGRNLYYRLXLSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34956 - protein, 53 aa, Diabrotica virgifera
  misc_feature: Coding regions on vcDNA: vcDNA=SeqID_14653; Strand=+; Position=171-332
TNPPWHINIPSFLTTTIGRYTTTIYCRDAFQPVCQKTLSLTIKYGEYNDLLTP

SEQ ID NO: 34957 - protein, 217 aa, Diabrotica virgifera
  misc_feature: Coding regions on vcDNA: vcDNA=SeqID_14654; Strand=+; Position=163-816
  misc_feature: Homolog annotation: Hit_ID=EAL29333.1; Match level="QueryCoverage =79%, HitCoverage=29%, E-value=8e-09, Identity=33%"; Hit description =GA14119-PA [Drosophila pseudoobscura]
YGIQEKISRPRVKVIKSPWDAALETGSVDAAFVEEPTWTTKGNYVAPDVNSYEAALKNDSLDNWSVPKSNDQKMYAQNPSYNSNSINKIIDGNQKGSSNVDEYKPTMPQGWATHKQFGSNTLPRTKPKSTASPTYKPPGSPSVFIPKERPSYFTPSESEPNYNYKPSLQISEAPKPTKILDLHSLQYYNVSPKGWTEAKNYYKTLSYSQSREMYSDF

SEQ ID NO: 34958 - protein, 20 aa, Diabrotica virgifera
  misc_feature: Coding regions on vcDNA: vcDNA=SeqID_14655; Strand=-; Position=0-59
  misc_feature (2)..(10): Xaa can be any naturally occurring amino acid
FXXXXXXXXXDINEFNTTKT

SEQ ID NO: 34959 - protein, 82 aa, Diabrotica virgifera
  misc_feature: Coding regions on vcDNA: vcDNA=SeqID_14656; Strand=-; Position=272-520
  misc_feature (2)..(18): Xaa can be any naturally occurring amino acid
  misc_feature (42)..(56): Xaa can be any naturally occurring amino acid
  misc_feature (60)..(80): Xaa can be any naturally occurring amino acid
SXXXXXXXXXXXXXXXXXEYYINIIYNLLLTKIILCLSSYLXXXXXXXXXXXXXXXAYSXXXXXXXXXXXXXXXXXXXXXPK

SEQ ID NO: 34960 - protein, 93 aa, Diabrotica virgifera; identical to SEQ ID NO: 27329
  misc_feature: Coding regions on vcDNA: vcDNA=SeqID_14657; Strand=+; Position=488-769
  misc_feature (25)..(55): Xaa can be any naturally occurring amino acid

SEQ ID NO: 34961 - protein, 288 aa, Diabrotica virgifera
  misc_feature: Coding regions on vcDNA: vcDNA=SeqID_14658; Strand=+; Position=2-862
  misc_feature: Homolog annotation: Hit_ID=XP_313843.1; Match level="QueryCoverage =100%, HitCoverage=38%, E-value=4e-47, Identity=37%"; Hit description= ENSANGP00000011728 [Anopheles gambiae]
  misc_feature (203)..(209): Xaa can be any naturally occurring amino acid
  misc_feature (225)..(225): Xaa can be any naturally occurring amino acid
  misc_feature (238)..(238): Xaa can be any naturally occurring amino acid
  misc_feature (240)..(240): Xaa can be any naturally occurring amino acid
  misc_feature (242)..(242): Xaa can be any naturally occurring amino acid
  misc_feature (263)..(263): Xaa can be any naturally occurring amino acid
  misc_feature (265)..(265): Xaa can be any naturally occurring amino acid
  misc_feature (271)..(272): Xaa can be any naturally occurring amino acid
  misc_feature (274)..(274): Xaa can be any naturally occurring amino acid
EDPSAEFERIKREREEQYKPKLLIDVNLEHWKQKEREKERELERQKARERERMRELDRERDRQRKREEREKRYIMEQAAQELAAVEAEPIDSDSDMEADNHYSPAPPEPDPVSMDNSNSAQWTQVQAPDEDSKHSFISNHDEHVVPPTSTGMKITLAKPITLQSPTRDSKRRKSDLREVFNPDEDDSNTQIKKRKLVPLDYNXXXXXXXEKENGESKKSEESKSXEEKRRNIKSLIEXIXTXKEALFAYHLDWSAIDSVLMEXKXRPWDNXXIXEYIGEPEPTLVDFI

SEQ ID NO: 34962 - protein, 74 aa, Diabrotica virgifera
  misc_feature: Coding regions on vcDNA: vcDNA=SeqID_14659; Strand=-; Position=14-238
  misc_feature (3)..(13): Xaa can be any naturally occurring amino acid
  misc_feature (16)..(26): Xaa can be any naturally occurring amino acid
  misc_feature (42)..(42): Xaa can be any naturally occurring amino acid
  misc_feature (46)..(53): Xaa can be any naturally occurring amino acid
  misc_feature (71)..(71): Xaa can be any naturally occurring amino acid
YYXXXXXXXXXXXLFXXXXXXXXXXXTNPGSHLFKLRSCKIXKSTXXXXXXXXPIINFNPTSRSQSYLSIXTLQ

SEQ ID NO: 34963 - protein, 271 aa, Diabrotica virgifera
  misc_feature: Coding regions on vcDNA: vcDNA=SeqID_14660; Strand=+; Position=2-817
  misc_feature: Homolog annotation: Hit_ID=EAA09023.3; Match level="QueryCoverage =73%, HitCoverage=83%, E-value=6e-21, Identity=32%"; Hit description =ENSANGP00000011648 [Anopheles gambiae str. PEST] ref|XP_562307.1| ENSANGP00000011648 [Anopheles gambiae st
  misc_feature: Gene Ontology Annotation: Biological process=regulation of protein activity, epigenetic
  misc_feature: Pfam annotation: Pfam_ID=GILT; Match level="Score=94.7, E-value=2.4e -25, Copies=1"; Pfam description=Gamma interferon inducible lysosomal t
  misc_feature (178)..(184): Xaa can be any naturally occurring amino acid
  misc_feature (198)..(204): Xaa can be any naturally occurring amino acid
  misc_feature (208)..(208): Xaa can be any naturally occurring amino acid
MYIFTSCLYAFLVLLVTSSNAQDQNEQKVTVRVYHESLCPYAKKFIVDQLAPTMKGNLSRYVNLELVPYGKAKEIHLANGTQYYECHHKVQECYGNRIQACVDNHIEKSKREEYLSFVSCFMGNLTTNVEKKQVDDALKRCIPEPLDVDQIRNCTISPLGDKLIENNAKITNGFQKPXXXXXXXVFNGVYNPSESSEXXXXXXXVLCXKIKGKKPEECANLPNKGGESIQDANLTNKSGESKSKDANLTNKGVEANKVYRTLLVALLILYV

SEQ ID NO: 34964 - protein, 93 aa, Diabrotica virgifera
  misc_feature: Coding regions on vcDNA: vcDNA=SeqID_14661; Strand=-; Position=1-279
  misc_feature (5)..(93): Xaa can be any naturally occurring amino acid
ICNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34965 - protein, 219 aa, Diabrotica virgifera
  misc_feature: Coding regions on vcDNA: vcDNA=SeqID_14662; Strand=+; Position=5-664
  misc_feature (1)..(123): Xaa can be any naturally occurring amino acid
  misc_feature (136)..(161): Xaa can be any naturally occurring amino acid
  misc_feature (163)..(169): Xaa can be any naturally occurring amino acid
  misc_feature (171)..(177): Xaa can be any naturally occurring amino acid
  misc_feature (187)..(201): Xaa can be any naturally occurring amino acid
  misc_feature (205)..(214): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQIRINNFHILEYXXXXXXXXXXXXXXXXXXXXXXXXXXFXXXXXXXIXXXXXXXKYIGLVKEFXXXXXXXXXXXXXXXIKYXXXXXXXXXXVAAVV

SEQ ID NO: 34966 - protein, 158 aa, Diabrotica virgifera
  misc_feature: Coding regions on vcDNA: vcDNA=SeqID_14663; Strand=+; Position=105-581
MKEKGQCREYRNKSAGNAGNALFYGEDIRRYLLSQQLQAEELDLATAMHLIKSTKEELKKSRTDDTYREVLEKAKSLTDSSGVLFDEQKRTMTVPHRLAISVLMSTTGNKYTETKAYTSKLKIAFSWNTIVASQKMKVCSQYRMPLRKKIKHSWRKRN

SEQ ID NO: 34967 - protein, 24 aa, Diabrotica virgifera
  misc_feature: Coding regions on vcDNA: vcDNA=SeqID_14664; Strand=-; Position=1-72
  misc_feature (2)..(2): Xaa can be any naturally occurring amino acid
  misc_feature (4)..(22): Xaa can be any naturally occurring amino acid
FXIXXXXXXXXXXXXXXXXXXXNN

SEQ ID NO: 34968 - protein, 19 aa, Diabrotica virgifera
  misc_feature: Coding regions on vcDNA: vcDNA=SeqID_14665; Strand=+; Position=1-57
DVWVVRFYIQKISNICSSK

SEQ ID NO: 34969 - protein, 140 aa, Diabrotica virgifera
  misc_feature: Coding regions on vcDNA: vcDNA=SeqID_14666; Strand=-; Position=104-526
SSSVHPNPCGVWFTVAMQVMVSKTFFSLAQDLGLSDACTCIAFIISFLAKEDSSVSPRTSGYVIWGSWGCWTCSFCSCESYTSISAFSTMRNSHPPYPCPIIGVSIIRSPTLTLNKTLIYCSSILCFHNADLGDQQSRLL

SEQ ID NO: 34970 - protein, 129 aa, Diabrotica virgifera
  misc_feature: Coding regions on vcDNA: vcDNA=SeqID_14667; Strand=-; Position=1-387
  misc_feature (1)..(129): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 34971 - protein, 66 aa, Diabrotica virgifera; identical to SEQ ID NO: 26808
  misc_feature: Coding regions on vcDNA: vcDNA=SeqID_14668; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 34972 - protein, 45 aa, Diabrotica virgifera
  misc_feature: Coding regions on vcDNA: vcDNA=SeqID_14669; Strand=-; Position=0-134
  misc_feature (1)..(42): Xaa can be any naturally occurring amino acid
XXXXXXXXXXXXXXXXXXXXXXXXXXXXXXXXXXXXXXXXXXLFT

SEQ ID NO: 34973 - protein, 50 aa, Diabrotica virgifera
  misc_feature: Coding regions on vcDNA: vcDNA=SeqID_14670; Strand=+; Position=3-152
  misc_feature (4)..(22): Xaa can be any naturally occurring amino acid
  misc_feature (24)..(24): Xaa can be any naturally occurring amino acid
  misc_feature (36)..(46): Xaa can be any naturally occurring amino acid
FFYXXXXXXXXXXXXXXXXXXXHXFILIIYLIRRDXXXXXXXXXXXISIT

SEQ ID NO: 34974 - protein, 218 aa, Diabrotica virgifera
  misc_feature: Coding regions on vcDNA: vcDNA=SeqID_14671; Strand=-; Position=158-814
  misc_feature: Homolog annotation: Hit_ID=XP_393350.1; Match level="QueryCoverage =90%, HitCoverage=23%, E-value=2e-52, Identity=48%"; Hit description =similar to ENSANGP00000005993 [Apis mellifera]
  misc_feature: Gene Ontology Annotation: Molecular function=molecular_function unknown; Cellular component=endoplasmic reticulum membrane; Biological process=GPI anchor biosynthesis
MFLAAAVLIVTSVLRIEKATDIEQLFDVPNISILIWIILAQYFFYATGHQPSFPNISWEAAFIGTTGTFSNNVIPGTLIILNTFCSYILMGVLLPLLLITPFTVFVMIPSVCEKKQEFRVEASRGEVILFERDRLMLTSMFKLAAKYILGHAIRVFASMLAATIHCRHLMVWNIFAPKLIFESIGMFITLGSVIVGYLILVRINNKTESLIQTLNKMS

SEQ ID NO: 34975 - protein, 125 aa, Diabrotica virgifera
  misc_feature: Coding regions on vcDNA: vcDNA=SeqID_14672; Strand=+; Position=345-723
  misc_feature: Homolog annotation: Hit_ID=XP_395067.1; Match level="QueryCoverage =60%, HitCoverage=1%, E-value=9e-09, Identity=45%"; Hit description =similar to hemolectin [Apis mellifera]
  misc_feature (3)..(9): Xaa can be any naturally occurring amino acid
  misc_feature (42)..(42): Xaa can be any naturally occurring amino acid
DEXXXXXXXPVPSNEILKYLKDSPKCDSNMMVDIQCPTVKDXNQPTKLLNKLDLHIECSLEIGLICRSSGNESKCPDFEEKFICPVRTNNNYTSHLPTPPTDTNTPPTIPQAILRSLQWNAAHPV

SEQ ID NO: 34976 - protein, 78 aa, Diabrotica virgifera
  misc_feature: Coding regions on vcDNA: vcDNA=SeqID_14673; Strand=+; Position=125-361
FKIYIFFSVFWPWFRRTLSQCKIVQTIKNACDVTLLYFLLTFIVSNLKLYTILFTLLVQNVHAQLYDVNMRFGPPVLI

SEQ ID NO: 34977 - protein, 34 aa, Diabrotica virgifera
  misc_feature: Coding regions on vcDNA: vcDNA=SeqID_14674; Strand=+; Position=98-202
FKTDKRSVVVLLYTYFTLIYSDSNEIQLPMHLIF

SEQ ID NO: 34978 - protein, 47 aa, Diabrotica virgifera; identical to SEQ ID NO: 26759
  misc_feature: Coding regions on vcDNA: vcDNA=SeqID_14675; Strand=+; Position=3-146
  misc_feature (1)..(15): Xaa can be any naturally occurring amino acid
  misc_feature (17)..(24): Xaa can be any naturally occurring amino acid

SEQ ID NO: 34979 - protein, 37 aa, Diabrotica virgifera
  misc_feature: Coding regions on vcDNA: vcDNA=SeqID_14676; Strand=+; Position=2-115
NSVILLESQIDNKDCDLDVGLKFIIGVAGILLSLIDF

SEQ ID NO: 34980 - protein, 84 aa, Diabrotica virgifera
  misc_feature: Coding regions on vcDNA: vcDNA=SeqID_14677; Strand=-; Position=2-253
  misc_feature (26)..(26): Xaa can be any naturally occurring amino acid
  misc_feature (55)..(55): Xaa can be any naturally occurring amino acid
  misc_feature (57)..(57): Xaa can be any naturally occurring amino acid
  misc_feature (60)..(61): Xaa can be any naturally occurring amino acid
  misc_feature (64)..(66): Xaa can be any naturally occurring amino acid
  misc_feature (69)..(69): Xaa can be any naturally occurring amino acid
  misc_feature (73)..(73): Xaa can be any naturally occurring amino acid
  misc_feature (75)..(76): Xaa can be any naturally occurring amino acid
  misc_feature (80)..(82): Xaa can be any naturally occurring amino acid
WALLAWPPGRACFLGLGLRRCVLALXRCRACAFRCLFPLSRRSVSLLRPSFSLPXSXCWXXLSXXXSFXLKGXPXXPFYXXXAL

SEQ ID NO: 34981 - protein, 79 aa, Diabrotica virgifera
  misc_feature: Coding regions on vcDNA: vcDNA=SeqID_14678; Strand=+; Position=1-240
KCSYCHLLIIKIMGHSWRCFCNLHACLIEVCSHQKENKHKKLTLKTPDIKITILNVLPLQSTLAEGQREPPKNMIADNS

SEQ ID NO: 34982 - protein, 97 aa, Diabrotica virgifera
  misc_feature: Coding regions on vcDNA: vcDNA=SeqID_14679; Strand=+; Position=363-656
HTEHVEVIKTFSYRRYYIKDIGANARLHVARMVNACLDEVQFKNYIGQYIPDYRIYMTKTSHSETKSYSHDTGGLRIAAQKKFISYAYAIFLSVSIF

SEQ ID NO: 34983 - protein, 30 aa, Diabrotica virgifera
  misc_feature: Coding regions on vcDNA: vcDNA=SeqID_14680; Strand=-; Position=0-89
  misc_feature (16)..(24): Xaa can be any naturally occurring amino acid
NHPTVIDQKKDAYIVXXXXXXXXXRTLRGP

SEQ ID NO: 34984 - protein, 239 aa, Diabrotica virgifera
  misc_feature: Coding regions on vcDNA: vcDNA=SeqID_14681; Strand=-; Position=1-717
  misc_feature (4)..(25): Xaa can be any naturally occurring amino acid
  misc_feature (28)..(48): Xaa can be any naturally occurring amino acid
  misc_feature (51)..(177): Xaa can be any naturally occurring amino acid
  misc_feature (181)..(200): Xaa can be any naturally occurring amino acid
  misc_feature (203)..(216): Xaa can be any naturally occurring amino acid
  misc_feature (219)..(233): Xaa can be any naturally occurring amino acid
LNKXXXXXXXXXXXXXXXXXXXXXXPYXXXXXXXXXXXXXXXXXXXXXQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHFIXXXXXXXXXXXXXXXXXXXXKLXXXXXXXXXXXXXXPKXXXXXXXXXXXXXXXPILINY

SEQ ID NO: 34985 - protein, 66 aa, Diabrotica virgifera
  misc_feature: Coding regions on vcDNA: vcDNA=SeqID_14682; Strand=+; Position=31-231
  misc_feature (19)..(28): Xaa can be any naturally occurring amino acid
ACIVNIIDLIIYCNCFIYXXXXXXXXXXNYEYFVSIIFFTIRVCEGSLGILLLIIIDPAYGNELYF

SEQ ID NO: 34986 - protein, 295 aa, Diabrotica virgifera
  misc_feature: Coding regions on vcDNA: vcDNA=SeqID_14683; Strand=+; Position=3-887
  misc_feature: Homolog annotation: Hit_ID=NP_523524.2; Match level="QueryCoverage =98%, HitCoverage=65%, E-value=1e-143, Identity=84%"; Hit description= CG4422-PA [Drosophila melanogaster] gb|AAF52777.1| CG4422-PA [Drosophila melanogaster]
  misc_feature: Gene Ontology Annotation: Molecular function=GDP-dissociation inhibitor activity; Cellular component=synaptic vesicle; Biological process=synaptic vesicle fusion
  misc_feature: Pfam annotation: Pfam_ID=GDI; Match level="Score=465.8, E-value=4.6e -137, Copies=1"; Pfam description=GDP dissociation inhibitor
  misc_feature (223)..(223): Xaa can be any naturally occurring amino acid
  misc_feature (227)..(227): Xaa can be any naturally occurring amino acid
  misc_feature (241)..(241): Xaa can be any naturally occurring amino acid
  misc_feature (252)..(252): Xaa can be any naturally occurring amino acid
  misc_feature (256)..(256): Xaa can be any naturally occurring amino acid
  misc_feature (259)..(259): Xaa can be any naturally occurring amino acid
  misc_feature (270)..(270): Xaa can be any naturally occurring amino acid
  misc_feature (275)..(275): Xaa can be any naturally occurring amino acid
DAWAGLKECILSGMLSVSGKKVLHVDRNKYYGGESASICPLEELFSKFGVPPPDESYGRGRDWNVDLIPKFLMANGMLVKLLIHTGVTRYLEFKSVEGSYVYKGGKIAKVPVDQKEALASDLMGMFEKRRFRNFLIYVQDFQADDPKTWKDFDPNTQNMQALYEKFGLDKNTQDFTGHALALHRDDDYLNRMAVETINRIKLYSDSLARYGKSPYLYPTYGLXELPXGFARLSAIYGGTYXVDKPIDEIVLXEGGXVVXVRSGKRIAKWXQVYCXSTYVSDKVRKKGKVIRCICL

SEQ ID NO: 34987 - protein, 151 aa, Diabrotica virgifera
  misc_feature: Coding regions on vcDNA: vcDNA=SeqID_14684; Strand=+; Position=194-650
  misc_feature: Homolog annotation: Hit_ID=XP_312898.1; Match level="QueryCoverage =98%, HitCoverage=66%, E-value=2e-25, Identity=45%"; Hit description =ENSANGP00000014763 [Anopheles gambiae]
  misc_feature (45)..(50): Xaa can be any naturally occurring amino acid
  misc_feature (94)..(94): Xaa can be any naturally occurring amino acid
TQNMSDSQEKRSFTTEEWNYLTKYFVGNTFRYRDNIIIPKGVGPXXXXXXEEKMVESFFESCAFKSLMSCVVGYGLGAAIGLFSSSMVLLQLQXCRTSTARQVFREMKTTTLGMQRICSVGLCFWINDYRISRGSQLENGTMLGSTGGLLD

SEQ ID NO: 34988 - protein, 62 aa, Diabrotica virgifera
  misc_feature: Coding regions on vcDNA: vcDNA=SeqID_14685; Strand=+; Position=2-190
  misc_feature (3)..(21): Xaa can be any naturally occurring amino acid
PPXXXXXXXXXXXXXXXXXXXYGSDSRCIINRGCYCKIYEWHVLTMIFIAHYCVNKTALQCV

SEQ ID NO: 34989 - protein, 93 aa, Diabrotica virgifera; identical to SEQ ID NO: 27329
  misc_feature: Coding regions on vcDNA: vcDNA=SeqID_14686; Strand=+; Position=422-703
  misc_feature (25)..(55): Xaa can be any naturally occurring amino acid

SEQ ID NO: 34990 - protein, 73 aa, Diabrotica virgifera; identical to SEQ ID NO: 29260
  misc_feature: Coding regions on vcDNA: vcDNA=SeqID_14687; Strand=-; Position=1-219
  misc_feature (1)..(73): Xaa can be any naturally occurring amino acid

SEQ ID NO: 34991 - protein, 272 aa, Diabrotica virgifera
  misc_feature: Coding regions on vcDNA: vcDNA=SeqID_14688; Strand=+; Position=3-821
  misc_feature (1)..(228): Xaa can be any naturally occurring amino acid
  misc_feature (230)..(243): Xaa can be any naturally occurring amino acid
  misc_feature (254)..(260): Xaa can be any naturally occurring amino acid
  misc_feature (266)..(266): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIKFIIXXXXXXXRLFDFXNLHDLS

SEQ ID NO: 34992 - protein, 66 aa, Diabrotica virgifera
  misc_feature: Coding regions on vcDNA: vcDNA=SeqID_14689; Strand=+; Position=232-432
AATPIIILQPTTGARSFETIGTPPKNTPDLPEEIISCNENTLDHKMVDVYAYLTTATVIFYSPHLI

SEQ ID NO: 34993 - protein, 205 aa, Diabrotica virgifera
  misc_feature: Coding regions on vcDNA: vcDNA=SeqID_14690; Strand=+; Position=2-619
  misc_feature: Homolog annotation: Hit_ID=XP_397208.1; Match level="QueryCoverage =73%, HitCoverage=80%, E-value=1e-14, Identity=35%"; Hit description =similar to ENSANGP00000014828 [Apis mellifera]
  misc_feature: Pfam annotation: Pfam_ID=DM4_12; Match level="Score=79.8, E-value =7.2e-21, Copies=1"; Pfam description=DM4/DM12 family
  misc_feature (59)..(65): Xaa can be any naturally occurring amino acid
MTENTKFRWLCSLLVLVILVGKVVPQGFQFTNPIRFPYSNTGNPYIGMFVAIAVPIDLXXXXXXXFSANFESSYGLPSNQSLLSYPPIYASTRQLIYQLLESKIKGYGYPGKKCLQRAICEAAEYTTENYGVLGDILHVLLTPSTSRNDTNVEDYAKSEEYGRTKGNCKKYKKNCGLSILNLFSVVKDTYAMYNPNTLKKEISML

SEQ ID NO: 34994 - protein, 198 aa, Diabrotica virgifera
  misc_feature: Coding regions on vcDNA: vcDNA=SeqID_14691; Strand=+; Position=82-678
  misc_feature: Homolog annotation: Hit_ID=XP_392599.1; Match level="QueryCoverage =99%, HitCoverage=98%, E-value=6e-60, Identity=61%"; Hit description =similar to ENSANGP00000003500 [Apis mellifera]
  misc_feature: Gene Ontology Annotation: Molecular function=transporter activity; Cellular component=integral to membrane; Biological process=proton transport
  misc_feature: Pfam annotation: Pfam_ID=ATP-synt_C; Match level="Score=31.5, E-value= 2.6e-06, Copies=2"; Pfam description=ATP synthase subunit C
  misc_feature (85)..(91): Xaa can be any naturally occurring amino acid
MRYTLSYIGATLASTVTLIFALYYCLTGKGEQVSLAWLLLNVSPHMWAGLGIGLAVSLSVVGAAAGIHTTGVSIVGAGVKAPRIXXXXXXXIIFCEAVAIYGLIMAIVLCGSWKNFDVDLFNLKTHNFAQNHYGSHVIFGSGLTVGFCVGVVGSGAAISDAANSSLFVKILIIEIFGSAIGLFGLIVGVYLTSRGSMV

SEQ ID NO: 34995 - protein, 52 aa, Diabrotica virgifera
  misc_feature: Coding regions on vcDNA: vcDNA=SeqID_14692; Strand=+; Position=3-161
  misc_feature (1)..(17): Xaa can be any naturally occurring amino acid
  misc_feature (23)..(30): Xaa can be any naturally occurring amino acid
  misc_feature (37)..(44): Xaa can be any naturally occurring amino acid
XXXXXXXXXXXXXXXXXAYIFLXXXXXXXXYTLFISXXXXXXXXHNLFTRGD

SEQ ID NO: 34996 - protein, 63 aa, Diabrotica virgifera
  misc_feature: Coding regions on vcDNA: vcDNA=SeqID_14693; Strand=-; Position=69-260
  misc_feature (2)..(20): Xaa can be any naturally occurring amino acid
  misc_feature (23)..(33): Xaa can be any naturally occurring amino acid
  misc_feature (55)..(61): Xaa can be any naturally occurring amino acid
KXXXXXXXXXXXXXXXXXXXFLXXXXXXXXXXXNPPWLPRVLTSDQVKFKSRTDXXXXXXXQL

SEQ ID NO: 34997 - protein, 21 aa, Diabrotica virgifera
  misc_feature: Coding regions on vcDNA: vcDNA=SeqID_14694; Strand=-; Position=0-62
  misc_feature (1)..(20): Xaa can be any naturally occurring amino acid
XXXXXXXXXXXXXXXXXXXXR

SEQ ID NO: 34998 - protein, 262 aa, Diabrotica virgifera
  misc_feature: Coding regions on vcDNA: vcDNA=SeqID_14695; Strand=+; Position=104-889
  misc_feature: Homolog annotation: Hit_ID=EAL39044.1; Match level="QueryCoverage =82%, HitCoverage=59%, E-value=3e-67, Identity=53%"; Hit description =ENSANGP00000027022 [Anopheles gambiae str. PEST] ref|XP_553022.1| ENSANGP00000027022 [Anopheles gambiae st
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=-66.2, E-value =5.9e-08, Copies=1"; Pfam description=Lipase
MMWGWTILFAGLFVRTFPQIIPDQNEYETFPIPTFIINQMGNSQIRQAFNIGSCRIVYNPVCPDPDVTFFLFTKEKPEYPVPILVGSQRLNTNLNTTYFDPKKPTKIIIHGYNSNMNISALVEIRKEYLSTKDYNIFAVDWSPLNQAPCYLGALMNIRHVGTCSAQLVQRLLDLGNTDIHVIGFSLGAHITNYMAVALRPYRLPRITGLDPAMPGFITWDLDSKLDKTDADFVDVYHTNAFIQGKVEESGHVDFYINGGVIQ

SEQ ID NO: 34999 - protein, 245 aa, Diabrotica virgifera
  misc_feature: Coding regions on vcDNA: vcDNA=SeqID_14696; Strand=+; Position=167-900
  misc_feature: Homolog annotation: Hit_ID=XP_313723.1; Match level="QueryCoverage =99%, HitCoverage=33%, E-value=2e-86, Identity=66%"; Hit description =ENSANGP00000017587 [Anopheles gambiae]
  misc_feature: Gene Ontology Annotation: Molecular function=calcium ion binding; Cellular component=mitochondrion; Biological process=glucose catabolism
  misc_feature: Pfam annotation: Pfam_ID=DAO; Match level="Score=42.1, E-value=1.7e -09, Copies=1"; Pfam description=FAD dependent oxidoreductase
  misc_feature (207)..(208): Xaa can be any naturally occurring amino acid
  misc_feature (218)..(218): Xaa can be any naturally occurring amino acid
  misc_feature (227)..(228): Xaa can be any naturally occurring amino acid
  misc_feature (239)..(239): Xaa can be any naturally occurring amino acid
MASRFKKIAVSGITGTIGAGIATYYLLRDDGKQPWPTAVSAKEASLKPKRVLPTRADQIKSLQSEKFDVVIIGGGATGAGCALDAATRGLKTALIEADDFASGTSSRSTKLIHGGVRYLQKAIMQLDYEQYRMVQEALHERAVMLHQAPHLAHPLPIMLPVYRWWQVPYYWAGIKMYDLIAGRQTVKSSYFLSKKNALELFPMLRGXXLVGGLVYYDXSQDDARMNXXVAVTATVHGAXIANHVS

SEQ ID NO: 35000 - protein, 70 aa, Diabrotica virgifera
  misc_feature: Coding regions on vcDNA: vcDNA=SeqID_14697; Strand=+; Position=194-406
  misc_feature (30)..(35): Xaa can be any naturally occurring amino acid
SKRHIFNNIRYANNTAMVADTIEDIQFILXXXXXXKKGFGIEDITKTKTSIRYKYLKIMIRTQRSTTASW

SEQ ID NO: 35001 - protein, 94 aa, Diabrotica virgifera
  misc_feature: Coding regions on vcDNA: vcDNA=SeqID_14698; Strand=-; Position=1-282
  misc_feature (1)..(6): Xaa can be any naturally occurring amino acid
  misc_feature (9)..(20): Xaa can be any naturally occurring amino acid
  misc_feature (22)..(31): Xaa can be any naturally occurring amino acid
  misc_feature (37)..(75): Xaa can be any naturally occurring amino acid
  misc_feature (87)..(94): Xaa can be any naturally occurring amino acid
XXXXXXPPXXXXXXXXXXXXPXXXXXXXXXXFGGFSXXXXXXXXXXXXXXXXXXXXXXXXXXXXXXXXXXXXXXXIMFPKRGQNPGXXXXXXXX

SEQ ID NO: 35002 - protein, 79 aa, Diabrotica virgifera
  misc_feature: Coding regions on vcDNA: vcDNA=SeqID_14699; Strand=-; Position=1-237
  misc_feature (1)..(11): Xaa can be any naturally occurring amino acid
  misc_feature (16)..(23): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(77): Xaa can be any naturally occurring amino acid
XXXXXXXXXXXVPFVXXXXXXXXDRNQPGLTPVLNXXXXXXXXSNXXXXXXXXXXXXXXPTSRSXXXXXXXXXXXXXLL

SEQ ID NO: 35003 - protein, 26 aa, Diabrotica virgifera
  misc_feature: Coding regions on vcDNA: vcDNA=SeqID_14700; Strand=-; Position=1-78
  misc_feature (6)..(26): Xaa can be any naturally occurring amino acid
KKNLDXXXXXXXXXXXXXXXXXXXXX

SEQ ID NO: 35004 - protein, 220 aa, Diabrotica virgifera
  misc_feature: Coding regions on vcDNA: vcDNA=SeqID_14701; Strand=-; Position=168-830
  misc_feature (16)..(37): Xaa can be any naturally occurring amino acid
  misc_feature (39)..(47): Xaa can be any naturally occurring amino acid
  misc_feature (56)..(61): Xaa can be any naturally occurring amino acid
  misc_feature (71)..(76): Xaa can be any naturally occurring amino acid
  misc_feature (93)..(101): Xaa can be any naturally occurring amino acid
  misc_feature (108)..(115): Xaa can be any naturally occurring amino acid
  misc_feature (119)..(139): Xaa can be any naturally occurring amino acid
  misc_feature (154)..(175): Xaa can be any naturally occurring amino acid
  misc_feature (184)..(195): Xaa can be any naturally occurring amino acid
GPPGPPPKVTAPPAGXXXXXXXXXXXXXXXXXXXXXXPXXXXXXXXXLSLFPHPGXXXXXXAALLGGPPRXXXXXXVQPPPPAFNFGPPCRLXXXXXXXXXLGPPWPXXXXXXXXKRGXXXXXXXXXXXXXXXXXXXXXKKPKFFLKAGAPPRXXXXXXXXXXXXXXXXXXXXXXGGGKNKNHXXXXXXXXXXXXGPLFLVLRKNSPGGPPGFFLGGSHP

SEQ ID NO: 35005 - protein, 166 aa, Diabrotica virgifera
  misc_feature: Coding regions on vcDNA: vcDNA=SeqID_14702; Strand=+; Position=42-539
  misc_feature (22)..(22): Xaa can be any naturally occurring amino acid
  misc_feature (27)..(27): Xaa can be any naturally occurring amino acid
  misc_feature (30)..(30): Xaa can be any naturally occurring amino acid
  misc_feature (39)..(39): Xaa can be any naturally occurring amino acid
  misc_feature (43)..(44): Xaa can be any naturally occurring amino acid
  misc_feature (46)..(47): Xaa can be any naturally occurring amino acid
  misc_feature (63)..(63): Xaa can be any naturally occurring amino acid
  misc_feature (73)..(73): Xaa can be any naturally occurring amino acid
  misc_feature (75)..(78): Xaa can be any naturally occurring amino acid
  misc_feature (80)..(80): Xaa can be any naturally occurring amino acid
  misc_feature (83)..(83): Xaa can be any naturally occurring amino acid
  misc_feature (86)..(86): Xaa can be any naturally occurring amino acid
  misc_feature (88)..(88): Xaa can be any naturally occurring amino acid
  misc_feature (94)..(94): Xaa can be any naturally occurring amino acid
  misc_feature (96)..(96): Xaa can be any naturally occurring amino acid
  misc_feature (103)..(104): Xaa can be any naturally occurring amino acid
  misc_feature (114)..(114): Xaa can be any naturally occurring amino acid
  misc_feature (117)..(117): Xaa can be any naturally occurring amino acid
  misc_feature (120)..(120): Xaa can be any naturally occurring amino acid
  misc_feature (123)..(123): Xaa can be any naturally occurring amino acid
  misc_feature (126)..(126): Xaa can be any naturally occurring amino acid
  misc_feature (129)..(130): Xaa can be any naturally occurring amino acid
  misc_feature (141)..(141): Xaa can be any naturally occurring amino acid
  misc_feature (150)..(150): Xaa can be any naturally occurring amino acid
  misc_feature (156)..(159): Xaa can be any naturally occurring amino acid
SGRGEKKALRRTQRETTTRGGXQHGTXARXRNGKGPHQXTDTXXPXXTHPTPQPSGTTATGEXGPTDTQRDKXTXXXXKXTGXKTXNXKPKTPXAXGGRNEGXXKNTTQAAAAXHRXTAXQKXTQXRQXXQTEGHEPEGEXPAQRGGAAXDKENNXXXXKETKAEA

SEQ ID NO: 35006 - protein, 43 aa, Diabrotica virgifera
  misc_feature: Coding regions on vcDNA: vcDNA=SeqID_14703; Strand=-; Position=1-129
  misc_feature (1)..(8): Xaa can be any naturally occurring amino acid
  misc_feature (11)..(18): Xaa can be any naturally occurring amino acid
  misc_feature (20)..(20): Xaa can be any naturally occurring amino acid
  misc_feature (25)..(25): Xaa can be any naturally occurring amino acid
  misc_feature (36)..(36): Xaa can be any naturally occurring amino acid
XXXXXXXXDRXXXXXXXXIXNLIHXRGRNLYYRFDXSNKITLL

SEQ ID NO: 35007 - protein, 72 aa, Diabrotica virgifera
  misc_feature: Coding regions on vcDNA: vcDNA=SeqID_14704; Strand=-; Position=164-382
IVQLDIGNIYCIQGVPKRLVTNYTTHSGVKNSLIESNLPWYKCAHHKSYSPLKLQNENRFFSIYRKLLDIFY

SEQ ID NO: 35008 - protein, 46 aa, Diabrotica virgifera
  misc_feature: Coding regions on vcDNA: vcDNA=SeqID_14705; Strand=-; Position=1-138
  misc_feature (3)..(10): Xaa can be any naturally occurring amino acid
  misc_feature (12)..(21): Xaa can be any naturally occurring amino acid
  misc_feature (25)..(25): Xaa can be any naturally occurring amino acid
  misc_feature (37)..(44): Xaa can be any naturally occurring amino acid
FKXXXXXXXXSXXXXXXXXXXNINXIHIEGRNLYYRXXXXXXXXLL

SEQ ID NO: 35009 - protein, 41 aa, Diabrotica virgifera
  misc_feature: Coding regions on vcDNA: vcDNA=SeqID_14706; Strand=+; Position=1-123
  misc_feature (1)..(6): Xaa can be any naturally occurring amino acid
  misc_feature (12)..(40): Xaa can be any naturally occurring amino acid
XXXXXXAYIFLXXXXXXXXXXXXXXXXXXXXXXXXXXXXXG

SEQ ID NO: 35010 - protein, 53 aa, Diabrotica virgifera
  misc_feature: Coding regions on vcDNA: vcDNA=SeqID_14707; Strand=-; Position=2-160
  misc_feature (3)..(3): Xaa can be any naturally occurring amino acid
  misc_feature (11)..(18): Xaa can be any naturally occurring amino acid
  misc_feature (20)..(28): Xaa can be any naturally occurring amino acid
  misc_feature (39)..(52): Xaa can be any naturally occurring amino acid
NPXWLTPVLTXXXXXXXXEXXXXXXXXXNYKLNPRSRSXXXXXXXXXXXXXXV

SEQ ID NO: 35011 - protein, 149 aa, Diabrotica virgifera
  misc_feature: Coding regions on vcDNA: vcDNA=SeqID_14708; Strand=+; Position=454-900
  misc_feature: Homolog annotation: Hit_ID=XP_315123.1; Match level="QueryCoverage =95%, HitCoverage=62%, E-value=1e-37, Identity=53%"; Hit description =ENSANGP00000015228 [Anopheles gambiae]
  misc_feature: Gene Ontology Annotation: Molecular function=DNA binding; Cellular component=nucleus; Biological process=mRNA metabolism
  misc_feature: Pfam annotation: Pfam_ID=KH_1; Match level="Score=103.1, E-value=6.9e- 28, Copies=2"; Pfam description=KH domain
MKRGADGDMGSPQKRSRRGDEEVRLLIPSMVAGSIIGKGGSNITKLRSQYKASITVPDCPGPERILTLSSDMDSVCNIVQDVIPKLEAHGATTNGNELDLRMMIHQSQAGCVIGKGGSKIKEIREKTGARVQIYANVAPSSTDRVIQSQ

SEQ ID NO: 35012 - protein, 174 aa, Diabrotica virgifera
  misc_feature: Coding regions on vcDNA: vcDNA=SeqID_14709; Strand=+; Position=3-524
  misc_feature (95)..(102): Xaa can be any naturally occurring amino acid
IFSKTSEKMSEGDVVNTSEEVQENQEVVEESIAPVKSVKNVEAAPPNLFDIFKPKDAANADKDGAKPEDKPADGTKPADETKPADGTTEAKPNIXXXXXXXXEAVTKPEEPKPLFPANDPFNFKKNAEEAQKAFKEKGLGGWIATVQKNVQNQMTELSVAPEINRLKDKEWPEL

SEQ ID NO: 35013 - protein, 119 aa, Diabrotica virgifera; identical to SEQ ID NO: 29283
  misc_feature: Coding regions on vcDNA: vcDNA=SeqID_14710; Strand=+; Position=183-542
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 35014 - protein, 68 aa, Diabrotica virgifera
  misc_feature: Coding regions on vcDNA: vcDNA=SeqID_14711; Strand=-; Position=602-808
LACLYLNLSLSSILHTNQQFSSNLKWIYLLFKLSSKLFQHNHNQCFPYFLHSFFQNGNKIDKIIFEIL

SEQ ID NO: 35015 - protein, 225 aa, Diabrotica virgifera
  misc_feature: Coding regions on vcDNA: vcDNA=SeqID_14712; Strand=+; Position=59-736
  misc_feature: Homolog annotation: Hit_ID=XP_314994.1; Match level="QueryCoverage =76%, HitCoverage=71%, E-value=6e-47, Identity=52%"; Hit description =ENSANGP00000021352 [Anopheles gambiae]
  misc_feature: Pfam annotation: Pfam_ID=DUF1301; Match level="Score=183.9, E-value =3.4e-52, Copies=1"; Pfam description=Protein of unknown function (DUF1301)
MSIKSCIRVIPLLRNAINSHNSCLSRTINFTKSNIHRSTFSLYNKLDIRLYSTENKSESKEIYYGSLTPQIKAVKIFSLSSSVVGIIAQPFLYNEIASTGNVPVIVAAYTAIGFFTVVTPILLHLITKKYVTHLYYKPSTNSYIANNVNFFCLTKETEFTPEDVVVSEVPGMFTTFEAKGKALFVDPRLFEDPEHYAKIMGFDKPLDFKLYQTTDNIPSSSNKKD

SEQ ID NO: 35016 - protein, 88 aa, Diabrotica virgifera
  misc_feature: Coding regions on vcDNA: vcDNA=SeqID_14713; Strand=-; Position=2-265
VSLHTNSHSPSSINLTLTYIPIFIFFFNYSLYQYYNTISSSPHFPYPPLPQNSFTSPKNHKNPQNIPSFPNYHPFYQKDQTHFLHPYP

SEQ ID NO: 35017 - protein, 28 aa, Diabrotica virgifera
  misc_feature: Coding regions on vcDNA: vcDNA=SeqID_14714; Strand=+; Position=1-84
  misc_feature (6)..(6): Xaa can be any naturally occurring amino acid
  misc_feature (9)..(27): Xaa can be any naturally occurring amino acid
VTKLTXFYXXXXXXXXXXXXXXXXXXXL

SEQ ID NO: 35018 - protein, 19 aa, Diabrotica virgifera
  misc_feature: Coding regions on vcDNA: vcDNA=SeqID_14715; Strand=-; Position=1-57
  misc_feature (3)..(3): Xaa can be any naturally occurring amino acid
  misc_feature (5)..(17): Xaa can be any naturally occurring amino acid
LIXLXXXXXXXXXXXXXSF

SEQ ID NO: 35019 - protein, 278 aa, Diabrotica virgifera
  misc_feature: Coding regions on vcDNA: vcDNA=SeqID_14716; Strand=+; Position=3-836
  misc_feature: Homolog annotation: Hit_ID=XP_543445.1; Match level="QueryCoverage =94%, HitCoverage=26%, E-value=4e-28, Identity=28%"; Hit description =PREDICTED: similar to squamous cell carcinoma antigen recognized by T cells 3 [Canis familiaris]
  misc_feature (73)..(82): Xaa can be any naturally occurring amino acid
DSAELYDIYKEYIKEVKDTSTVLCLYERAILPLCLTPLLWEDYIKYCFKLKEVVLKVGTRAIRNCTWSEPLWXXXXXXXXXXKSDEKEIMECFEQGVINISPSPPLEFWFSFLEYYHRNSDDQKKLDKLFSQTVQQIGHENDPTYKVSRWHARLLAKRGDMESARKVWNNIINDQQNKGSVNAWLEYANLEKQYGEVNQVRNIFKRALFACKDWPQYIADEWLMLERESGTLEDIMKCEEKCKIVLRTASYTQKNLDVQYKRKRKSEEEPSRMGSNAD

SEQ ID NO: 35020 - protein, 301 aa, Diabrotica virgifera
  misc_feature: Coding regions on vcDNA: vcDNA=SeqID_14717; Strand=-; Position=2-904
  misc_feature (4)..(297): Xaa can be any naturally occurring amino acid
LYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLR

SEQ ID NO: 35021 - protein, 257 aa, Diabrotica virgifera
  misc_feature: Coding regions on vcDNA: vcDNA=SeqID_14718; Strand=-; Position=1-774
  misc_feature (5)..(14): Xaa can be any naturally occurring amino acid
  misc_feature (29)..(221): Xaa can be any naturally occurring amino acid
  misc_feature (223)..(257): Xaa can be any naturally occurring amino acid
RVCSXXXXXXXXXXHNKMLYKLNEDSLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXX

SEQ ID NO: 35022 - protein, 76 aa, Diabrotica virgifera
  misc_feature: Coding regions on vcDNA: vcDNA=SeqID_14719; Strand=-; Position=188-418
  misc_feature (42)..(53): Xaa can be any naturally occurring amino acid
  misc_feature (67)..(75): Xaa can be any naturally occurring amino acid
ITTTISNHNLYLELHPYRKKILSKSRRYNLYAYYIHIPTYVXXXXXXXXXXXXHSPQKIPEKHFFPXXXXXXXXXQ

SEQ ID NO: 35023 - protein, 67 aa, Diabrotica virgifera
  misc_feature: Coding regions on vcDNA: vcDNA=SeqID_14720; Strand=-; Position=70-273
FTCDNVLLSSPIIMSTFHIHQNSFYSWKEYNSNIHICIYSVTLTLYARASQDTFKVITNSVCTCITN

SEQ ID NO: 35024 - protein, 159 aa, Diabrotica virgifera
  misc_feature: Coding regions on vcDNA: vcDNA=SeqID_14721; Strand=+; Position=1-477
  misc_feature: Homolog annotation: Hit_ID=EAA05214.2; Match level="QueryCoverage =97%, HitCoverage=26%, E-value=3e-69, Identity=82%"; Hit description =ENSANGP00000015653 [Anopheles gambiae str. PEST] ref|XP_564225.1| ENSANGP00000015653 [Anopheles gambiae st
  misc_feature: Gene Ontology Annotation: Molecular function=protein binding; Cellular component=intracellular; Biological process=cell adhesion
PTRPEIKELVTGVIWNMSSCEDLKRNIIDDGVITIVTFIIIPHSGWDSQGNHGETCWSTVFRNASGVLRNVSSAGEYARKKLRECEGLVDALLFVVRCAIDKSNIGNKIVENSVCILRNLSYRCQEVEDPNYDKNPLPTQTRVAATSSKGENLGCFGGS

SEQ ID NO: 35025 - protein, 93 aa, Diabrotica virgifera
  misc_feature: Coding regions on vcDNA: vcDNA=SeqID_14722; Strand=+; Position=237-518
IFCVIFMLKRLYIIMKSTTLILNHLSCVDRISNGHQSNFFSFLKHPVRNYHFIPLLSIKRLVSTTQVDRNNNSDVSTIAAGYFKNTCCKSPYH

SEQ ID NO: 35026 - protein, 68 aa, Diabrotica virgifera
  misc_feature: Coding regions on vcDNA: vcDNA=SeqID_14723; Strand=-; Position=258-464
  misc_feature (26)..(32): Xaa can be any naturally occurring amino acid
NENLGKYNHFPQKYFPYKKAIFLFAXXXXXXXLMFNLFHLNYMQELHKTRTTFLLAHINTNFNSYCIQ

SEQ ID NO: 35027 - protein, 34 aa, Diabrotica virgifera; identical to SEQ ID NO: 27603
  misc_feature: Coding regions on vcDNA: vcDNA=SeqID_14724; Strand=-; Position=80-184

SEQ ID NO: 35028 - protein, 32 aa, Diabrotica virgifera
  misc_feature: Coding regions on vcDNA: vcDNA=SeqID_14725; Strand=+; Position=3-98
  misc_feature (1)..(7): Xaa can be any naturally occurring amino acid
XXXXXXXLTYIKCQSFLFIFIDTIIMLRKLLL

SEQ ID NO: 35029 - protein, 117 aa, Diabrotica virgifera
  misc_feature: Coding regions on vcDNA: vcDNA=SeqID_14726; Strand=+; Position=275-625
  misc_feature: Homolog annotation: Hit_ID=AAR19394.1; Match level="QueryCoverage =79%, HitCoverage=45%, E-value=2e-15, Identity=54%"; Hit description =modified lacZ' [Cloning vector pTA6]
  misc_feature (14)..(20): Xaa can be any naturally occurring amino acid
  misc_feature (22)..(24): Xaa can be any naturally occurring amino acid
  misc_feature (26)..(26): Xaa can be any naturally occurring amino acid
  misc_feature (28)..(28): Xaa can be any naturally occurring amino acid
  misc_feature (30)..(30): Xaa can be any naturally occurring amino acid
  misc_feature (33)..(35): Xaa can be any naturally occurring amino acid
  misc_feature (37)..(39): Xaa can be any naturally occurring amino acid
  misc_feature (42)..(42): Xaa can be any naturally occurring amino acid
  misc_feature (53)..(53): Xaa can be any naturally occurring amino acid
  misc_feature (62)..(62): Xaa can be any naturally occurring amino acid
  misc_feature (64)..(64): Xaa can be any naturally occurring amino acid
  misc_feature (81)..(81): Xaa can be any naturally occurring amino acid
  misc_feature (99)..(99): Xaa can be any naturally occurring amino acid
  misc_feature (109)..(109): Xaa can be any naturally occurring amino acid
FSKIWERKKEKGKXXXXXXXKXXXAXGXKXEEXXXEXXXQQXRSRKGEGDAPXSGATSAAGXGXTRSETATQASAPAPAPXADHPAQPATDAGEPRPAXKRGRPPGGRXRAQRHRDP

SEQ ID NO: 35030 - protein, 119 aa, Diabrotica virgifera
  misc_feature: Coding regions on vcDNA: vcDNA=SeqID_14727; Strand=-; Position=460-819
  misc_feature (1)..(1): Xaa can be any naturally occurring amino acid
  misc_feature (91)..(98): Xaa can be any naturally occurring amino acid
XMIVHCKRKLDVYKVLPLVYSEVNMFNRRTLHSLNFTYKIIKTKTPKYLYNKLKFSNEMHRRNLRPTTLLRTPQHNRQIFKKIFSYIAPSXXXXXXXXNCNLSPITFKKKIKALLLNYQ

SEQ ID NO: 35031 - protein, 257 aa, Diabrotica virgifera
  misc_feature: Coding regions on vcDNA: vcDNA=SeqID_14728; Strand=+; Position=3-776
  misc_feature: Homolog annotation: Hit_ID=PC1123; Match level="QueryCoverage=92%, HitCoverage=36%, E-value=9e-48, Identity=38%"; Hit description =hypothetical protein - bloodfluke planorb (fragment)
  misc_feature: Pfam annotation: Pfam_ID=RVT_1; Match level="Score=139.7, E-value =6.9e-39, Copies=1"; Pfam description=Reverse transcriptase (RNA -dependent
  misc_feature (60)..(74): Xaa can be any naturally occurring amino acid
RIWLNNVFPTSWSDSIIIPILKPNNARTKISSYRPISLTNVMCKVMEKIVNKILLWILEXXXXXXXXXXXXXXXRTTTDNLIDLESEILESFANKQETIAVFIDITKAFDTAWRYDIIRSLHTWNIRGNIINFISNFLKQRNFQVRVNHCTSSIRLQANGTPQGSVISATLFLIAINNIIASNSSLVHGRLYADDLVLVSSGKNISSVQRHLQTSLHELENWSKKTGFSFHSANRSVCYFSRNVIRINRNYNNVNQS

SEQ ID NO: 35032 - protein, 123 aa, Diabrotica virgifera
  misc_feature: Coding regions on vcDNA: vcDNA=SeqID_14729; Strand=+; Position=560-931
  misc_feature: Homolog annotation: Hit_ID=NP_733220.1; Match level="QueryCoverage =99%, HitCoverage=23%, E-value=1e-44, Identity=77%"; Hit description =CG5643-PG, isoform G [Drosophila melanogaster] ref|NP_733219.1| CG5643-PF, isoform F [Drosophila
  misc_feature: Gene Ontology Annotation: Molecular function=protein phosphatase type 2A, intrinsic regulator activity; Cellular component=cytoplasm; Biological process=neurogenesis
  misc_feature (46)..(46): Xaa can be any naturally occurring amino acid
  misc_feature (89)..(89): Xaa can be any naturally occurring amino acid
  misc_feature (96)..(96): Xaa can be any naturally occurring amino acid
  misc_feature (99)..(99): Xaa can be any naturally occurring amino acid
  misc_feature (111)..(111): Xaa can be any naturally occurring amino acid
  misc_feature (116)..(116): Xaa can be any naturally occurring amino acid
MSATTFVDRIDPFAKRSLKKKTKKSQGSSRYRNSQDVELQPLPLLXDVPASEQEELFIRKLRQCCVAFDFMDPVADLKGKEVKRCTLKXLVDYITXRRXVLTEPVYPEIIXMISAXPIRTLPS

SEQ ID NO: 35033 - protein, 266 aa, Diabrotica virgifera
  misc_feature: Coding regions on vcDNA: vcDNA=SeqID_14730; Strand=+; Position=106-906
  misc_feature: Homolog annotation: Hit_ID=AAT38514.1; Match level="QueryCoverage =97%, HitCoverage=51%, E-value=8e-55, Identity=39%"; Hit description =antennae-rich cytochrome P450 [Phyllopertha diversa]
MIFFNWNTLFLFGLVVYLLYKYLTRNHNYWKEKGVPYEEPYFLAGNFWDVFSGKRQIGKHLGYLYSKYNTPYFGIYILGKPYLVLRNPEIIKNITIRDFKNFDDRTFACDKNADDMAANSLFIMRNPDWKYIRAKLTPIFTSGKLKLMLGIMKDAAKEMQNYLSQCDNKIVEIKDVSSKFLTDIVASCFFGYEVKCFRNDQSDFVHFTKNLFSHKVALLPFFRLFSYFFVPTFVSLFKLNFLDNALLKKIIIDTLLYRETNNIKET

SEQ ID NO: 35034 - protein, 32 aa, Diabrotica virgifera
  misc_feature: Coding regions on vcDNA: vcDNA=SeqID_14731; Strand=-; Position=2-97
EKYNLFKTIVQCSYNNQTVLNLSFLSNRHVNC

SEQ ID NO: 35035 - protein, 114 aa, Diabrotica virgifera
  misc_feature: Coding regions on vcDNA: vcDNA=SeqID_14732; Strand=+; Position=69-411
  misc_feature: Homolog annotation: Hit_ID=AAL67868.1; Match level="QueryCoverage =76%, HitCoverage=15%, E-value=8e-11, Identity=48%"; Hit description =NADH dehydrogenase subunit 5 [Crioceris duodecimpunctata] ref|NP _569067.1| NADH dehydrogenase subunit 5
  misc_feature (2)..(20): Xaa can be any naturally occurring amino acid
  misc_feature (27)..(36): Xaa can be any naturally occurring amino acid
  misc_feature (42)..(50): Xaa can be any naturally occurring amino acid
  misc_feature (60)..(60): Xaa can be any naturally occurring amino acid
  misc_feature (82)..(82): Xaa can be any naturally occurring amino acid
IXXXXXXXXXXXXXXXXXXXEEYIRGXXXXXXXXXXVVIFVXXXXXXXXXPNLISILLCXDGLGLDSYGLEINYQYLTRVNXGILSALSNRRVDVDLLICICMNMKFCEVDHDM

SEQ ID NO: 35036 - protein, 283 aa, Diabrotica virgifera
  misc_feature: Coding regions on vcDNA: vcDNA=SeqID_14733; Strand=+; Position=1-849
  misc_feature: Homolog annotation: Hit_ID=XP_395212.1; Match level="QueryCoverage =100%, HitCoverage=67%, E-value=1e-121, Identity=30%"; Hit description=similar to ENSANGP00000012507 [Apis mellifera]
  misc_feature: Gene Ontology Annotation: Molecular function=microtubule binding; Cellular component=plasma membrane; Biological process=neuromuscular synaptic transmission
  misc_feature: Pfam annotation: Pfam_ID=Spectrin; Match level="Score=172.8, E-value =7.2e-49, Copies=2"; Pfam description=Spectrin repeat
  misc_feature (90)..(97): Xaa can be any naturally occurring amino acid
  misc_feature (153)..(160): Xaa can be any naturally occurring amino acid
ENVLRLWNYLLELLKARRIRLDISLQLQQNFQEMLHILDAMEELKQRLLTDDYGKHLMGVEDLLQKHNLLEADINILGDRVKAVASQSQXXXXXXXXEGYRPCDPALVLERVQQLEEAYAQLVRLAVERRTRLEESKRLWQFYWDMADEDNWXXXXXXXXSTSDIGHDLTTVNLLLSKHKILENELSSHESQLEAALGVGEELINGGHFGAEKIQERLNEIRDAWKHLLDLAAYRRKRLEEAVDYHQLFADADDIDIWMLDTLRLVSSEDVGQNEGYAQSLLK

SEQ ID NO: 35037 - protein, 95 aa, Diabrotica virgifera
  misc_feature: Coding regions on vcDNA: vcDNA=SeqID_14734; Strand=-; Position=0-284
  misc_feature (6)..(15): Xaa can be any naturally occurring amino acid
  misc_feature (20)..(73): Xaa can be any naturally occurring amino acid
  misc_feature (75)..(89): Xaa can be any naturally occurring amino acid
KKFRCXXXXXXXXXXKKLVXXXXXXXXXXXXXXXXXXXXXXXXXXXXXXXXXXXXXXXXXXXXXXXXXXXXXXFXXXXXXXXXXXXXXXFLHPTP

SEQ ID NO: 35038 - protein, 141 aa, Diabrotica virgifera
  misc_feature: Coding regions on vcDNA: vcDNA=SeqID_14735; Strand=+; Position=15-440
  misc_feature: Homolog annotation: Hit_ID=XP_312083.1; Match level="QueryCoverage =84%, HitCoverage=11%, E-value=1e-29, Identity=52%"; Hit description =ENSANGP00000016878 [Anopheles gambiae]
  misc_feature: Gene Ontology Annotation: Molecular function=formate-tetrahydrofolate ligase activity; Cellular component=cytoplasm; Biological process =purine base biosynthesis
  misc_feature (34)..(45): Xaa can be any naturally occurring amino acid
DTPLAPQYTEENLDLLRKGLPNILKHVSNAVKYXXXXXXXXXXXXTDTEAELELLRQACKNSGAFDAVVSKHWTQGGQGALDLAKAVVEATSQPRNFKFLYHLNRPIKDKIAIIGEEMHGAAGGCYIVWAADIKEHDETVY

SEQ ID NO: 35039 - protein, 48 aa, Diabrotica virgifera
  misc_feature: Coding regions on vcDNA: vcDNA=SeqID_14736; Strand=+; Position=3-149
LDLVKYHFSTTKEKFNLMVSNYDCERIFEFNTRQFYECVPCETWIIRE

SEQ ID NO: 35040 - protein, 82 aa, Diabrotica virgifera
  misc_feature: Coding regions on vcDNA: vcDNA=SeqID_14737; Strand=+; Position=342-590
  misc_feature (13)..(19): Xaa can be any naturally occurring amino acid
  misc_feature (52)..(59): Xaa can be any naturally occurring amino acid
YILLGRNLSRKMXXXXXXXINCIIRNFHNMKYVIIYVYILLFLFNIMLLLGXXXXXXXXLTDDLINIDKMHIWETDIGLIKA

SEQ ID NO: 35041 - protein, 66 aa, Diabrotica virgifera
  misc_feature: Coding regions on vcDNA: vcDNA=SeqID_14738; Strand=+; Position=3-200
  misc_feature (1)..(24): Xaa can be any naturally occurring amino acid
  misc_feature (31)..(57): Xaa can be any naturally occurring amino acid
XXXXXXXXXXXXXXXXXXXXXXXXKLTFFYXXXXXXXXXXXXXXXXXXXXXXXXXXXLTRGDYKIN

SEQ ID NO: 35042 - protein, 34 aa, Diabrotica virgifera; identical to SEQ ID NO: 27603
  misc_feature: Coding regions on vcDNA: vcDNA=SeqID_14739; Strand=-; Position=80-184

SEQ ID NO: 35043 - protein, 223 aa, Diabrotica virgifera
  misc_feature: Coding regions on vcDNA: vcDNA=SeqID_14740; Strand=+; Position=3-674
  misc_feature (212)..(220): Xaa can be any naturally occurring amino acid
YKCSTYKFVKLDVLFSMAANKDSAEHVPSPVTEAPIIKKSVRQKKVMDNFDDMVKDSTKPIKNVDDRNNQTTDSAEHVTSSDINAPITQQPVRQEKVMDNTDDMAKESKKQVKSVDDRNNPTACPAEHNPSSDIEAPIIHQPVHQEKVMDNSDDMVKDSAKQTKRVDDRNEQTMNNQSVIYVRIGQSRCEQTLILGALFLECGLLTCMLCGXXXXXXXXXNHC

SEQ ID NO: 35044 - protein, 24 aa, Diabrotica virgifera
  misc_feature: Coding regions on vcDNA: vcDNA=SeqID_14741; Strand=-; Position=1-72
  misc_feature (1)..(5): Xaa can be any naturally occurring amino acid
  misc_feature (7)..(23): Xaa can be any naturally occurring amino acid
XXXXXEXXXXXXXXXXXXXXXXXE

SEQ ID NO: 35045 - protein, 53 aa, Diabrotica virgifera
  misc_feature: Coding regions on vcDNA: vcDNA=SeqID_14742; Strand=-; Position=0-158
  misc_feature (4)..(18): Xaa can be any naturally occurring amino acid
  misc_feature (20)..(51): Xaa can be any naturally occurring amino acid
GSKXXXXXXXXXXXXXXXTXXXXXXXXXXXXXXXXXXXXXXXXXXXXXXXXEL

SEQ ID NO: 35046 - protein, 279 aa, Diabrotica virgifera
  misc_feature: Coding regions on vcDNA: vcDNA=SeqID_14743; Strand=-; Position=2-838
  misc_feature (5)..(29): Xaa can be any naturally occurring amino acid
  misc_feature (56)..(56): Xaa can be any naturally occurring amino acid
  misc_feature (66)..(75): Xaa can be any naturally occurring amino acid
  misc_feature (77)..(229): Xaa can be any naturally occurring amino acid
  misc_feature (232)..(245): Xaa can be any naturally occurring amino acid
  misc_feature (248)..(248): Xaa can be any naturally occurring amino acid
  misc_feature (251)..(251): Xaa can be any naturally occurring amino acid
  misc_feature (253)..(253): Xaa can be any naturally occurring amino acid
  misc_feature (255)..(257): Xaa can be any naturally occurring amino acid
  misc_feature (261)..(261): Xaa can be any naturally occurring amino acid
  misc_feature (263)..(276): Xaa can be any naturally occurring amino acid
KNLTXXXXXXXXXXXXXXXXXXXXXXXXXLSIKKLIIILPYHHQNTPSIQINHSPXYTLYLIHKHXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHXXXXXXXXXXXXXXSLXLLXPXPXXXFFFXFXXXXXXXXXXXXXXPQL

SEQ ID NO: 35047 - protein, 167 aa, Diabrotica virgifera
  misc_feature: Coding regions on vcDNA: vcDNA=SeqID_14744; Strand=+; Position=1-504
  misc_feature (5)..(12): Xaa can be any naturally occurring amino acid
  misc_feature (40)..(40): Xaa can be any naturally occurring amino acid
  misc_feature (42)..(49): Xaa can be any naturally occurring amino acid
  misc_feature (65)..(87): Xaa can be any naturally occurring amino acid
  misc_feature (94)..(106): Xaa can be any naturally occurring amino acid
  misc_feature (110)..(127): Xaa can be any naturally occurring amino acid
  misc_feature (132)..(142): Xaa can be any naturally occurring amino acid
IIICXXXXXXXXHPLTCGLILLIQTIFTSVITGLINYNYXFXXXXXXXXVGGILILFIYITRIAXXXXXXXXXXXXXXXXXXXXXXXILRFILXXXXXXXXXXXXXMNNXXXXXXXXXXXXXXXXXXNNLIXXXXXXXXXXXLIAGVKITKFLYGPLRQKCYEKGIC

SEQ ID NO: 35048 - protein, 179 aa, Diabrotica virgifera
  misc_feature: Coding regions on vcDNA: vcDNA=SeqID_14745; Strand=+; Position=3-542
  misc_feature (2)..(16): Xaa can be any naturally occurring amino acid
  misc_feature (22)..(56): Xaa can be any naturally occurring amino acid
  misc_feature (60)..(149): Xaa can be any naturally occurring amino acid
  misc_feature (155)..(178): Xaa can be any naturally occurring amino acid
WXXXXXXXXXXXXXXXPGESGXXXXXXXXXXXXXXXXXXXXXXXXXXXXXXXXXXXKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDNIXXXXXXXXXXXXXXXXXXXXXXXXG

SEQ ID NO: 35049 - protein, 150 aa, Diabrotica virgifera
  misc_feature: Coding regions on vcDNA: vcDNA=SeqID_14746; Strand=+; Position=121-570
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (22)..(24): Xaa can be any naturally occurring amino acid
  misc_feature (27)..(29): Xaa can be any naturally occurring amino acid
  misc_feature (31)..(32): Xaa can be any naturally occurring amino acid
  misc_feature (35)..(35): Xaa can be any naturally occurring amino acid
  misc_feature (44)..(44): Xaa can be any naturally occurring amino acid
  misc_feature (60)..(60): Xaa can be any naturally occurring amino acid
  misc_feature (69)..(69): Xaa can be any naturally occurring amino acid
  misc_feature (77)..(77): Xaa can be any naturally occurring amino acid
  misc_feature (87)..(87): Xaa can be any naturally occurring amino acid
  misc_feature (97)..(97): Xaa can be any naturally occurring amino acid
  misc_feature (103)..(103): Xaa can be any naturally occurring amino acid
  misc_feature (121)..(121): Xaa can be any naturally occurring amino acid
RXRXDXATARGPQTKKPKQEKXXXNKXXXRXXGPXREEAGGQRXASRGQERDATANKPEXNTREQTQKXRTRRKPAXPSQQEQRSQXQRDKGRRQKXARRQAXTPRKASRRRTKRQGDGQXPRRNRTQQKGQGTAQEPRNWGRENGQRKK

SEQ ID NO: 35050 - protein, 95 aa, Diabrotica virgifera
  misc_feature: Coding regions on vcDNA: vcDNA=SeqID_14747; Strand=+; Position=392-679
YYLLILFLQTLSFMHLHRDIQRISAFLHLHKFLEQFLQVHGGTKSVLVGSKTKTFWGLLCLFSLLLNARFICNDDAVKELDPFLYGYHILAHLHA

SEQ ID NO: 35051 - protein, 69 aa, Diabrotica virgifera
  misc_feature: Coding regions on vcDNA: vcDNA=SeqID_14748; Strand=+; Position=9-218
  misc_feature (62)..(68): Xaa can be any naturally occurring amino acid
SYYFIYRMVLYFGVQEMKICFLLFYTTSNMYITTIRIPLKKSKLHITKQKPLSFTHYLLSKXXXXXXXE

SEQ ID NO: 35052 - protein, 286 aa, Diabrotica virgifera
  misc_feature: Coding regions on vcDNA: vcDNA=SeqID_14749; Strand=-; Position=1-858
  misc_feature (3)..(286): Xaa can be any naturally occurring amino acid
SPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35053 - protein, 231 aa, Diabrotica virgifera
  misc_feature: Coding regions on vcDNA: vcDNA=SeqID_14750; Strand=+; Position=46-741
  misc_feature: Homolog annotation: Hit_ID=CAG02151.1; Match level="QueryCoverage =92%, HitCoverage=95%, E-value=2e-61, Identity=51%"; Hit description =unnamed protein product [Tetraodon nigroviridis]
  misc_feature: Gene Ontology Annotation: Molecular function=ligase activity; Cellular component=cellular_component unknown; Biological process =coenzymes and prosthetic group metabolism
  misc_feature: Pfam annotation: Pfam_ID=BPL_LipA_LipB; Match level="Score=90.3, E -value=5.2e-24, Copies=1"; Pfam description=Biotin/lipoate A/B protein ligase fami
MGRQLVKLLKVGKIKYGCGLHLQQHFVQLHKTTTENQNTLIIVEHPHVYTTGIRDKNYSQSEEENLKHKGAEFYRTNRGGLITYHGPGQLVAYPILNLHNFNPRIHWYIDKIEKTILNLCKKFKLEAELLGDRGVWIKDKKICSVGLHGSRYITSHGFALNCNPDLSWFDHIVPCGIEGKGVTSLSQELGREVTVAETIPVLLESFKEIFEVDLIDYPEEEADCLQKTFVK

SEQ ID NO: 35054 - protein, 102 aa, Diabrotica virgifera
  misc_feature: Coding regions on vcDNA: vcDNA=SeqID_14751; Strand=+; Position=399-704
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLXSLF

SEQ ID NO: 35055 - protein, 34 aa, Diabrotica virgifera
  misc_feature: Coding regions on vcDNA: vcDNA=SeqID_14752; Strand=+; Position=12-116
FYWRDQIDNKDCDLDVGLKLIIGVEAILLSLLDC

SEQ ID NO: 35056 - protein, 48 aa, Diabrotica virgifera
  misc_feature: Coding regions on vcDNA: vcDNA=SeqID_14753; Strand=-; Position=1-144
  misc_feature (6)..(48): Xaa can be any naturally occurring amino acid
QKIIDXXXXXXXXXXXXXXXXXXXXXXXXXXXXXXXXXXXXXXXXXXX

SEQ ID NO: 35057 - protein, 57 aa, Diabrotica virgifera
  misc_feature: Coding regions on vcDNA: vcDNA=SeqID_14754; Strand=+; Position=3-176
  misc_feature (18)..(22): Xaa can be any naturally occurring amino acid
NFRLVISSISSNYILFKXXXXXLEHRSLKMAKESAGKIGNGAVTTYVLLYNGIQTLS

SEQ ID NO: 35058 - protein, 83 aa, Diabrotica virgifera
  misc_feature: Coding regions on vcDNA: vcDNA=SeqID_14755; Strand=+; Position=564-812
  misc_feature (6)..(25): Xaa can be any naturally occurring amino acid
QARTGXXXXXXXXXXXXXXXXXXXXRELELFEDGPCNRFFFKYLQNTGAYIKIFRGGADVKMLHIYSGLISKIHGKVIYRQFC

SEQ ID NO: 35059 - protein, 279 aa, Diabrotica virgifera
  misc_feature: Coding regions on vcDNA: vcDNA=SeqID_14756; Strand=+; Position=58-894
  misc_feature: Homolog annotation: Hit_ID=NP_608540.1; Match level="QueryCoverage =92%, HitCoverage=30%, E-value=3e-09, Identity=19%"; Hit description =CG2839-PA [Drosophila melanogaster] gb|AAF51469.2| CG2839-PA [Drosophila melanogaster]
  misc_feature (3)..(3): Xaa can be any naturally occurring amino acid
  misc_feature (11)..(11): Xaa can be any naturally occurring amino acid
  misc_feature (29)..(29): Xaa can be any naturally occurring amino acid
MQXSRREQEHXKGHKEKNIQDNKKQDDQXHRSSNEDWSERPEKVREEKVVDKYEKERERDRPQRPDSRDSRDSRSTRHSRDSEPREYNMGSWSESMYEHPYEDKRKDYSREERRSVPGPITKDRMEADDMRNEKRNLTQLKRGQVVEVKSEIKKELPTKVIPLKMEFASAWADAQPLALEEAESKMTEDKRQSESKVEIKSPEQSKKSDKTDDYNQNRNRSYGQKKGWNTNDNHSSRGPPWPRRPSSRGQKPGGRNQDYHTADSDGSLDDHSGDFKSGR

SEQ ID NO: 35060 - protein, 38 aa, Diabrotica virgifera
  misc_feature: Coding regions on vcDNA: vcDNA=SeqID_14757; Strand=+; Position=1-114
  misc_feature (1)..(32): Xaa can be any naturally occurring amino acid
XXXXXXXXXXXXXXXXXXXXXXXXXXXXXXXXARDFDR

SEQ ID NO: 35061 - protein, 127 aa, Diabrotica virgifera
  misc_feature: Coding regions on vcDNA: vcDNA=SeqID_14758; Strand=+; Position=3-386
  misc_feature (4)..(110): Xaa can be any naturally occurring amino acid
IRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFINSLVKNKLHLVKLY

SEQ ID NO: 35062 - protein, 33 aa, Diabrotica virgifera
  misc_feature: Coding regions on vcDNA: vcDNA=SeqID_14759; Strand=-; Position=1-99
  misc_feature (10)..(33): Xaa can be any naturally occurring amino acid
NKNSAVIPKXXXXXXXXXXXXXXXXXXXXXXXX

SEQ ID NO: 35063 - protein, 67 aa, Diabrotica virgifera
  misc_feature: Coding regions on vcDNA: vcDNA=SeqID_14760; Strand=+; Position=85-288
MSRSTDDICVIDFLIVCSHRNIYKLLYAIYFVNYYDYRGSVSMISCHALNDANERQLSIPYPRYPHV

SEQ ID NO: 35064 - protein, 83 aa, Diabrotica virgifera
  misc_feature: Coding regions on vcDNA: vcDNA=SeqID_14761; Strand=-; Position=1-249
  misc_feature (3)..(83): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35065 - protein, 55 aa, Diabrotica virgifera
  misc_feature: Coding regions on vcDNA: vcDNA=SeqID_14762; Strand=+; Position=1-165
  misc_feature (1)..(31): Xaa can be any naturally occurring amino acid
  misc_feature (42)..(51): Xaa can be any naturally occurring amino acid
XXXXXXXXXXXXXXXXXXXXXXXXXXXXXXXIKIRTQNFHIXXXXXXXXXXLLLL

SEQ ID NO: 35066 - protein, 102 aa, Diabrotica virgifera
  misc_feature: Coding regions on vcDNA: vcDNA=SeqID_14763; Strand=-; Position=63-371
  misc_feature (41)..(46): Xaa can be any naturally occurring amino acid
KYIVLWSSLVIEKLSVGPEILSIYASVNDSSPHKLFLAVSXXXXXXSCRCCIKSENDYCRTTSLVCQDTQVPRASSLVHSKSTFMSDTLFAYPARFSMVTFT

SEQ ID NO: 35067 - protein, 271 aa, Diabrotica virgifera
  misc_feature: Coding regions on vcDNA: vcDNA=SeqID_14764; Strand=+; Position=90-902
  misc_feature: Homolog annotation: Hit_ID=NP_861421.1; Match level="QueryCoverage =88%, HitCoverage=61%, E-value=4e-61, Identity=40%"; Hit description =zinc finger protein 233 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=189.8, E-value =5.7e-54, Copies=7"; Pfam description=Zinc finger, C2H2 type
  misc_feature (76)..(83): Xaa can be any naturally occurring amino acid
  misc_feature (250)..(250): Xaa can be any naturally occurring amino acid
  misc_feature (264)..(264): Xaa can be any naturally occurring amino acid
MEVKTEVKEEFIECDKRLVVLLSTEIDLGELKYELPNNSEETSVSHKDYVESSNTEKHMNAQTHSGRKIYKCEICXXXXXXXXSLNYHMCIHTGQKPFKCEICPKQFTRKQLLGYHMTVHSGEKQHQCEICYKRFNRKTDLNVHVRVHTGERPHKCKMCLKQFAQGITLKKHMRVHTGEMPYKCEICLKQFARKDSVKEHMKVHTGERPYKCEICLKQFSIKKTLNEHMRVHTGEKPHKCEICLKQFAVXKQLTRHIRVHTEEXPYKCEFC

SEQ ID NO: 35068 - protein, 218 aa, Diabrotica virgifera
  misc_feature: Coding regions on vcDNA: vcDNA=SeqID_14765; Strand=+; Position=161-815
  misc_feature: Homolog annotation: Hit_ID=CAA30094.1; Match level="QueryCoverage =99%, HitCoverage=48%, E-value=2e-60, Identity=57%"; Hit description =unnamed protein product [Xenopus laevis] pir||S00253 tubulin alpha chain - African clawed frog sp|P08537|T
  misc_feature: Gene Ontology Annotation: Molecular function=GTP binding; Cellular component=microtubule; Biological process=microtubule-based process
  misc_feature: Pfam annotation: Pfam_ID=Tubulin; Match level="Score=36.9, E-value =3.8e-09, Copies=1"; Pfam description=Tubulin/FtsZ family, GTPase domain
  misc_feature (90)..(90): Xaa can be any naturally occurring amino acid
  misc_feature (145)..(145): Xaa can be any naturally occurring amino acid
  misc_feature (160)..(160): Xaa can be any naturally occurring amino acid
  misc_feature (177)..(177): Xaa can be any naturally occurring amino acid
NCLQPDIQTDSHMTADKTDERGDDFFNTFVTETDAPKHVPIELFANLEPTVLNETHTETYRPLLLPKQLINANKNDANNYDTGHYTIGNXILDLILNIIHKWTDLCTVLLGLLIFHSFGAGTASVFTSLLTEHQSDDYEMKSKHXFAIYPSTHVSTAEEXPYTSILTTHTTHEHSNXDYMVDNDISYDIRKLNLHIYRTTYTISDRLTAPITSSLTSS

SEQ ID NO: 35069 - protein, 59 aa, Diabrotica virgifera
  misc_feature: Coding regions on vcDNA: vcDNA=SeqID_14766; Strand=+; Position=141-320
IFVILQPSMRPFIYHDLVSSSIPTTCSSKSDAGSDGELVFTHCVQRCFHLLSQLSSDIS

SEQ ID NO: 35070 - protein, 68 aa, Diabrotica virgifera
  misc_feature: Coding regions on vcDNA: vcDNA=SeqID_14767; Strand=-; Position=68-274
  misc_feature (4)..(10): Xaa can be any naturally occurring amino acid
LWVXXXXXXXSDLLTHSNISSRGSLYISQPVLSFLSLAYDGRRLSVCVVPLLPPLGRYAHTRTTDKDS

SEQ ID NO: 35071 - protein, 92 aa, Diabrotica virgifera
  misc_feature: Coding regions on vcDNA: vcDNA=SeqID_14768; Strand=-; Position=388-666
LIIYRNNLKNRKQILSKGLNQLLRELKIIWFKPRLKPQIEVEIQASKLKQRLKVSFGLSEVGNTGPNSQWTLVGHEIALATGGRQIVFLVLD

SEQ ID NO: 35072 - protein, 298 aa, Diabrotica virgifera
  misc_feature: Coding regions on vcDNA: vcDNA=SeqID_14769; Strand=-; Position=2-895
  misc_feature (1)..(265): Xaa can be any naturally occurring amino acid
  misc_feature (287)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCSTFKILHDLSLNRCEPGWFLXXXXXXXFGPFV

SEQ ID NO: 35073 - protein, 75 aa, Diabrotica virgifera
  misc_feature: Coding regions on vcDNA: vcDNA=SeqID_14770; Strand=-; Position=602-829
  misc_feature (27)..(27): Xaa can be any naturally occurring amino acid
CLDLLLLLSNSPVISIIHLWLCSCKYXNSKTTLCSSVTYLSTCPGEIKLGLFIAQKNVNFRTLSMKRDLIKLPKL

SEQ ID NO: 35074 - protein, 257 aa, Diabrotica virgifera
  misc_feature: Coding regions on vcDNA: vcDNA=SeqID_14771; Strand=+; Position=3-777
  misc_feature: Homolog annotation: Hit_ID=NP_476739.1; Match level="QueryCoverage =91%, HitCoverage=83%, E-value=7e-99, Identity=31%"; Hit description =CG1977-PA [Drosophila melanogaster] gb|AAF47569.1| CG1977-PA [Drosophila melanogaster]
  misc_feature: Gene Ontology Annotation: Molecular function=actin binding; Cellular component=plasma membrane; Biological process=neuromuscular synaptic transmission
  misc_feature: Pfam annotation: Pfam_ID=Spectrin; Match level="Score=216.8, E-value =4.2e-62, Copies=2"; Pfam description=Spectrin repeat
  misc_feature (207)..(207): Xaa can be any naturally occurring amino acid
MLESDKRSLISLWDERRILYEQCMDLQVFYRDTEQADTWMAKQEAFLANEDLGDSLDSVEALIKKHEDFEKSLAAQEEKIKALDEFATKLIDGEHYAADDVAQRRAMLLERRKALKEKSSIRRETLEDAYKLQQFERDCDETKGWINEKLKFATDESYLDPTNLGGKVQKHQNFEQELNANKSRMEDITSTAQELIEADHYAAPRIXSRMKEIVEPLENLTQSTNNQTPIFQDSRHSTLPTYLSNLSCFSPFKLHPL

SEQ ID NO: 35075 - protein, 127 aa, Diabrotica virgifera
  misc_feature: Coding regions on vcDNA: vcDNA=SeqID_14772; Strand=-; Position=0-380
  misc_feature (3)..(90): Xaa can be any naturally occurring amino acid
  misc_feature (95)..(104): Xaa can be any naturally occurring amino acid
  misc_feature (117)..(126): Xaa can be any naturally occurring amino acid
SFXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLFPXXXXXXXXXXPLLLLPPFFSLFXXXXXXXXXXS

SEQ ID NO: 35076 - protein, 30 aa, Diabrotica virgifera
  misc_feature: Coding regions on vcDNA: vcDNA=SeqID_14773; Strand=-; Position=1-90
  misc_feature (27)..(28): Xaa can be any naturally occurring amino acid
  misc_feature (30)..(30): Xaa can be any naturally occurring amino acid
LAGGGPAVGVRRPPFSPPGFKGVPRCXXVX

SEQ ID NO: 35077 - protein, 71 aa, Diabrotica virgifera
  misc_feature: Coding regions on vcDNA: vcDNA=SeqID_14774; Strand=+; Position=299-511
LFVGMTSNTTRHANLIFTSHSRSKDCHIVDHAIINVYAISLSFSKSFVLRYRFQSFKLSNEETIEQLITVC

SEQ ID NO: 35078 - protein, 50 aa, Diabrotica virgifera
  misc_feature: Coding regions on vcDNA: vcDNA=SeqID_14775; Strand=-; Position=2-151
  misc_feature (3)..(12): Xaa can be any naturally occurring amino acid
STXXXXXXXXXXDIFVIIQEKLILKKTTILLRRFLKGLYFYSRYISGAKG

SEQ ID NO: 35079 - protein, 212 aa, Diabrotica virgifera
  misc_feature: Coding regions on vcDNA: vcDNA=SeqID_14776; Strand=-; Position=0-635
  misc_feature (2)..(75): Xaa can be any naturally occurring amino acid
  misc_feature (78)..(134): Xaa can be any naturally occurring amino acid
  misc_feature (136)..(208): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXLFXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXSSTS

SEQ ID NO: 35080 - protein, 46 aa, Diabrotica virgifera
  misc_feature: Coding regions on vcDNA: vcDNA=SeqID_14777; Strand=+; Position=6-146
SNFGKFLPLNSCFYIMRMVLYRISNLPTFNIFSKQVVTWTAHHTTF

SEQ ID NO: 35081 - protein, 50 aa, Diabrotica virgifera
  misc_feature: Coding regions on vcDNA: vcDNA=SeqID_14778; Strand=+; Position=128-280
TLHHTIGLNFENKRTSGPVPTMPLESPAPSRIIVQRETRSITRKSNTSDL

SEQ ID NO: 35082 - protein, 81 aa, Diabrotica virgifera
  misc_feature: Coding regions on vcDNA: vcDNA=SeqID_14779; Strand=-; Position=227-472
KKNECFSESTKFLDTIYSASFYSFGKVQYSIRIMGILKYGSVSTLDLPRSFSILGVQASLYKQYKKYPIFLIRARKILPII

SEQ ID NO: 35083 - protein, 156 aa, Diabrotica virgifera
  misc_feature: Coding regions on vcDNA: vcDNA=SeqID_14780; Strand=+; Position=515-982
  misc_feature: Homolog annotation: Hit_ID=AAG45420.1; Match level="QueryCoverage =96%, HitCoverage=63%, E-value=2e-29, Identity=47%"; Hit description =vegetative cell wall protein gp1 [Chlamydomonas reinhardtii] sp|Q9FPQ6|GP1_CHLRE Vegetative cell wall prot
  misc_feature: Gene Ontology Annotation: Molecular function=molecular_function unknown; Cellular component=extracellular space; Biological process =biological_process unknown
CCLLLSSPTILSSSLLPLLPPFPNNNSLFPTLPPTPQPPIPPPHNLNSPLTPSSPPSPPSSTSHTPPPPFPPLLPSPSPPTPPPPSLPSTTSPLTPSPPSFPSPSPSLPYPHPTLPSLSSSLLPPSHPLLSPYPPSLPHPPSSPSPSPPLLPPLPP

SEQ ID NO: 35084 - protein, 27 aa, Diabrotica virgifera
  misc_feature: Coding regions on vcDNA: vcDNA=SeqID_14781; Strand=-; Position=0-80
  misc_feature (17)..(26): Xaa can be any naturally occurring amino acid
ISVSFGVVCGKEGGLFXXXXXXXXXXG

SEQ ID NO: 35085 - protein, 97 aa, Diabrotica virgifera
  misc_feature: Coding regions on vcDNA: vcDNA=SeqID_14782; Strand=+; Position=85-375
NSNRLNNIAATPYKYFNPTSRQKSKISIRIIQKRYTDIPQVVHSYRPKSRSKDKLSTSFLNRDLQYSNHGSAFYKKRNAHTLGIEKSDAVHPVPLST

SEQ ID NO: 35086 - protein, 93 aa, Diabrotica virgifera
  misc_feature: Coding regions on vcDNA: vcDNA=SeqID_14783; Strand=+; Position=21-299
IGILIINFVVFTGPLSGRDHYLTTIKLLLSQFKTATVLTLLLHNKHLNELSLYRSVLPLDIGSRFSHETTPTQLLTIKLQLNLFILLIVHIFT

SEQ ID NO: 35087 - protein, 226 aa, Diabrotica virgifera
  misc_feature: Coding regions on vcDNA: vcDNA=SeqID_14784; Strand=+; Position=201-881
  misc_feature: Homolog annotation: Hit_ID=XP_314721.1; Match level="QueryCoverage =72%, HitCoverage=63%, E-value=1e-22, Identity=33%"; Hit description =ENSANGP00000013196 [Anopheles gambiae]
  misc_feature: Pfam annotation: Pfam_ID=Far-17a_AIG1; Match level="Score=74.3, E -value=3.3e-19, Copies=1"; Pfam description=FAR-17a/AIG1-like protein
MKYLNIIVVFIYIGLIVTDICAMVVRDRLNNNVNRPKGESFRIQKLYRYYFLTYWNFMLQIFFISLAVLDELSKLLSLPSKVQNLLSKVRAYIFNSLVFPCSTLVVFTFWSIWAVDRELIFPKVMDTFFPSWLNHVLHTFIAIPLVIEILLPKKDNFVQFKNAAPILLFYAGLYQTLYFSIYLRDGVWLYPIYKVLSIPQMVLFNIVQMLLILGFQYVSISSQIVK

SEQ ID NO: 35088 - protein, 239 aa, Diabrotica virgifera
  misc_feature: Coding regions on vcDNA: vcDNA=SeqID_14785; Strand=+; Position=112-831
  misc_feature: Homolog annotation: Hit_ID=AAO21506.1; Match level="QueryCoverage =89%, HitCoverage=46%, E-value=3e-41, Identity=42%"; Hit description =serpin 3b [Manduca sexta] gb|AAO21505.1| serpin 3a [Manduca sexta]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=-89.3, E-value =6.1e-07, Copies=1"; Pfam description=Serpin (serine protease inhibitor)
NINWTDIFDWRILKEYSPTYKNLLMSPISLRIILALLYQGSSGLTKREFESVMHFTDQQSAREEFRNILNKLQVAESPEYTLNLGTRVFLDIPVAPQQKFASIAKDFFKTELVLTNFTNKEEAGHTINSWAEQQTNGRIHKLIDPADLADALMVIANAVYFKGTWKYQFPFQTVDKFYVPDGNNFFSISARFMAVEDKFYFHESPLLDAKILRLPYKGGALTPWLYNYRTPKEVLPSLI

SEQ ID NO: 35089 - protein, 66 aa, Diabrotica virgifera; identical to SEQ ID NO: 26808
  misc_feature: Coding regions on vcDNA: vcDNA=SeqID_14786; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35090 - protein, 192 aa, Diabrotica virgifera
  misc_feature: Coding regions on vcDNA: vcDNA=SeqID_14787; Strand=+; Position=113-690
  misc_feature: Homolog annotation: Hit_ID=XP_392715.1; Match level="QueryCoverage =65%, HitCoverage=18%, E-value=4e-10, Identity=32%"; Hit description =similar to ENSANGP00000013083 [Apis mellifera]
  misc_feature: Gene Ontology Annotation: Molecular function=enzyme activator activity
  misc_feature (144)..(144): Xaa can be any naturally occurring amino acid
  misc_feature (175)..(175): Xaa can be any naturally occurring amino acid
LQALLEHFSQYRLRTGFSFDYFCLITDCKYDVCYALHIWIDAESYEIELRIYRELNTSNLCLILNLNTILSTHPTLTLYYYPDLLTGEPYDMIFFFEYELNLDRLNNKHVTYLENRMRIICAEPLIDFVTSKYSNLEWSYLTSXSAVITECLLKPPHLTFPVCTIMITPSESAHXIARDIYLFSQLFDQSPP

SEQ ID NO: 35091 - protein, 250 aa, Diabrotica virgifera
  misc_feature: Coding regions on vcDNA: vcDNA=SeqID_14788; Strand=+; Position=15-773
  misc_feature: Homolog annotation: Hit_ID=AAO32817.1; Match level="QueryCoverage =91%, HitCoverage=75%, E-value=1e-54, Identity=53%"; Hit description =ADP/ATP translocase [Bombyx mori]
  misc_feature: Gene Ontology Annotation: Molecular function=adenine transporter activity; Cellular component=integral to plasma membrane; Biological process=transport
  misc_feature (46)..(46): Xaa can be any naturally occurring amino acid
  misc_feature (57)..(57): Xaa can be any naturally occurring amino acid
  misc_feature (87)..(87): Xaa can be any naturally occurring amino acid
  misc_feature (91)..(91): Xaa can be any naturally occurring amino acid
  misc_feature (145)..(145): Xaa can be any naturally occurring amino acid
  misc_feature (151)..(151): Xaa can be any naturally occurring amino acid
  misc_feature (171)..(171): Xaa can be any naturally occurring amino acid
  misc_feature (186)..(186): Xaa can be any naturally occurring amino acid
  misc_feature (211)..(211): Xaa can be any naturally occurring amino acid
  misc_feature (242)..(248): Xaa can be any naturally occurring amino acid
KTITATPPYAFEKFLKEYEEVALADPIAFIKDLLTGRVSAPISKTXNLQIEHEKPIXQVQHISKRIALFQRYNCILYCFISITHQQXFVYXCGGNTINDFRYFPTQALMFDFKDKNKQIFLNIVDKKIQFWRYFLSNLHSAADAXYTSLCXVYPHDFDKTGLTTDVNKGVXLGEFSEMCNCLCKIXKLYALIRLYLSDLCVSVQAIIIYRXAFFNFYDTVKCILPDPMNTPLVHSSHIATDXXXXXXXIS

SEQ ID NO: 35092 - protein, 78 aa, Diabrotica virgifera
  misc_feature: Coding regions on vcDNA: vcDNA=SeqID_14789; Strand=-; Position=3-236
  misc_feature (2)..(13): Xaa can be any naturally occurring amino acid
  misc_feature (15)..(23): Xaa can be any naturally occurring amino acid
  misc_feature (41)..(41): Xaa can be any naturally occurring amino acid
  misc_feature (45)..(58): Xaa can be any naturally occurring amino acid
  misc_feature (65)..(77): Xaa can be any naturally occurring amino acid
YXXXXXXXXXXXXLXXXXXXXXXDRNQPGSHRFKLRSCKIXKVEXXXXXXXXXXXXXXSNIEVAXXXXXXXXXXXXXC

SEQ ID NO: 35093 - protein, 112 aa, Diabrotica virgifera
  misc_feature: Coding regions on vcDNA: vcDNA=SeqID_14790; Strand=+; Position=291-629
  misc_feature (5)..(23): Xaa can be any naturally occurring amino acid
  misc_feature (49)..(63): Xaa can be any naturally occurring amino acid
  misc_feature (83)..(88): Xaa can be any naturally occurring amino acid
VKFMXXXXXXXXXXXXXXXXXXXGLSLKNKILLPSNFYVTIRVTPFSYXXXXXXXXXXXXXXXFYKFFIIIRTYSIYIEDCCXXXXXXPCYLLHSHPVINRNPATSFFPCPI

SEQ ID NO: 35094 - protein, 52 aa, Diabrotica virgifera
  misc_feature: Coding regions on vcDNA: vcDNA=SeqID_14791; Strand=-; Position=2-157
  misc_feature (25)..(52): Xaa can be any naturally occurring amino acid
RGDHLINSKRHVSNNQVQKNVVGIXXXXXXXXXXXXXXXXXXXXXXXXXXXX

SEQ ID NO: 35095 - protein, 52 aa, Diabrotica virgifera
  misc_feature: Coding regions on vcDNA: vcDNA=SeqID_14792; Strand=-; Position=54-212
  misc_feature (5)..(11): Xaa can be any naturally occurring amino acid
SSQFXXXXXXXHYNKIEHSYYITSKNHFIFSLYNIYCHTTFHNFTYDLTHIH

SEQ ID NO: 35096 - protein, 42 aa, Diabrotica virgifera
  misc_feature: Coding regions on vcDNA: vcDNA=SeqID_14793; Strand=+; Position=2-130
YTLSGDDSLHSTRHAKQASSIHGVTVDSHLSILNRVLLITIV

SEQ ID NO: 35097 - protein, 23 aa, Diabrotica virgifera
  misc_feature: Coding regions on vcDNA: vcDNA=SeqID_14794; Strand=-; Position=1-69
  misc_feature (19)..(19): Xaa can be any naturally occurring amino acid
FLSSSPFTPIFGLKGVFFXPKTL

SEQ ID NO: 35098 - protein, 107 aa, Diabrotica virgifera
  misc_feature: Coding regions on vcDNA: vcDNA=SeqID_14795; Strand=+; Position=104-424
KLMSMCSLTSNITQRRITLTTINSPNTLLFTCHTHGELHFIAPLVKYTSSNLRRLFLLSNIIQATNIYSRHMPPPSPTRHPLTQHLIYYQDELQRDIYLTAPTRSAF

SEQ ID NO: 35099 - protein, 78 aa, Diabrotica virgifera
  misc_feature: Coding regions on vcDNA: vcDNA=SeqID_14796; Strand=+; Position=175-411
FIYPYSSSFVLWNLALTHTYLIFKETNDNFFFVRQLLYFLNIFNTIFTRWKMDCKKLCLSPYFYSRVPICNLRYLYRK

SEQ ID NO: 35100 - protein, 36 aa, Diabrotica virgifera
  misc_feature: Coding regions on vcDNA: vcDNA=SeqID_14797; Strand=-; Position=5-115
FEASRKYVEFHFFTPCAFWKMWLSFEPSQGQFHTRS

SEQ ID NO: 35101 - protein, 22 aa, Diabrotica virgifera
  misc_feature: Coding regions on vcDNA: vcDNA=SeqID_14798; Strand=+; Position=2-67
  misc_feature (1)..(5): Xaa can be any naturally occurring amino acid
XXXXXNNFNLFHFTNDDKISIK

SEQ ID NO: 35102 - protein, 132 aa, Diabrotica virgifera
  misc_feature: Coding regions on vcDNA: vcDNA=SeqID_14799; Strand=+; Position=99-497
  misc_feature: Homolog annotation: Hit_ID=CAH04325.1; Match level="QueryCoverage =93%, HitCoverage=77%, E-value=5e-11, Identity=38%"; Hit description =S10e ribosomal protein [Curculio glandium]
  misc_feature (61)..(61): Xaa can be any naturally occurring amino acid
  misc_feature (95)..(102): Xaa can be any naturally occurring amino acid
  misc_feature (111)..(111): Xaa can be any naturally occurring amino acid
FLTTLTCERATIPNHTVIKKLPSLKTKSHVECTILWRDNYRNQSHLGQQRPSLTLYPDPEXIDPSTLTRPATTETPRPRPAPPQTRYIETSSTAXXXXXXXXVDPEADKEXDVGPAIAEAEFRQRYSRGRIP

SEQ ID NO: 35103 - protein, 25 aa, Diabrotica virgifera
  misc_feature: Coding regions on vcDNA: vcDNA=SeqID_14800; Strand=-; Position=53-130
  misc_feature (10)..(18): Xaa can be any naturally occurring amino acid
VKLYILFKIXXXXXXXXXYLYNIIV

SEQ ID NO: 35104 - protein, 46 aa, Diabrotica virgifera
  misc_feature: Coding regions on vcDNA: vcDNA=SeqID_14801; Strand=-; Position=7-147
YNHRLPLVLHIKAVTIHHNIALPSQLIQFHYIKIFFPPKRGSPLII

SEQ ID NO: 35105 - protein, 106 aa, Diabrotica virgifera
  misc_feature: Coding regions on vcDNA: vcDNA=SeqID_14802; Strand=+; Position=236-557
  misc_feature: Homolog annotation: Hit_ID=XP_397415.1; Match level="QueryCoverage =90%, HitCoverage=53%, E-value=2e-16, Identity=46%"; Hit description =similar to CG3204-PA [Apis mellifera]
  misc_feature: Gene Ontology Annotation: Molecular function=GTPase activity; Cellular component=membrane; Biological process=signal transduction
  misc_feature (23)..(23): Xaa can be any naturally occurring amino acid
  misc_feature (42)..(42): Xaa can be any naturally occurring amino acid
  misc_feature (75)..(75): Xaa can be any naturally occurring amino acid
FIVSSCIGALTDPFVSVCTYVKXDPTLENFYRYKIEQLNPPXEMQFLDTAETEHFTRMHPLYTKNEQHFAEAKRXTNHLTYHNIRPLNHIINKDKGTHYFPILLDR

SEQ ID NO: 35106 - protein, 38 aa, Diabrotica virgifera
  misc_feature: Coding regions on vcDNA: vcDNA=SeqID_14803; Strand=+; Position=261-377
KGVQILINMTYLTKRISLIFKCPNKKHIVLSHYESIFY

SEQ ID NO: 35107 - protein, 225 aa, Diabrotica virgifera
  misc_feature: Coding regions on vcDNA: vcDNA=SeqID_14804; Strand=+; Position=166-843
  misc_feature: Homolog annotation: Hit_ID=XP_317624.1; Match level="QueryCoverage =82%, HitCoverage=45%, E-value=5e-58, Identity=60%"; Hit description =ENSANGP00000018433 [Anopheles gambiae] gb|EAA12921.1| ENSANGP00000018433 [Anopheles gambiae
  misc_feature: Pfam annotation: Pfam_ID=DAO; Match level="Score=58.7, E-value=1.6e -14, Copies=1"; Pfam description=FAD dependent oxidoreductase
  misc_feature (153)..(158): Xaa can be any naturally occurring amino acid
MSIILSEVAFLKSWKFPAKQLLHTRTFASSTLTQSQDSNNYDIAIVGGGIVGVATAREISNRNSKLRMAILEKEKTLANHQTGHNSGVVHAGIYYKPGSLKAKLCVEGLQLSYKYFDSKNIPYKKCGKLIVATDKSQVEKLQELHKRGIENKXXXXXXLKGEKAIQEKEPLCKGLEALWSPETGIVDWGLVTQYFAKRFLNQKGEIYNDFQVNGFQEIRDPNYPI

SEQ ID NO: 35108 - protein, 40 aa, Diabrotica virgifera
  misc_feature: Coding regions on vcDNA: vcDNA=SeqID_14805; Strand=-; Position=93-215
RETEHLSRPKESLERGFRAVKDLTSECLFEPKMLNDITPN

SEQ ID NO: 35109 - protein, 82 aa, Diabrotica virgifera
  misc_feature: Coding regions on vcDNA: vcDNA=SeqID_14806; Strand=-; Position=3-248
  misc_feature (38)..(47): Xaa can be any naturally occurring amino acid
  misc_feature (50)..(56): Xaa can be any naturally occurring amino acid
KQLLPYLHIHKFLYIISNYNVRAKKIFFFNPPQKLIPXXXXXXXXXXSIXXXXXXXNSLPITNIYKQNTYLSKKIISNNYHT

SEQ ID NO: 35110 - protein, 38 aa, Diabrotica virgifera
  misc_feature: Coding regions on vcDNA: vcDNA=SeqID_14807; Strand=-; Position=1-114
  misc_feature (2)..(38): Xaa can be any naturally occurring amino acid
KXXXXXXXXXXXXXXXXXXXXXXXXXXXXXXXXXXXXX

SEQ ID NO: 35111 - protein, 98 aa, Diabrotica virgifera
  misc_feature: Coding regions on vcDNA: vcDNA=SeqID_14808; Strand=+; Position=131-427
RYFFISQLNSCFHVIENNNVYFSSLYWMSQQKFTSRQSTYLSNLYKSNLLYGKFEVSSCDVFMLVKILLMHIMFTFLRAHRISSAIRCSKYDAFLNFT

SEQ ID NO: 35112 - protein, 141 aa, Diabrotica virgifera
  misc_feature: Coding regions on vcDNA: vcDNA=SeqID_14809; Strand=+; Position=1-426
  misc_feature: Homolog annotation: Hit_ID=NP_648107.3; Match level="QueryCoverage =85%, HitCoverage=21%, E-value=2e-34, Identity=57%"; Hit description =CG8596-PA [Drosophila melanogaster] gb|AAF50577.2| CG8596-PA [Drosophila melanogaster]
KWCSYTPAMGLAQFILGYMFTSFGYPIAVTLLQTIFSKLLGSKPQGVWMGFMVGAGCLSRVMGPIFVTYIYEEYGTVWTFGFTTVMMIVCQIWLLWIQKSLNPDLKKDEATTDQELQETSKFASVDLEVENGIQRNCDNVQ

SEQ ID NO: 35113 - protein, 50 aa, Diabrotica virgifera
  misc_feature: Coding regions on vcDNA: vcDNA=SeqID_14810; Strand=-; Position=75-227
SSFRSEITGCIVPSWGWLMLEVQTLNNSSSKSSIPYQVVPVNLLNTFIVH

SEQ ID NO: 35114 - protein, 207 aa, Diabrotica virgifera
  misc_feature: Coding regions on vcDNA: vcDNA=SeqID_14811; Strand=+; Position=40-660
  misc_feature: Homolog annotation: Hit_ID=NP_611468.1; Match level="QueryCoverage =87%, HitCoverage=48%, E-value=6e-25, Identity=40%"; Hit description =CG9090-PA [Drosophila melanogaster] gb|AAF57486.1| CG9090-PA [Drosophila melanogaster]
  misc_feature: Gene Ontology Annotation: Molecular function=phosphate carrier activity; Cellular component=integral to plasma membrane; Biological process=transport
  misc_feature (50)..(50): Xaa can be any naturally occurring amino acid
  misc_feature (53)..(53): Xaa can be any naturally occurring amino acid
  misc_feature (57)..(57): Xaa can be any naturally occurring amino acid
  misc_feature (61)..(61): Xaa can be any naturally occurring amino acid
  misc_feature (63)..(63): Xaa can be any naturally occurring amino acid
  misc_feature (65)..(65): Xaa can be any naturally occurring amino acid
  misc_feature (71)..(72): Xaa can be any naturally occurring amino acid
  misc_feature (74)..(74): Xaa can be any naturally occurring amino acid
  misc_feature (79)..(80): Xaa can be any naturally occurring amino acid
  misc_feature (82)..(82): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(92): Xaa can be any naturally occurring amino acid
  misc_feature (94)..(94): Xaa can be any naturally occurring amino acid
  misc_feature (98)..(98): Xaa can be any naturally occurring amino acid
  misc_feature (100)..(100): Xaa can be any naturally occurring amino acid
  misc_feature (103)..(103): Xaa can be any naturally occurring amino acid
  misc_feature (123)..(128): Xaa can be any naturally occurring amino acid
  misc_feature (131)..(131): Xaa can be any naturally occurring amino acid
  misc_feature (134)..(134): Xaa can be any naturally occurring amino acid
  misc_feature (139)..(140): Xaa can be any naturally occurring amino acid
  misc_feature (145)..(145): Xaa can be any naturally occurring amino acid
  misc_feature (158)..(158): Xaa can be any naturally occurring amino acid
  misc_feature (160)..(161): Xaa can be any naturally occurring amino acid
  misc_feature (164)..(165): Xaa can be any naturally occurring amino acid
  misc_feature (168)..(168): Xaa can be any naturally occurring amino acid
  misc_feature (170)..(171): Xaa can be any naturally occurring amino acid
  misc_feature (173)..(174): Xaa can be any naturally occurring amino acid
  misc_feature (176)..(176): Xaa can be any naturally occurring amino acid
  misc_feature (182)..(182): Xaa can be any naturally occurring amino acid
  misc_feature (192)..(192): Xaa can be any naturally occurring amino acid
GNNRRTDFPRPKANKARQQPENQTLPQPDDPRAEKRAAGRQTAAAAAAEXDSXEPGXAHHXAXGXQGGTRXXGXTHTAXXPXDXXKRXXQXXPXKHKXAXNGXKATRAEEGTRGPAKGRAPTXXXXXXQGXRKXGPEEXXKATHXDTSGEENAHPNRXRXXEAXXATXEXXAXXAXPPTEAXKDKTQTTPGXANTPREARPRKHREE

SEQ ID NO: 35115 - protein, 34 aa, Diabrotica virgifera
  misc_feature: Coding regions on vcDNA: vcDNA=SeqID_14812; Strand=-; Position=1-102
  misc_feature (9)..(9): Xaa can be any naturally occurring amino acid
  misc_feature (11)..(11): Xaa can be any naturally occurring amino acid
  misc_feature (15)..(21): Xaa can be any naturally occurring amino acid
  misc_feature (25)..(31): Xaa can be any naturally occurring amino acid
TSKNPTRKXLXTNIXXXXXXXGKPXXXXXXXALI

SEQ ID NO: 35116 - protein, 85 aa, Diabrotica virgifera
  misc_feature: Coding regions on vcDNA: vcDNA=SeqID_14813; Strand=-; Position=268-525
LLEVSLRVGRGQLVSIQEVERSASASCAHGYAITRRGLASIGSGSSSSQESLSLEEVSVAESCAAEALFLSGGRIKLWKCVRQVT

SEQ ID NO: 35117 - protein, 110 aa, Diabrotica virgifera
  misc_feature: Coding regions on vcDNA: vcDNA=SeqID_14814; Strand=+; Position=72-404
DVHGVHSVFPESTQCFIKENSNEELRDPPFGEIIHYYMGSHRPSSTREEPIPAPVSQPGSKQERFSFIFIFFTPGPTGGSVLHYQGAHFPVCGSNLLRSQLGLFGNNECL

SEQ ID NO: 35118 - protein, 55 aa, Diabrotica virgifera
  misc_feature: Coding regions on vcDNA: vcDNA=SeqID_14815; Strand=+; Position=3-167
EYYRKFPPPKLEQLVKRRVEKELEQRKRDEQLSPLETEQKPKHQAQENPGTPPAS

SEQ ID NO: 35119 - protein, 30 aa, Diabrotica virgifera
  misc_feature: Coding regions on vcDNA: vcDNA=SeqID_14816; Strand=-; Position=1-90
  misc_feature (11)..(17): Xaa can be any naturally occurring amino acid
FLSYLALITLXXXXXXXCRRKEGFLQVPAM

SEQ ID NO: 35120 - protein, 32 aa, Diabrotica virgifera
  misc_feature: Coding regions on vcDNA: vcDNA=SeqID_14817; Strand=+; Position=2-97
KNMYEIRIHLDLAMGEIFVIDCKNLKLDIGLK

SEQ ID NO: 35121 - protein, 280 aa, Diabrotica virgifera
  misc_feature: Coding regions on vcDNA: vcDNA=SeqID_14818; Strand=-; Position=1-840
  misc_feature (8)..(54): Xaa can be any naturally occurring amino acid
  misc_feature (59)..(105): Xaa can be any naturally occurring amino acid
  misc_feature (109)..(128): Xaa can be any naturally occurring amino acid
  misc_feature (135)..(170): Xaa can be any naturally occurring amino acid
  misc_feature (173)..(210): Xaa can be any naturally occurring amino acid
  misc_feature (212)..(257): Xaa can be any naturally occurring amino acid
  misc_feature (268)..(277): Xaa can be any naturally occurring amino acid
WCFFGVVXXXXXXXXXXXXXXXXXXXXXXXXXXXXXXXXXXXXXXXXXXXXXXXLLVVXXXXXXXXXXXXXXXXXXXXXXXXXXXXXXXXXXXXXXXXXXXXXXXSALXXXXXXXXXXXXXXXXXXXXVFCVCFXXXXXXXXXXXXXXXXXXXXXXXXXXXXXXXXXXXXLLXXXXXXXXXXXXXXXXXXXXXXXXXXXXXXXXXXXXXXGXXXXXXXXXXXXXXXXXXXXXXXXXXXXXXXXXXXXXXXXXXXXXXASLCVFVFVCXXXXXXXXXXAVF

SEQ ID NO: 35122 - protein, 34 aa, Diabrotica virgifera
  misc_feature: Coding regions on vcDNA: vcDNA=SeqID_14819; Strand=-; Position=1-102
TIITVPRGHENILSFIKISYKKLVVLNSVYSGRL

SEQ ID NO: 35123 - protein, 61 aa, Diabrotica virgifera; identical to SEQ ID NO: 29542
  misc_feature: Coding regions on vcDNA: vcDNA=SeqID_14820; Strand=-; Position=2-184
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(61): Xaa can be any naturally occurring amino acid

SEQ ID NO: 35124 - protein, 126 aa, Diabrotica virgifera
  misc_feature: Coding regions on vcDNA: vcDNA=SeqID_14821; Strand=-; Position=136-516
  misc_feature (24)..(31): Xaa can be any naturally occurring amino acid
  misc_feature (34)..(41): Xaa can be any naturally occurring amino acid
  misc_feature (71)..(83): Xaa can be any naturally occurring amino acid
  misc_feature (98)..(105): Xaa can be any naturally occurring amino acid
  misc_feature (107)..(119): Xaa can be any naturally occurring amino acid
TNHSTTTKTFPLHKPQKNQHQNYXXXXXXXXHPXXXXXXXXTTKKQLQKHPLPPKNNYKTHNQNYPHNHNXXXXXXXXXXXXXPLPSLLKKKNPPQTXXXXXXXXSXXXXXXXXXXXXXTQHKHNK

SEQ ID NO: 35125 - protein, 53 aa, Diabrotica virgifera
  misc_feature: Coding regions on vcDNA: vcDNA=SeqID_14822; Strand=-; Position=1-159
  misc_feature (3)..(53): Xaa can be any naturally occurring amino acid
SLXXXXXXXXXXXXXXXXXXXXXXXXXXXXXXXXXXXXXXXXXXXXXXXXXXX

SEQ ID NO: 35126 - protein, 50 aa, Diabrotica virgifera
  misc_feature: Coding regions on vcDNA: vcDNA=SeqID_14823; Strand=-; Position=2-151
AVSIRRTISLTYQRFLIKLNALQRGTHTRANEIYRAKGGPGNSRPGPPGG

SEQ ID NO: 35127 - protein, 99 aa, Diabrotica virgifera
  misc_feature: Coding regions on vcDNA: vcDNA=SeqID_14824; Strand=+; Position=17-316
STTKYNMCDDDVAVLVFHKGNRQNQNNRFPQTIKSLTRNQKLTLYQTGISPETYPSFDSLLLLNQILRNRDNTPATSNTSYISDATPRKKPLLIERAIL

SEQ ID NO: 35128 - protein, 61 aa, Diabrotica virgifera
  misc_feature: Coding regions on vcDNA: vcDNA=SeqID_14825; Strand=+; Position=39-221
EVVWLIVNNGAQGCEYQTIRIIQHPYTEHLWVTVSYWKTNPPHRVTPTRLPRESYNTSAST

SEQ ID NO: 35129 - protein, 63 aa, Diabrotica virgifera
  misc_feature: Coding regions on vcDNA: vcDNA=SeqID_14826; Strand=+; Position=211-399
NLETGIIRLRFMPFIMVPAYNLQQRTSLPTAYNDAPLNNCDPWRKRHVPKASLSHSYITFRPI

SEQ ID NO: 35130 - protein, 90 aa, Diabrotica virgifera
  misc_feature: Coding regions on vcDNA: vcDNA=SeqID_14827; Strand=+; Position=154-423
  misc_feature: Homolog annotation: Hit_ID=XP_396587.1; Match level="QueryCoverage =80%, HitCoverage=37%, E-value=2e-13, Identity=56%"; Hit description =similar to ENSANGP00000008511 [Apis mellifera]
  misc_feature: Gene Ontology Annotation: Molecular function=structural constituent of cytoskeleton; Cellular component=Arp2/3 protein complex; Biological process=cell motility
  misc_feature: Pfam annotation: Pfam_ID=P21-Arc; Match level="Score=-102.6, E-value =0.0015, Copies=1"; Pfam description=P21-ARC (ARP2/3 complex 21 kDa subunit
  misc_feature (37)..(37): Xaa can be any naturally occurring amino acid
  misc_feature (48)..(48): Xaa can be any naturally occurring amino acid
MTRYTKPGTIHPNLQQHNIINLSLFYFKDNVFFSTYXITSELDTSTIXITLYITQRLKNMQNCRTTAQAHNHMQSLAISKLVIPFAPRLS

SEQ ID NO: 35131 - protein, 181 aa, Diabrotica virgifera
  misc_feature: Coding regions on vcDNA: vcDNA=SeqID_14828; Strand=+; Position=288-833
  misc_feature (157)..(164): Xaa can be any naturally occurring amino acid
MEINQEASEETCKIKVEDTCVGSSFDVCKIEINEEPKREPVYDAFIDYLDSNEFSIDTKVEQDEYKFSLVEEKQTTNEESFSQKKFLEMEYIETLPDLSCNKEQQISPNSRKTTLNNYYSIICFKHCSQKNNSNKHTEIHTEKRLYKCVICFKQFSXXXXXXXXMRVHIGERFYRFPILIR

SEQ ID NO: 35132 - protein, 47 aa, Diabrotica virgifera
  misc_feature: Coding regions on vcDNA: vcDNA=SeqID_14829; Strand=+; Position=47-187
  misc_feature (7)..(18): Xaa can be any naturally occurring amino acid
VTLSFLXXXXXXXXXXXXATTYVNGLLLHDKILYILKFLSKNTSYPL

SEQ ID NO: 35133 - protein, 58 aa, Diabrotica virgifera
  misc_feature: Coding regions on vcDNA: vcDNA=SeqID_14830; Strand=+; Position=211-387
QVRYIAQEHILRKCVDKKTLKLCNEPENIYIGMDYIYNIFYNILLMLILNKSAYILEK

SEQ ID NO: 35134 - protein, 109 aa, Diabrotica virgifera
  misc_feature: Coding regions on vcDNA: vcDNA=SeqID_14831; Strand=+; Position=88-417
  misc_feature: Homolog annotation: Hit_ID=XP_393173.1; Match level="QueryCoverage =89%, HitCoverage=1%, E-value=1e-21, Identity=56%"; Hit description =similar to Hypothetical protein CBG09037 [Apis mellifera]
  misc_feature: Gene Ontology Annotation: Molecular function=single-stranded RNA binding; Cellular component=microtubule cytoskeleton; Biological process=spermatid development
EDGRDDQLFSFHQGDQNRILKGVMRVGHLAKGRLLQGDTNVELVILCADKPTLTLLKKVDEILPSALKQVVPESAYTVTINASEAGLIIAGDSLTVLVQPEAAGAGFEP

SEQ ID NO: 35135 - protein, 287 aa, Diabrotica virgifera
  misc_feature: Coding regions on vcDNA: vcDNA=SeqID_14832; Strand=-; Position=1-861
  misc_feature (3)..(280): Xaa can be any naturally occurring amino acid
NYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYEKINF

SEQ ID NO: 35136 - protein, 50 aa, Diabrotica virgifera
  misc_feature: Coding regions on vcDNA: vcDNA=SeqID_14833; Strand=+; Position=27-179
SIYNKHSIKKLSLIYPKNINLQNIQHIISHTHNTLKYVSHQKNYFNNKPP

SEQ ID NO: 35137 - protein, 154 aa, Diabrotica virgifera
  misc_feature: Coding regions on vcDNA: vcDNA=SeqID_14834; Strand=+; Position=164-624
  misc_feature: Homolog annotation: Hit_ID=AAN05630.1; Match level="QueryCoverage =71%, HitCoverage=48%, E-value=8e-14, Identity=36%"; Hit description =diapause-associated transcript-2 [Leptinotarsa decemlineata]
  misc_feature (57)..(57): Xaa can be any naturally occurring amino acid
ERTCEQLSSCREDSRSSSAKNERKMSELLNKKFNTTLPLDVNYMGEEDKGKCPDLRXKVDDISVKSEKCVDDDDVESETFWSLEQSKMARCFIPDIDLIASCLPEESKELPVLVSRIGTKLRGSHSKFLRRMFRKQKHSRVISILMVIINGFIN

SEQ ID NO: 35138 - protein, 243 aa, Diabrotica virgifera
  misc_feature: Coding regions on vcDNA: vcDNA=SeqID_14835; Strand=-; Position=0-728
  misc_feature (8)..(241): Xaa can be any naturally occurring amino acid
INSIGSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 35139 - protein, 195 aa, Diabrotica virgifera
  misc_feature: Coding regions on vcDNA: vcDNA=SeqID_14836; Strand=+; Position=3-590
  misc_feature (13)..(24): Xaa can be any naturally occurring amino acid
  misc_feature (27)..(73): Xaa can be any naturally occurring amino acid
  misc_feature (82)..(129): Xaa can be any naturally occurring amino acid
  misc_feature (132)..(141): Xaa can be any naturally occurring amino acid
  misc_feature (145)..(151): Xaa can be any naturally occurring amino acid
  misc_feature (153)..(178): Xaa can be any naturally occurring amino acid
IILILSSLLNYLXXXXXXXXXXXXLLXXXXXXXXXXXXXXXXXXXXXXXXXXXXXXXXXXXXXXXXXXXXXXXRRILTALRXXXXXXXXXXXXXXXXXXXXXXXXXXXXXXXXXXXXXXXXXXXXXXXXLYXXXXXXXXXXVFIXXXXXXXQXXXXXXXXXXXXXXXXXXXXXXXXXXINYLTDSSVILLKSSYR

SEQ ID NO: 35140 - protein, 51 aa, Diabrotica virgifera
  misc_feature: Coding regions on vcDNA: vcDNA=SeqID_14837; Strand=-; Position=47-202
  misc_feature (34)..(40): Xaa can be any naturally occurring amino acid
RYLETKTTSCQTGYFDFLVRNYGVNFRDVINSEXXXXXXXPNHVRHARFIE

SEQ ID NO: 35141 - protein, 106 aa, Diabrotica virgifera
  misc_feature: Coding regions on vcDNA: vcDNA=SeqID_14838; Strand=+; Position=429-749
TFDIDLGVLMTVWILLIILSYGLAEQLEENRHMSSHSYAYNLFKFGITGLSETAYFCSSEISSSPNRRKLETSSAARTSPVDPARFDAHRGMWPSYFSMLRKVYWI

SEQ ID NO: 35142 - protein, 65 aa, Diabrotica virgifera
  misc_feature: Coding regions on vcDNA: vcDNA=SeqID_14839; Strand=-; Position=1-195
  misc_feature (36)..(65): Xaa can be any naturally occurring amino acid
MITVPYHGQHTAKHSNYSAGRRVFIYNTKRHVSNKXXXXXXXXXXXXXXXXXXXXXXXXXXXXXX

SEQ ID NO: 35143 - protein, 102 aa, Diabrotica virgifera
  misc_feature: Coding regions on vcDNA: vcDNA=SeqID_14840; Strand=-; Position=146-454
  misc_feature (1)..(23): Xaa can be any naturally occurring amino acid
  misc_feature (26)..(68): Xaa can be any naturally occurring amino acid
  misc_feature (77)..(82): Xaa can be any naturally occurring amino acid
XXXXXXXXXXXXXXXXXXXXXXXNLXXXXXXXXXXXXXXXXXXXXXXXXXXXXXXXXXXXXXXXXXXXAYHISLQKXXXXXXVNKKNFNILLFTFEWIYTCF

SEQ ID NO: 35144 - protein, 74 aa, Diabrotica virgifera
  misc_feature: Coding regions on vcDNA: vcDNA=SeqID_14841; Strand=+; Position=162-386
LHQYRMDITSSFLSYTKYTHLHLCHEVFYAPIHVYILNQSLLSYNYHHTPNVTYIHIKYELDRPIAMTYKRSSL

SEQ ID NO: 35145 - protein, 61 aa, Diabrotica virgifera
  misc_feature: Coding regions on vcDNA: vcDNA=SeqID_14842; Strand=+; Position=49-234
YLQSWDSIPAIKLLKINSTIQVYPSVHGCAHSSSHTSYKDEGNIINPKREPNLSEDILAKM

SEQ ID NO: 35146 - protein, 109 aa, Diabrotica virgifera
  misc_feature: Coding regions on vcDNA: vcDNA=SeqID_14843; Strand=-; Position=2-328
IGLSLLQNSANVTKEFVLMSRYEEGFIISRKNISIVDNNTSVIFMSGCRRFPRFFVFVARPLLLWVFSFPLLFVWFFCMCVCLGFGFALVSLKRGCPSGLAVPPALKRT

SEQ ID NO: 35147 - protein, 17 aa, Diabrotica virgifera
  misc_feature: Coding regions on vcDNA: vcDNA=SeqID_14844; Strand=-; Position=1-51
  misc_feature (3)..(17): Xaa can be any naturally occurring amino acid
EVXXXXXXXXXXXXXXX

SEQ ID NO: 35148 - protein, 323 aa, Diabrotica virgifera
  misc_feature: Coding regions on vcDNA: vcDNA=SeqID_14845; Strand=-; Position=0-968
  misc_feature (2)..(319): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQIEL

SEQ ID NO: 35149 - protein, 63 aa, Diabrotica virgifera
  misc_feature: Coding regions on vcDNA: vcDNA=SeqID_14846; Strand=-; Position=215-406
ISIINNLISEIRLPNIVFHCYLFHMLVLYKLIIITENYVLSKLDFRAFAYTFFYRTLYTFRGI

SEQ ID NO: 35150 - protein, 105 aa, Diabrotica virgifera
  misc_feature: Coding regions on vcDNA: vcDNA=SeqID_14847; Strand=-; Position=119-436
KQEHHLQEFLHCLANLFLMLLYQHNTICTYQSFNFVALSMMLTKLLYKRTSILSTSLLMYSISPELRSMMISHTFLYFNFDSTNKITPNRIHCFKEISATSPNCL

SEQ ID NO: 35151 - protein, 62 aa, Diabrotica virgifera
  misc_feature: Coding regions on vcDNA: vcDNA=SeqID_14848; Strand=-; Position=1-186
PRYCGGVHLYLLINHFLLVVHGALIALIRLVGILSVVSGPTSPPDLQPWHYTRRSLTRTLRN

SEQ ID NO: 35152 - protein, 37 aa, Diabrotica virgifera
  misc_feature: Coding regions on vcDNA: vcDNA=SeqID_14849; Strand=+; Position=3-116
  misc_feature (2)..(14): Xaa can be any naturally occurring amino acid
TXXXXXXXXXXXXXCDLDVELKSIIAETGISLSLFDF

SEQ ID NO: 35153 - protein, 64 aa, Diabrotica virgifera
  misc_feature: Coding regions on vcDNA: vcDNA=SeqID_14850; Strand=+; Position=111-305
FMRPEQRRTPNLQCFLILHQKRELSRNVRFPVRDCVILHIHDERHCTNDIPKWKPIFFPYIDIF

SEQ ID NO: 35154 - protein, 184 aa, Diabrotica virgifera
  misc_feature: Coding regions on vcDNA: vcDNA=SeqID_14851; Strand=+; Position=223-775
  misc_feature: Homolog annotation: Hit_ID=XP_394922.1; Match level="QueryCoverage =97%, HitCoverage=40%, E-value=5e-37, Identity=45%"; Hit description =similar to juvenile hormone epoxide hydrolase II [Apis mellifera]
  misc_feature: Gene Ontology Annotation: Molecular function=epoxide hydrolase activity
  misc_feature: Pfam annotation: Pfam_ID=EHN; Match level="Score=59.9, E-value=6.9e -15, Copies=1"; Pfam description=Epoxide hydrolase N terminus
  misc_feature (17)..(17): Xaa can be any naturally occurring amino acid
  misc_feature (67)..(67): Xaa can be any naturally occurring amino acid
  misc_feature (108)..(108): Xaa can be any naturally occurring amino acid
  misc_feature (175)..(175): Xaa can be any naturally occurring amino acid
KTRKPKVKPFTISVSEXVLKDLLYFLHHHRTFTPPLEGIVHENSINSNLAKTIDKYWRKKYNWIESXMHLNQYPQFTVNIQGLYLNYIHIKPKVSYDIKMLSLLILHXSSVSVKVFSMNYFRLLITPQKARNFVFESIDPHIPGFWFSKPALRPGLNPNKIALRFKNMKHQLGFXKFHVQGGDF

SEQ ID NO: 35155 - protein, 17 aa, Diabrotica virgifera
  misc_feature: Coding regions on vcDNA: vcDNA=SeqID_14852; Strand=-; Position=1-51
  misc_feature (3)..(17): Xaa can be any naturally occurring amino acid
EVXXXXXXXXXXXXXXX

SEQ ID NO: 35156 - protein, 66 aa, Diabrotica virgifera
  misc_feature: Coding regions on vcDNA: vcDNA=SeqID_14853; Strand=-; Position=0-197
  misc_feature (27)..(35): Xaa can be any naturally occurring amino acid
  misc_feature (47)..(64): Xaa can be any naturally occurring amino acid
FPSFLVPRLCFLFPFYLLLFCIPHRKXXXXXXXXXSPSSFPHIFLSXXXXXXXXXXXXXXXXXXWT

SEQ ID NO: 35157 - protein, 73 aa, Diabrotica virgifera
  misc_feature: Coding regions on vcDNA: vcDNA=SeqID_14854; Strand=+; Position=117-338
PPRLKPPTYHREDRKKRPPNGQPVLRNCLFTPQPANREAARHLHIQCFSGQYRSNKTMNPTVTPLSTMILSPA

SEQ ID NO: 35158 - protein, 52 aa, Diabrotica virgifera
  misc_feature: Coding regions on vcDNA: vcDNA=SeqID_14855; Strand=-; Position=0-155
  misc_feature (22)..(51): Xaa can be any naturally occurring amino acid
KKKQKAPASASPPFSVSSLASXXXXXXXXXXXXXXXXXXXXXXXXXXXXXXG

SEQ ID NO: 35159 - protein, 52 aa, Diabrotica virgifera
  misc_feature: Coding regions on vcDNA: vcDNA=SeqID_14856; Strand=+; Position=329-487
  misc_feature (30)..(34): Xaa can be any naturally occurring amino acid
VGTWMRKEHWSTLIQRNVSPLVVFFLPKPXXXXXLCELLQPFIMLFLSLLVS

SEQ ID NO: 35160 - protein, 75 aa, Diabrotica virgifera
  misc_feature: Coding regions on vcDNA: vcDNA=SeqID_14857; Strand=-; Position=1-225
RRKSSQQNHQRHTGISICRGIHTPWITFYYKMIYYKSGMFRRLLKSISSLFSALVHLSIYSYVINFIYIVKNWIY

SEQ ID NO: 35161 - protein, 262 aa, Diabrotica virgifera
  misc_feature: Coding regions on vcDNA: vcDNA=SeqID_14858; Strand=+; Position=40-825
  misc_feature: Homolog annotation: Hit_ID=CAD29886.1; Match level="QueryCoverage =95%, HitCoverage=88%, E-value=3e-76, Identity=65%"; Hit description =helix-loop-helix transcription factor [Tribolium castaneum]
  misc_feature: Gene Ontology Annotation: Molecular function=RNA polymerase II transcription factor activity; Cellular component=extracellular matrix; Biological process=adult locomotory behavior
  misc_feature: Pfam annotation: Pfam_ID=HLH; Match level="Score=73.7, E-value=4.8e -19, Copies=1"; Pfam description=Helix-loop-helix DNA-binding domain
  misc_feature (238)..(238): Xaa can be any naturally occurring amino acid
MVTTTNAVTSTSMIQGNSTTPTSNTPGTGENNNGVKRISDNRRSNKPIMEKRRRARINNCLNELKTLILDAMKKDPARHSKLEKADILEMTVKHLQNLQRQQVAMSAAADPLVVNKFRAGFSECASEVGRFPGLDPIVRRRLLQHLANCLSQGSKPQEVPQVQVHILPNTQKPLEQQVPQSSGIILSNGNGTGVQLVPTRLPNGDLALVLPTTLQTQPQYSPAAVPLLVPIVPERTAXTTSATSSYSNYFSSHSPEPMESMY

SEQ ID NO: 35162 - protein, 102 aa, Diabrotica virgifera
  misc_feature: Coding regions on vcDNA: vcDNA=SeqID_14859; Strand=+; Position=7-315
  misc_feature (59)..(68): Xaa can be any naturally occurring amino acid
LGRLKISLIKRKLYLDYSNVELEVDVKVLIKKPKKLICSKKVEFSGRKRIIPSENIQVXXXXXXXXXXARASICNQHYWKSICLASCLIRICFFCFCVTDYA

SEQ ID NO: 35163 - protein, 281 aa, Diabrotica virgifera
  misc_feature: Coding regions on vcDNA: vcDNA=SeqID_14860; Strand=+; Position=82-923
  misc_feature: Homolog annotation: Hit_ID=EAL28092.1; Match level="QueryCoverage =96%, HitCoverage=55%, E-value=1e-60, Identity=46%"; Hit description =GA11424-PA [Drosophila pseudoobscura]
  misc_feature: Gene Ontology Annotation: Cellular component=membrane; Biological process=signal transduction
  misc_feature: Pfam annotation: Pfam_ID=Sugar_tr; Match level="Score=-81.3, E-value =0.00017, Copies=1"; Pfam description=Sugar (and other) transporter
  misc_feature (259)..(259): Xaa can be any naturally occurring amino acid
  misc_feature (270)..(270): Xaa can be any naturally occurring amino acid
MTSSSPNRTFLYIAACAANIAAFVCGTGFGWTSPELPKLKDNTTSPLDHELTDTQEGWIGSFLPLAAAIGPIGGGVLADIIGRKKTLLLGTLPFIVAYILNIFAKSVFIFYIGRFLSGIGVGIIFTVLPMYIGEISDDDVRGSLGSFMQFFIVIGLLFSYAIGPFVSIATFNIILVIPPVLFMIIFLIFIPDSPCYLLQTKNTKDALEALIRLRGREISFVQKEMEVMKVQVEKEQRDKGNFFDIFKCKGLRTALFYSXWGLVAFQQLSXNNIILFYSQNL

SEQ ID NO: 35164 - protein, 66 aa, Diabrotica virgifera
  misc_feature: Coding regions on vcDNA: vcDNA=SeqID_14861; Strand=-; Position=2-199
  misc_feature (53)..(59): Xaa can be any naturally occurring amino acid
TSHLLITSTVEDDGPVFTYSWSLMLMGPRNKKRCHSVKISYSRRSIRYMRQKXXXXXXXFVAKHSH

SEQ ID NO: 35165 - protein, 42 aa, Diabrotica virgifera
  misc_feature: Coding regions on vcDNA: vcDNA=SeqID_14862; Strand=+; Position=383-511
QRDYLQVVDSDQDILSDEEENHTIMDDDLRDDSMTQSMFQIK

SEQ ID NO: 35166 - protein, 169 aa, Diabrotica virgifera
  misc_feature: Coding regions on vcDNA: vcDNA=SeqID_14863; Strand=-; Position=2-511
  misc_feature (3)..(10): Xaa can be any naturally occurring amino acid
  misc_feature (17)..(43): Xaa can be any naturally occurring amino acid
  misc_feature (47)..(55): Xaa can be any naturally occurring amino acid
  misc_feature (57)..(68): Xaa can be any naturally occurring amino acid
  misc_feature (74)..(97): Xaa can be any naturally occurring amino acid
  misc_feature (99)..(106): Xaa can be any naturally occurring amino acid
  misc_feature (115)..(121): Xaa can be any naturally occurring amino acid
  misc_feature (136)..(146): Xaa can be any naturally occurring amino acid
  misc_feature (157)..(164): Xaa can be any naturally occurring amino acid
FIXXXXXXXXIILILSXXXXXXXXXXXXXXXXXXXXXXXXXXXHIFXXXXXXXXXLXXXXXXXXXXXXAHNLIXXXXXXXXXXXXXXXXXXXXXXXXLXXXXXXXXLIPNHFSLXXXXXXXLIYNIILYLLYLLKXXXXXXXXXXXNPQYTKYKGLXXXXXXXXHISQY

SEQ ID NO: 35167 - protein, 60 aa, Diabrotica virgifera
  misc_feature: Coding regions on vcDNA: vcDNA=SeqID_14864; Strand=-; Position=41-223
ISVGYGAFIVSGSSLVPFKISASTLIYMDSITSVGYIVLFAHSIYRCVGAPHCRQHKHSF

SEQ ID NO: 35168 - protein, 116 aa, Diabrotica virgifera
  misc_feature: Coding regions on vcDNA: vcDNA=SeqID_14865; Strand=+; Position=149-499
  misc_feature (39)..(46): Xaa can be any naturally occurring amino acid
YRWHGFRRISQGRNNFSVSVSVACSDRTSASCTSGSSRXXXXXXXXPNTLHSTYVRRTCRRKIIISTTANDLGTSHIAMTLELMMRALRSLHPVLLAGEAPEPCFIDFATADLPPA

SEQ ID NO: 35169 - protein, 99 aa, Diabrotica virgifera
  misc_feature: Coding regions on vcDNA: vcDNA=SeqID_14866; Strand=-; Position=2-298
  misc_feature (2)..(33): Xaa can be any naturally occurring amino acid
  misc_feature (36)..(46): Xaa can be any naturally occurring amino acid
  misc_feature (56)..(63): Xaa can be any naturally occurring amino acid
  misc_feature (66)..(79): Xaa can be any naturally occurring amino acid
  misc_feature (85)..(98): Xaa can be any naturally occurring amino acid
PXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 35170 - protein, 56 aa, Diabrotica virgifera
  misc_feature: Coding regions on vcDNA: vcDNA=SeqID_14867; Strand=-; Position=264-434
FKPHTPLLIHVLNQLYYHDRCAEQMKYNAMTSYQFHSFNPTYIIRSSKCSLNNYKL

SEQ ID NO: 35171 - protein, 192 aa, Diabrotica virgifera
  misc_feature: Coding regions on vcDNA: vcDNA=SeqID_14868; Strand=+; Position=263-841
  misc_feature: Homolog annotation: Hit_ID=NP_476950.1; Match level="QueryCoverage =100%, HitCoverage=100%, E-value=1e-102, Identity=92%"; Hit description=CG2248-PA [Drosophila melanogaster] gb|EAL29953.1| GA15321-PA [Drosophila
  misc_feature: Gene Ontology Annotation: Molecular function=GTPase activity; Cellular component=rhabdomere; Biological process=rhabdomere development
  misc_feature: Pfam annotation: Pfam_ID=Ras; Match level="Score=312.2, E-value=7.8e -91, Copies=1"; Pfam description=Ras family
  misc_feature (184)..(184): Xaa can be any naturally occurring amino acid
MQAIKCVVVGDGAVGKTCLLISYTTNAFPGEYIPTVFDNYSANVMVDGKPINLGLWDTAGQEDYDRLRPLSYPQTDVFLICFSLVNPASFENVRAKWYPEVRHHCPNTPIILVGTKLDLRDDRVTIEKLKDKKLSPITYPQGLAMAKEISAVKYLECSALTQKGLKTVFDEAIRAVLCPVMQVXQKRKCSIL

SEQ ID NO: 35172 - protein, 70 aa, Diabrotica virgifera
  misc_feature: Coding regions on vcDNA: vcDNA=SeqID_14869; Strand=-; Position=468-680
EAVFFSSAGSLQLLVEKLLIMLELAGQNTSCFQVYRWAGESKMQVRTDMLLMPGGREGCRVAWLGRCSCA

SEQ ID NO: 35173 - protein, 49 aa, Diabrotica virgifera
  misc_feature: Coding regions on vcDNA: vcDNA=SeqID_14870; Strand=-; Position=167-316
  misc_feature (18)..(24): Xaa can be any naturally occurring amino acid
  misc_feature (34)..(39): Xaa can be any naturally occurring amino acid
FEYEQFVILLFLYKKFIXXXXXXXELPLKMGCIXXXXXXGYIYIVNKDI

SEQ ID NO: 35174 - protein, 294 aa, Diabrotica virgifera
  misc_feature: Coding regions on vcDNA: vcDNA=SeqID_14871; Strand=+; Position=1-885
FALKAPGQGDSMYSQASILLGLVCTSLAFPRTYQEQRQIYYQQPLPVPYGAYQLPQQLQQQQQQPSIFQVPASTSFLPNNVPGLRYGAQQIVYVVPGGNQLLFEEGSTGGQGNSPYLESFMNFLNGHLPSRPGAQAPEKPVEKPAEEKPAENSVNASQEQEASAEEVTPPVEVLKPQAESGPAQLQQLPAQQPIQLAPLPPQHIAQLPTAQDQQILQQQLLQQRYYQPYLLNQPQQLNQALYGRPALAAPTANYLVNYRAYPLSDKKPGSSAIAFQKLLQKNAEAAAAGSQTNC

SEQ ID NO: 35175 - protein, 316 aa, Diabrotica virgifera
  misc_feature: Coding regions on vcDNA: vcDNA=SeqID_14872; Strand=-; Position=0-947
  misc_feature (2)..(311): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGPALG

SEQ ID NO: 35176 - protein, 223 aa, Diabrotica virgifera
  misc_feature: Coding regions on vcDNA: vcDNA=SeqID_14873; Strand=+; Position=110-781
  misc_feature (60)..(66): Xaa can be any naturally occurring amino acid
  misc_feature (111)..(118): Xaa can be any naturally occurring amino acid
SGKKYVERSNVEEENKIVNDILNSINCNNVEDEIVSKPKRSGLSRTKSSSFNLSTLTNFXXXXXXXITNETNNNYIQKPHLQNNQIEINNRNDECGLKRSGLSKSKACGNXXXXXXXXAEETSLEFGDETEENHVLFILGDNEKLEDLKKTNEVRKTERKLSSNTLDISEPENADKLNVIKFPLPEEKPIGDLIEVLPTSFLPDHNALDELVPDKIVQGIKCF

SEQ ID NO: 35177 - protein, 304 aa, Diabrotica virgifera
  misc_feature: Coding regions on vcDNA: vcDNA=SeqID_14874; Strand=+; Position=3-918
  misc_feature: Homolog annotation: Hit_ID=XP_321225.1; Match level="QueryCoverage =95%, HitCoverage=32%, E-value=1e-88, Identity=59%"; Hit description =ENSANGP00000020237 [Anopheles gambiae]
  misc_feature: Gene Ontology Annotation: Molecular function=co-chaperone activity; Cellular component=endoplasmic reticulum; Biological process =response to stress
  misc_feature: Pfam annotation: Pfam_ID=HSP70; Match level="Score=-389.5, E-value =0.035, Copies=1"; Pfam description=Hsp70 protein
  misc_feature (30)..(36): Xaa can be any naturally occurring amino acid
  misc_feature (157)..(157): Xaa can be any naturally occurring amino acid
  misc_feature (270)..(276): Xaa can be any naturally occurring amino acid
  misc_feature (299)..(299): Xaa can be any naturally occurring amino acid
APQPPVRVFKNDRAMAPPIKEAGRVKNVLXXXXXXXAQIEGLLDEKDFKLPVTRDEMEALFGDLFERVNNPIEQALKTAHLTMDVVNQVVLVGAGTRVPKVQEHLRKAVGQELAKNLNTDEAAAMGAVYKAADLSTGFKVAKFITKDAVVYPIQVTXRLAETGVKQVKRTLFGLMNSYPQKKIITFNKHTSDFNFNVNYADLDFLNPKEIQYLGTTNISQFELKGVADALKKHSGENVESKGIKAHFAMDDSGILNFVNVELVVEKTVVXXXXXXXLSKLGSTFSKLFGGDEKPAEEKXRRPTF

SEQ ID NO: 35178 - protein, 92 aa, Diabrotica virgifera
  misc_feature: Coding regions on vcDNA: vcDNA=SeqID_14875; Strand=-; Position=511-789
APEGSPCPLQLFSTNSTVSYGPLAAAHEPRGWISIRVVKKLSQTIQPFIRLCSGMKMSPKRPHSKVQLIGFQTKSVKLLYLHSSQSYTRSKL

SEQ ID NO: 35179 - protein, 300 aa, Diabrotica virgifera
  misc_feature: Coding regions on vcDNA: vcDNA=SeqID_14876; Strand=+; Position=1-903
  misc_feature (7)..(273): Xaa can be any naturally occurring amino acid
  misc_feature (279)..(291): Xaa can be any naturally occurring amino acid
LSQRPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLGITXXXXXXXXXXXXXCDLDVGLSL

SEQ ID NO: 35180 - protein, 146 aa, Diabrotica virgifera
  misc_feature: Coding regions on vcDNA: vcDNA=SeqID_14877; Strand=+; Position=24-460
  misc_feature: Homolog annotation: Hit_ID=NP_510658.1; Match level="QueryCoverage =96%, HitCoverage=37%, E-value=6e-13, Identity=24%"; Hit description =TBP-Associated transcription Factor family member (taf-3) [Caenorhabditis elegans]
  misc_feature (68)..(68): Xaa can be any naturally occurring amino acid
  misc_feature (141)..(141): Xaa can be any naturally occurring amino acid
RPTEHKAHESTREHRSKKAREHRKTSKQEKKEQERTRRAEKPNQTKAEPQGKRTGAKRGAQRRQKERXRTKRTEQRPTLRPEPEKQQQREAQRTAHQAQGETTSPKRKKSHTPKKQTRKTTDTTNRSQTPRRQKNQTQKQXNRQGA

SEQ ID NO: 35181 - protein, 246 aa, Diabrotica virgifera
  misc_feature: Coding regions on vcDNA: vcDNA=SeqID_14878; Strand=+; Position=235-972
  misc_feature: Homolog annotation: Hit_ID=EAL33794.1; Match level="QueryCoverage =91%, HitCoverage=49%, E-value=2e-80, Identity=59%"; Hit description =GA15786-PA [Drosophila pseudoobscura]
  misc_feature: Gene Ontology Annotation: Molecular function=sodium-dependent phosphate transporter activity; Cellular component=integral to membrane; Biological process=phosphate transport
  misc_feature: Pfam annotation: Pfam_ID=MFS_1; Match level="Score=26.6, E-value=7.4e- 05, Copies=1"; Pfam description=Major Facilitator Superfamily
MATATNRRRWSDFLTCRQVLNIMVILGFMFNYMLRVNLTIAIVDMMVPAQTNATNSTTTTKVPIVDQHKFNWSSSEKNDILGSFFWGYILTELPGGRMAEIVGAKKIFGGGMLMASLLTVLTPAACYWNFYAIVILRALVGFALGATWPSMPPMAAKWIPPLERSKFMANMMASALGAAITLPVCGYLISVSGWESVFYVTGAVGIVWSILWFVLVFDSPAPHPRIKAEERMDIEDKIAEFEGGAK

SEQ ID NO: 35182 - protein, 65 aa, Diabrotica virgifera
  misc_feature: Coding regions on vcDNA: vcDNA=SeqID_14879; Strand=-; Position=47-244
  misc_feature (5)..(5): Xaa can be any naturally occurring amino acid
  misc_feature (12)..(14): Xaa can be any naturally occurring amino acid
  misc_feature (17)..(18): Xaa can be any naturally occurring amino acid
  misc_feature (20)..(21): Xaa can be any naturally occurring amino acid
  misc_feature (23)..(25): Xaa can be any naturally occurring amino acid
  misc_feature (27)..(28): Xaa can be any naturally occurring amino acid
  misc_feature (41)..(41): Xaa can be any naturally occurring amino acid
  misc_feature (45)..(56): Xaa can be any naturally occurring amino acid
  misc_feature (59)..(60): Xaa can be any naturally occurring amino acid
YIQLXTFLITFXXXKNXXIXXSXXXNXXNLTLHFIKLLYYXFYIXXXXXXXXXXXXKIXXLFKNL

SEQ ID NO: 35183 - protein, 262 aa, Diabrotica virgifera
  misc_feature: Coding regions on vcDNA: vcDNA=SeqID_14880; Strand=+; Position=69-854
  misc_feature: Homolog annotation: Hit_ID=XP_393750.1; Match level="QueryCoverage =92%, HitCoverage=18%, E-value=4e-54, Identity=45%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=MMR_HSR1; Match level="Score=-23.7, E-value =0.089, Copies=1"; Pfam description=GTPase of unknown function
NLSNCNFINVTSLLLFLKLYLPITRNLRRLEASTRSPMIGHLNAALEGVTTVRAYKAENMIIDEYERHQDVFTSAHYSLLGFKFGMGFYMSMLAGVMVTLVICSFVLFETDATAGSIGLALTQVIYLGALIQGAVRCWADLETLMTATERALEYTGLKSETTQGSVPKHWPKDGTISFQNVSLSYNSTQRILNNLSFQVQAKEKIGIVGRTGAGKSSIISTIFRLYEVDGKITIDGVDIKLLPLKHLLKHLAIIPQDPILFS

SEQ ID NO: 35184 - protein, 321 aa, Diabrotica virgifera
  misc_feature: Coding regions on vcDNA: vcDNA=SeqID_14881; Strand=+; Position=3-965
  misc_feature (6)..(256): Xaa can be any naturally occurring amino acid
  misc_feature (258)..(271): Xaa can be any naturally occurring amino acid
  misc_feature (278)..(278): Xaa can be any naturally occurring amino acid
  misc_feature (283)..(290): Xaa can be any naturally occurring amino acid
  misc_feature (293)..(300): Xaa can be any naturally occurring amino acid
  misc_feature (307)..(307): Xaa can be any naturally occurring amino acid
  misc_feature (309)..(309): Xaa can be any naturally occurring amino acid
  misc_feature (313)..(319): Xaa can be any naturally occurring amino acid
QHTVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIXVYNWXXXXXXXXVRXXXXXXXXFNRCEPXWXLSLXXXXXXXEK

SEQ ID NO: 35185 - protein, 80 aa, Diabrotica virgifera
  misc_feature: Coding regions on vcDNA: vcDNA=SeqID_14882; Strand=-; Position=258-500
  misc_feature (62)..(68): Xaa can be any naturally occurring amino acid
HLTTPSPYSYFTTTYPNPITTPISSTLKNHHHYKSPQIKPHITIYYHKYTHIFFQFIMNDFXXXXXXXSHIIININYQYQ

SEQ ID NO: 35186 - protein, 243 aa, Diabrotica virgifera
  misc_feature: Coding regions on vcDNA: vcDNA=SeqID_14883; Strand=-; Position=1-729
  misc_feature (1)..(167): Xaa can be any naturally occurring amino acid
  misc_feature (170)..(209): Xaa can be any naturally occurring amino acid
  misc_feature (211)..(241): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXXGXXXXXXXXXXXXXXXXXXXXXXXXXXXXXXXKK

SEQ ID NO: 35187 - protein, 95 aa, Diabrotica virgifera
  misc_feature: Coding regions on vcDNA: vcDNA=SeqID_14884; Strand=+; Position=111-400
  misc_feature: Homolog annotation: Hit_ID=AAR10109.1; Match level="QueryCoverage =56%, HitCoverage=60%, E-value=3e-22, Identity=92%"; Hit description =similar to Drosophila melanogaster ctp [Drosophila yakuba] ref|NP _726944.1| CG6998-PD, isoform D [Drosophi
  misc_feature: Pfam annotation: Pfam_ID=Dynein_light; Match level="Score=91.3, E -value=2.5e-24, Copies=1"; Pfam description=Dynein light chain type 1
  misc_feature (49)..(49): Xaa can be any naturally occurring amino acid
VKFSRHSRDPKRPTAKQLLKTPISYNIEKDIAAYIKKEFDKKYNPTSAXIVGRNFGSYVTHETRHFIYFYLGQVAILISVQEWLISKKPQFHLDF

SEQ ID NO: 35188 - protein, 58 aa, Diabrotica virgifera
  misc_feature: Coding regions on vcDNA: vcDNA=SeqID_14885; Strand=+; Position=1-174
  misc_feature (1)..(15): Xaa can be any naturally occurring amino acid
  misc_feature (18)..(55): Xaa can be any naturally occurring amino acid
XXXXXXXXXXXXXXXYLXXXXXXXXXXXXXXXXXXXXXXXXXXXXXXXXXXXXXXEIV

SEQ ID NO: 35189 - protein, 127 aa, Diabrotica virgifera
  misc_feature: Coding regions on vcDNA: vcDNA=SeqID_14886; Strand=+; Position=192-575
QMLYPLIVNIKATRNINIDRVMNLKREFYQETFKKIVQWHLRKYQLDHTVVTYLPFHEKIYPLLLSDEEFQKGFFINKTYDIIYLWNTDMLVFCYDSAAIESVLNTKKSTHYVTFWDTWLVHYITAT

SEQ ID NO: 35190 - protein, 286 aa, Diabrotica virgifera
  misc_feature: Coding regions on vcDNA: vcDNA=SeqID_14887; Strand=+; Position=1-858
  misc_feature (1)..(285): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 35191 - protein, 84 aa, Diabrotica virgifera
  misc_feature: Coding regions on vcDNA: vcDNA=SeqID_14888; Strand=+; Position=251-505
  misc_feature (30)..(40): Xaa can be any naturally occurring amino acid
TLIQHRGPNLYYRLELPKKIPRKPQREFIXXXXXXXXXXXSEGMNVRIQGRTTGVYFYRITMLMLPEVQSPLERPGKRRRLPKY

SEQ ID NO: 35192 - protein, 34 aa, Diabrotica virgifera; identical to SEQ ID NO: 27603
  misc_feature: Coding regions on vcDNA: vcDNA=SeqID_14889; Strand=-; Position=79-183

SEQ ID NO: 35193 - protein, 45 aa, Diabrotica virgifera
  misc_feature: Coding regions on vcDNA: vcDNA=SeqID_14890; Strand=-; Position=100-237
  misc_feature (1)..(11): Xaa can be any naturally occurring amino acid
  misc_feature (16)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (33)..(33): Xaa can be any naturally occurring amino acid
  misc_feature (41)..(41): Xaa can be any naturally occurring amino acid
XXXXXXXXXXXPFVLXYIYXIXIEPNLGSPRFXLRSCKILXVDQT

SEQ ID NO: 35194 - protein, 312 aa, Diabrotica virgifera
  misc_feature: Coding regions on vcDNA: vcDNA=SeqID_14891; Strand=-; Position=1-936
  misc_feature (3)..(11): Xaa can be any naturally occurring amino acid
  misc_feature (14)..(21): Xaa can be any naturally occurring amino acid
  misc_feature (33)..(45): Xaa can be any naturally occurring amino acid
  misc_feature (48)..(312): Xaa can be any naturally occurring amino acid
GLXXXXXXXXXSTXXXXXXXXPIINLIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35195 - protein, 126 aa, Diabrotica virgifera
  misc_feature: Coding regions on vcDNA: vcDNA=SeqID_14892; Strand=+; Position=492-869
  misc_feature: Homolog annotation: Hit_ID=AAO39598.1; Match level="QueryCoverage =94%, HitCoverage=27%, E-value=1e-15, Identity=36%"; Hit description =GM20958p [Drosophila melanogaster]
TFFMTSKKSHEVDILSYIAAALSNISGTTHLIDIGDGKGYLSSMLALHHKIPVLGIDASAINTNGAVTRVKKLSRVWNAVSSPQKEVKSKEQVTSDLYKQVTKFVDSSIDFVELVSDIFLEKPDGL

SEQ ID NO: 35196 - protein, 268 aa, Diabrotica virgifera
  misc_feature: Coding regions on vcDNA: vcDNA=SeqID_14893; Strand=+; Position=17-820
  misc_feature: Homolog annotation: Hit_ID=XP_319899.1; Match level="QueryCoverage =93%, HitCoverage=51%, E-value=1e-57, Identity=45%"; Hit description =ENSANGP00000005268 [Anopheles gambiae]
  misc_feature: Gene Ontology Annotation: Cellular component=membrane fraction; Biological process=lipid metabolism
  misc_feature: Pfam annotation: Pfam_ID=UDPGT; Match level="Score=-95.8, E-value =7.3e-06, Copies=1"; Pfam description=UDP-glucoronosyl and UDP -glucosyl tra
  misc_feature (266)..(266): Xaa can be any naturally occurring amino acid
MFYYRYALPKADKIARKYFGDDMPYLGDLEKNISLLLLNVNPIIHNVRPNVPNVIEINQMHIKKRKPLPKDIQDYLDSAPQGVVYFSLGSNVKSANLTEQIRKEIVAGLGALPYKVLWKWETDYLPNKPDNVMTKKWCPQQDILAHPNIKVFVMQGGLQSIEEAITLEVPLVGMPFVTDQPSNIKRIVELGLGVKVDHKTLTRDILKDAIMEVAQNPKYKEEVKKAKSILLDQPMKGVEKAVWWIEYVIRHKGARHLRSPAEILTXVG

SEQ ID NO: 35197 - protein, 169 aa, Diabrotica virgifera
  misc_feature: Coding regions on vcDNA: vcDNA=SeqID_14894; Strand=+; Position=177-686
  misc_feature: Homolog annotation: Hit_ID=XP_317515.1; Match level="QueryCoverage =83%, HitCoverage=24%, E-value=2e-41, Identity=60%"; Hit description =ENSANGP00000009976 [Anopheles gambiae]
  misc_feature: Gene Ontology Annotation: Molecular function=choline kinase activity
  misc_feature: Pfam annotation: Pfam_ID=Choline_kinase; Match level="Score=-42.0, E -value=0.0011, Copies=1"; Pfam description=Choline/ethanolamine kinase
MLDIVPKNKPAAGDCFEMKELTARICRDYLQGAWKKVNAKNIGFKHISGGLSNHLFHVSLPDSLKTADANVEHEPKDVLIRVYGQTHGEGALEALITESVIFTLLSERNLGPKLHGIFPGGRIEQYIDARPLLTKELSDERLSVSIAKKMAAIHSMEQNCDKLRAIGCP

SEQ ID NO: 35198 - protein, 86 aa, Diabrotica virgifera
  misc_feature: Coding regions on vcDNA: vcDNA=SeqID_14895; Strand=+; Position=405-665
  misc_feature (14)..(20): Xaa can be any naturally occurring amino acid
  misc_feature (22)..(33): Xaa can be any naturally occurring amino acid
SFYWSLLPLALLEXXXXXXXSXXXXXXXXXXXXLLSMALEYWCFFLYRKGTSRTFLCILNVLRFFYFYRFMISEHVPAIHFSLVRL

SEQ ID NO: 35199 - protein, 305 aa, Diabrotica virgifera
  misc_feature: Coding regions on vcDNA: vcDNA=SeqID_14896; Strand=+; Position=20-934
MVTPIRPRMPVTPTGRPQAGYVRVAPGTIRARTPVVPAGNTLRPIRPINAVKHEWFEKTVRAAARVNSNLSYTLTQLNRAQANATSVEALAVVHNKLQEILSSSINSLIQIRKNLRTEFIAGIKNIRFPSSTSTTPTTSTASNAASTSKDDDDVIFVDDSTPKTTATTVTTPTLPPGLSLIKKTQAGVLRTNSPSTTSVAGPSGVTKTIRATPSKPSTSAGNQGKGGFLRVKSFSALQSVTSECITIPDDRSEDGDGDADVLPVEETDPLPMVEVVDEEAADKSKEAKVKDEDDDKKGDKKGQSS

SEQ ID NO: 35200 - protein, 120 aa, Diabrotica virgifera
  misc_feature: Coding regions on vcDNA: vcDNA=SeqID_14897; Strand=-; Position=49-411
  misc_feature (16)..(24): Xaa can be any naturally occurring amino acid
  misc_feature (100)..(107): Xaa can be any naturally occurring amino acid
FAPGHKIPEFASGVPXXXXXXXXXISNDISDESSVEGSFNTCLNGYSCSISNESQSTNIHIYIINVPFNSEVIHGGVGLDFICAYFSSPYWFLHDHFEAXXXXXXXXQFFHNLRQLPSNR

SEQ ID NO: 35201 - protein, 279 aa, Diabrotica virgifera
  misc_feature: Coding regions on vcDNA: vcDNA=SeqID_14898; Strand=+; Position=2-837
  misc_feature: Homolog annotation: Hit_ID=XP_310232.1; Match level="QueryCoverage =93%, HitCoverage=35%, E-value=7e-76, Identity=52%"; Hit description =ENSANGP00000016973 [Anopheles gambiae]
  misc_feature: Gene Ontology Annotation: Cellular component=integral to membrane
  misc_feature: Pfam annotation: Pfam_ID=ABC2_membrane; Match level="Score=95.4, E -value=1.5e-25, Copies=1"; Pfam description=ABC-2 type transporter
  misc_feature (265)..(265): Xaa can be any naturally occurring amino acid
LKGRDLFEEKKVGLYSDETKAVPAAIIMQFLLLYKRNLLIIKRCYGPSLNRVLAHIVIGLIFGYLYRNVGSAADTVLANYVYLYGTLLLTVYTGKMPVTLSFPLEMKILSREHFNRWYKLTPYLLSVILVEIPFQVICTWMYIAVSYSLTNQPLDFRLFLFVIFVTACSLCGQSMGYFIGATTPVKVAVFIAPVLACFLSVFGFCIRAIDTSTMFKPIFFISYFRAAFQSVVYSIYGFNREILVCPIEEEYCHYKDPHKFLSEMXILDVDFSSNFILIG

SEQ ID NO: 35202 - protein, 235 aa, Diabrotica virgifera
  misc_feature: Coding regions on vcDNA: vcDNA=SeqID_14899; Strand=+; Position=135-839
  misc_feature: Homolog annotation: Hit_ID=NP_724706.2; Match level="QueryCoverage =98%, HitCoverage=59%, E-value=2e-56, Identity=46%"; Hit description =CG14767-PC, isoform C [Drosophila melanogaster] ref|NP_724705.1| CG14767-PB, isoform B [Drosophila
  misc_feature: Gene Ontology Annotation: Cellular component=integral to membrane
  misc_feature: Pfam annotation: Pfam_ID=Mtp; Match level="Score=7.6, E-value=1.5e -08, Copies=1"; Pfam description=Golgi 4-transmembrane spanning transp
MFTMRLKLGSDRNKEWTSCFCLHVRTATILFGIWHLVLHILALTVLALMMRNHHVILQKNEDLQTDFLPTPLSKKDDDNPYYLPTTQDSRKIYTSDIDMGALMTVCTLSITLLMVYGTIKGKPTHVLPFFCLQLFDFAITALTATGYFCYLRSAHRLIAENWNLPLRQELLQLSPQVLTLIVLLAFLFSMLWKAYWISVVWRCYKYLTFRHKLTETPFDTSFLNPTTVVSPIQII

SEQ ID NO: 35203 - protein, 67 aa, Diabrotica virgifera
  misc_feature: Coding regions on vcDNA: vcDNA=SeqID_14900; Strand=-; Position=153-356
SGDFYQLTLFLNLFSISLTLATPKINLDTLSKSSLIQIAISYNIPRPVQTIHEQIFQRLNRSFPMNL

SEQ ID NO: 35204 - protein, 61 aa, Diabrotica virgifera
  misc_feature: Coding regions on vcDNA: vcDNA=SeqID_14901; Strand=+; Position=479-664
IHNDKTTTFNCTSHNDDDITMTSWNIKYQYIAPNRTLIAPYVRTAIRHMYVSIIYQGTADH

SEQ ID NO: 35205 - protein, 122 aa, Diabrotica virgifera
  misc_feature: Coding regions on vcDNA: vcDNA=SeqID_14902; Strand=-; Position=272-640
  misc_feature (8)..(20): Xaa can be any naturally occurring amino acid
  misc_feature (25)..(46): Xaa can be any naturally occurring amino acid
  misc_feature (58)..(73): Xaa can be any naturally occurring amino acid
  misc_feature (79)..(88): Xaa can be any naturally occurring amino acid
RRDIILNXXXXXXXXXXXXXQQNSXXXXXXXXXXXXXXXXXXXXXXHLNYLNLFLNKXXXXXXXXXXXXXXXXYFRILXXXXXXXXXXNNSLPGHRRKTLKCGQSSSNRRNDNGNPQTELVH

SEQ ID NO: 35206 - protein, 64 aa, Diabrotica virgifera
  misc_feature: Coding regions on vcDNA: vcDNA=SeqID_14903; Strand=-; Position=2-196
  misc_feature (21)..(21): Xaa can be any naturally occurring amino acid
YVKNKRLQLVFKLQWDKIIQXLVKNLSEPSNKNVPFTMVLPVHNQYNKILVELIQIYYIITHPL

SEQ ID NO: 35207 - protein, 202 aa, Diabrotica virgifera
  misc_feature: Coding regions on vcDNA: vcDNA=SeqID_14904; Strand=-; Position=1-606
  misc_feature (1)..(139): Xaa can be any naturally occurring amino acid
  misc_feature (142)..(179): Xaa can be any naturally occurring amino acid
  misc_feature (181)..(202): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRXXXXXXXXXXXXXXXXXXXXXX

SEQ ID NO: 35208 - protein, 249 aa, Diabrotica virgifera
  misc_feature: Coding regions on vcDNA: vcDNA=SeqID_14905; Strand=+; Position=2-748
  misc_feature: Homolog annotation: Hit_ID=AAF87760.1; Match level="QueryCoverage =98%, HitCoverage=55%, E-value=6e-94, Identity=74%"; Hit description =cytochrome oxidase subunit I [Diabrotica virgifera zeae]
  misc_feature: Pfam annotation: Pfam_ID=COX1; Match level="Score=-117.9, E-value =3.1e-07, Copies=1"; Pfam description=Cytochrome C and Quinol oxidase polyp
  misc_feature (25)..(25): Xaa can be any naturally occurring amino acid
  misc_feature (60)..(60): Xaa can be any naturally occurring amino acid
  misc_feature (77)..(77): Xaa can be any naturally occurring amino acid
  misc_feature (80)..(86): Xaa can be any naturally occurring amino acid
  misc_feature (113)..(119): Xaa can be any naturally occurring amino acid
  misc_feature (133)..(133): Xaa can be any naturally occurring amino acid
  misc_feature (141)..(157): Xaa can be any naturally occurring amino acid
  misc_feature (187)..(187): Xaa can be any naturally occurring amino acid
  misc_feature (203)..(210): Xaa can be any naturally occurring amino acid
  misc_feature (231)..(231): Xaa can be any naturally occurring amino acid
FTRPFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 35209 - protein, 158 aa, Diabrotica virgifera
  misc_feature: Coding regions on vcDNA: vcDNA=SeqID_14906; Strand=-; Position=1-474
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(157): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 35210 - protein, 88 aa, Diabrotica virgifera
  misc_feature: Coding regions on vcDNA: vcDNA=SeqID_14907; Strand=-; Position=68-334
QKSKTRSSNANNCGKPIYAMKHLMRSKLASRGENIQIYKTIIRPAVAVDFLYTQLLYEAFIELSGLYHIAEGSYRIFLWHATGLLRLL

SEQ ID NO: 35211 - protein, 64 aa, Diabrotica virgifera
  misc_feature: Coding regions on vcDNA: vcDNA=SeqID_14908; Strand=+; Position=382-576
  misc_feature (27)..(34): Xaa can be any naturally occurring amino acid
RLVVFFVLQWRRVTFSKVLPKPDVKNXXXXXXXXLPGISFCFQSCGIKLNKSLFPNYMYVIMYM

SEQ ID NO: 35212 - protein, 32 aa, Diabrotica virgifera
  misc_feature: Coding regions on vcDNA: vcDNA=SeqID_14909; Strand=-; Position=1-96
  misc_feature (3)..(3): Xaa can be any naturally occurring amino acid
  misc_feature (6)..(28): Xaa can be any naturally occurring amino acid
  misc_feature (30)..(30): Xaa can be any naturally occurring amino acid
KKXLDXXXXXXXXXXXXXXXXXXXXXXXIXIN

SEQ ID NO: 35213 - protein, 48 aa, Diabrotica virgifera
  misc_feature: Coding regions on vcDNA: vcDNA=SeqID_14910; Strand=-; Position=69-215
NEQYIFKFSSRDQNFHSKNYRVFLLTLIRTVPLLINCTFFTLSMNTLS

SEQ ID NO: 35214 - protein, 237 aa, Diabrotica virgifera
  misc_feature: Coding regions on vcDNA: vcDNA=SeqID_14911; Strand=+; Position=2-712
  misc_feature: Homolog annotation: Hit_ID=BAC82608.1; Match level="QueryCoverage =80%, HitCoverage=46%, E-value=3e-11, Identity=27%"; Hit description =gag-like protein [Danio rerio]
  misc_feature: Pfam annotation: Pfam_ID=zf-CCHC; Match level="Score=29.4, E-value =1.1e-05, Copies=1"; Pfam description=Zinc knuckle
LSSVCPTIPHDVLIRELKEMGLNLVSPITFLRIGASLPEYNHIKSFRRQVFVSPHSIMIPDSILINYESVTYRIFIAQDNLTCYACKQTGHISSKCPNTNNTLSPTQAQNSTSQNPTSTLISHSATDNGSQSHQAEDGDPNNINIQKPSSISSTPQTLLPTSEASKIIPTEENIPTKNPCEKTSEVMDQQASLGIIGESSSTSVKRSIDETLSPPIENLNTNNPTFALPQTPRQTNI

SEQ ID NO: 35215 - protein, 66 aa, Diabrotica virgifera
  misc_feature: Coding regions on vcDNA: vcDNA=SeqID_14912; Strand=-; Position=1-198
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(64): Xaa can be any naturally occurring amino acid
PFXXXXXXXXXXXTNLAHTGLNXXXXXXXXSNXXXXXXXXXXXXXXPNRGRXXXXXXXXXXXXXLL

SEQ ID NO: 35216 - protein, 52 aa, Diabrotica virgifera
  misc_feature: Coding regions on vcDNA: vcDNA=SeqID_14913; Strand=+; Position=2-157
  misc_feature (23)..(23): Xaa can be any naturally occurring amino acid
  misc_feature (27)..(27): Xaa can be any naturally occurring amino acid
  misc_feature (38)..(38): Xaa can be any naturally occurring amino acid
  misc_feature (40)..(50): Xaa can be any naturally occurring amino acid
MKYLAVFVRFAYLYAVFLLKRRXEENXRRGGGGKRKGXRXXXXXXXXXXXKG

SEQ ID NO: 35217 - protein, 204 aa, Diabrotica virgifera
  misc_feature: Coding regions on vcDNA: vcDNA=SeqID_14914; Strand=+; Position=1-615
  misc_feature: Homolog annotation: Hit_ID=NP_611099.2; Match level="QueryCoverage =79%, HitCoverage=30%, E-value=2e-44, Identity=52%"; Hit description =CG15706-PA [Drosophila melanogaster] gb|AAF58040.2| CG15706-PA [Drosophila melanogaster]
  misc_feature (7)..(13): Xaa can be any naturally occurring amino acid
SLASGFXXXXXXXSLEDLAEASQTTNIKLLEGIIVAAETLGGEVIFFSISGVILERFGHVHCFSMCFINYALRLGLLSVAPSPWWVVPIEFIFQGPTYALTYTTIVAYANELAPPGASATMQGIAAGMDDGFGYAIGSLLGGTLYKYFGGKPTIQIFSFIAVICSILHLVLHKTILKDGESADSSVEYKSPEDAIKIKLEKESD

SEQ ID NO: 35218 - protein, 66 aa, Diabrotica virgifera; identical to SEQ ID NO: 26808
  misc_feature: Coding regions on vcDNA: vcDNA=SeqID_14915; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35219 - protein, 21 aa, Diabrotica virgifera
  misc_feature: Coding regions on vcDNA: vcDNA=SeqID_14916; Strand=-; Position=1-63
  misc_feature (7)..(16): Xaa can be any naturally occurring amino acid
ISLQNLXXXXXXXXXXRTLIK

SEQ ID NO: 35220 - protein, 275 aa, Diabrotica virgifera
  misc_feature: Coding regions on vcDNA: vcDNA=SeqID_14917; Strand=-; Position=90-917
  misc_feature: Homolog annotation: Hit_ID=CAI01952.1; Match level="QueryCoverage =98%, HitCoverage=84%, E-value=2e-29, Identity=36%"; Hit description =hypothetical protein PB402192.00.0 [Plasmodium berghei]
  misc_feature: Gene Ontology Annotation: Molecular function=DNA-directed RNA polymerase II activity; Cellular component=extracellular space; Biological process=cell proliferation
  misc_feature (131)..(131): Xaa can be any naturally occurring amino acid
  misc_feature (201)..(201): Xaa can be any naturally occurring amino acid
KKTLTQNQTHTKNTTQKTKQPPKKTTPPTTPKKQPKKTTTNPPQKKQPKPSYHTTKNLHPPNPKKQKPSNKQKTTKTQPNQPLQTKPTTQKTQQTNHPNNIQTNHTPHTSNTQPPTPPTPHHKHNQKTTPXNTPSQTPKPNPNTPTQKPNNPNHKTNTPQQTKTQIKPTTKHQTPYKTTPPQTQKKQQHTPNTTKKQTHTXQTKTKPKHNKNPHLKPKKQQTQTKTKYQNKNTQPKNNTTKPKPTTPTPQKNQPKNPPHNNNNTHHHPHNTTKTT

SEQ ID NO: 35221 - protein, 101 aa, Diabrotica virgifera; identical to SEQ ID NO: 29675
  misc_feature: Coding regions on vcDNA: vcDNA=SeqID_14918; Strand=-; Position=173-478
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 35222 - protein, 66 aa, Diabrotica virgifera; identical to SEQ ID NO: 26808
  misc_feature: Coding regions on vcDNA: vcDNA=SeqID_14919; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35223 - protein, 295 aa, Diabrotica virgifera
  misc_feature: Coding regions on vcDNA: vcDNA=SeqID_14920; Strand=+; Position=3-887
  misc_feature (15)..(272): Xaa can be any naturally occurring amino acid
RFYIQKISNSCSSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDFKNPNSDKSKWITPDQLLDLY

SEQ ID NO: 35224 - protein, 304 aa, Diabrotica virgifera
  misc_feature: Coding regions on vcDNA: vcDNA=SeqID_14921; Strand=+; Position=3-914
  misc_feature: Homolog annotation: Hit_ID=XP_318550.1; Match level="QueryCoverage =85%, HitCoverage=28%, E-value=2e-33, Identity=32%"; Hit description =ENSANGP00000020240 [Anopheles gambiae]
  misc_feature: Pfam annotation: Pfam_ID=rve; Match level="Score=86.6, E-value=6.6e -23, Copies=1"; Pfam description=Integrase core domain
SRVRDDAFVTEIVHTINITDERREEFIAETKQDKKLQLIKDFCEKGWPSCSSRVPYVVKDYFSIRHDIYILNDLIFYMDRVIVPDSLRPRMLKFLHETHFGVTKTQQRARQVLFWPNMNKDIVDLVRNCVDCEKYHRSNVKEPLILREIPELPFQMLAADICEFGGASYLIVMDYLTKWIEIVLLPSKTSQSIIKSFKTMFATHGIPLEIVSDNMPFGSKECREFSREWNFKFVTSSPRYPRSNGQAERAVQIAKNILRKCGDLQLALLEYRNTPLLGSDKSPAQLLNSRRLRKQLPVLHEKYL

SEQ ID NO: 35225 - protein, 265 aa, Diabrotica virgifera
  misc_feature: Coding regions on vcDNA: vcDNA=SeqID_14922; Strand=+; Position=44-838
  misc_feature: Homolog annotation: Hit_ID=XP_309981.1; Match level="QueryCoverage =92%, HitCoverage=66%, E-value=8e-24, Identity=26%"; Hit description =ENSANGP00000015105 [Anopheles gambiae]
  misc_feature: Gene Ontology Annotation: Molecular function=tocopherol binding; Cellular component=cytosol; Biological process=transport
  misc_feature: Pfam annotation: Pfam_ID=CRAL_TRIO; Match level="Score=-10.3, E-value= 0.00024, Copies=1"; Pfam description=CRAL/TRIO domain
  misc_feature (26)..(26): Xaa can be any naturally occurring amino acid
  misc_feature (45)..(51): Xaa can be any naturally occurring amino acid
MSVCDKNVNVDECTEIVRKKIKDVKXDDIYIQRFLYSTGCLDTEXXXXXXXLYHETIVKIPDYYPKLGPKDIKDVLDMNFSVVLDDCDKEGRPIYYEKMERLDPARLTSMDVIAAEEIWFEYILSRHPGKAGKGLCMLVDSSGYSWKLFKWLTPSALSNGRRKIDAIPFKEIQVHIVNHSLMVDVALKLAWPFVPEERKKTVHCYFNNYETLFEHIDKSVLPAEYGGENEVNFTKLTQKLYDRNEEIQEIFSCTMLLNYKEKNRG

SEQ ID NO: 35226 - protein, 273 aa, Diabrotica virgifera
  misc_feature: Coding regions on vcDNA: vcDNA=SeqID_14923; Strand=+; Position=206 -1024
  misc_feature (26)..(46): Xaa can be any naturally occurring amino acid
  misc_feature (49)..(128): Xaa can be any naturally occurring amino acid
  misc_feature (132)..(148): Xaa can be any naturally occurring amino acid
  misc_feature (150)..(209): Xaa can be any naturally occurring amino acid
  misc_feature (215)..(237): Xaa can be any naturally occurring amino acid
  misc_feature (239)..(258): Xaa can be any naturally occurring amino acid
  misc_feature (260)..(270): Xaa can be any naturally occurring amino acid
DKDVKVSDILCLEWNVIRFYIYSIFXXXXXXXXXXXXXXXXXXXXXILXXXXXXXXXXXXXXXXXXXXXXXXXXXXXXXXXXXXXXXXXXXXXXXXXXXXXXXXXXXXXXXXXXXXXXXXXXXXXXXXEFGXXXXXXXXXXXXXXXXXEXXXXXXXXXXXXXXXXXXXXXXXXXXXXXXXXXXXXXXXXXXXXXXXXXXXXXXXXXXXXKDPIEXXXXXXXXXXXXXXXXXXXXXXXGXXXXXXXXXXXXXXXXXXXXEXXXXXXXXXXXFWE

SEQ ID NO: 35227 - protein, 174 aa, Diabrotica virgifera
  misc_feature: Coding regions on vcDNA: vcDNA=SeqID_14924; Strand=+; Position=412-935
  misc_feature: Homolog annotation: Hit_ID=XP_486434.1; Match level="QueryCoverage =38%, HitCoverage=37%, E-value=3e-11, Identity=49%"; Hit description =similar to hypothetical protein FLJ14345 [Mus musculus]
  misc_feature: Gene Ontology Annotation: Molecular function=transcriptional repressor activity; Biological process=neuroblast cell fate determination
  misc_feature: Pfam annotation: Pfam_ID=zf-C2H2; Match level="Score=44.4, E-value =3.4e-10, Copies=2"; Pfam description=Zinc finger, C2H2 type
  misc_feature (163)..(163): Xaa can be any naturally occurring amino acid
  misc_feature (170)..(170): Xaa can be any naturally occurring amino acid
MSAMDFKVEIKDEPVEYIQKDTESQLSTSIDLENFKNEKEDKSEMGLKAEIKEEFSDGYQIDDQLFTSPDLKDLVKADENNSGFSQNGMEIVKTELTCTTEQQISANTEETTSRNSICECKICFKQFSQAGSLKQHIKTHNAEKRYKCENLFKQFSQKQNLRXHLRLHTXETPL

SEQ ID NO: 35228 - protein, 77 aa, Diabrotica virgifera
  misc_feature: Coding regions on vcDNA: vcDNA=SeqID_14925; Strand=-; Position=1-231
  misc_feature (69)..(75): Xaa can be any naturally occurring amino acid
SIYLMTHDYYNSIFIRAYGISLVSRVSGDNYLVRKYFIMSQSTASDTLYHFIQHISKEQDGSRVNSFRXXXXXXXRE

SEQ ID NO: 35229 - protein, 66 aa, Diabrotica virgifera; identical to SEQ ID NO: 26808
  misc_feature: Coding regions on vcDNA: vcDNA=SeqID_14926; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35230 - protein, 57 aa, Diabrotica virgifera
  misc_feature: Coding regions on vcDNA: vcDNA=SeqID_14927; Strand=-; Position=1-171
  misc_feature (3)..(56): Xaa can be any naturally occurring amino acid
KNXXXXXXXXXXXXXXXXXXXXXXXXXXXXXXXXXXXXXXXXXXXXXXXXXXXXXXN

SEQ ID NO: 35231 - protein, 243 aa, Diabrotica virgifera
  misc_feature: Coding regions on vcDNA: vcDNA=SeqID_14928; Strand=-; Position=2-730
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(237): Xaa can be any naturally occurring amino acid
  misc_feature (239)..(243): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 35232 - protein, 145 aa, Diabrotica virgifera
  misc_feature: Coding regions on vcDNA: vcDNA=SeqID_14929; Strand=+; Position=535-969
  misc_feature: Homolog annotation: Hit_ID=XP_311849.1; Match level="QueryCoverage =95%, HitCoverage=78%, E-value=6e-50, Identity=47%"; Hit description =ENSANGP00000018251 [Anopheles gambiae]
  misc_feature: Gene Ontology Annotation: Molecular function=transcription factor activity; Cellular component=integral to plasma membrane; Biological process=N signaling pathway
PRKFSSYSSTTCTSGTCGQNAQCQVVGGRPVCSCLRGHSGDPLSLCRREECLDDGECRGQLACRGGKCIDPCVGTCGVNANCEARRGVPVCTCPAGYTGDPITSCRRFNPEELCHPSPLRPNTHCEVKNEVPTCSCLPGFHGSPL

SEQ ID NO: 35233 - protein, 156 aa, Diabrotica virgifera
  misc_feature: Coding regions on vcDNA: vcDNA=SeqID_14930; Strand=+; Position=207-677
  misc_feature: Homolog annotation: Hit_ID=XP_307144.1; Match level="QueryCoverage =94%, HitCoverage=40%, E-value=2e-24, Identity=38%"; Hit description =ENSANGP00000024852 [Anopheles gambiae]
  misc_feature (46)..(46): Xaa can be any naturally occurring amino acid
  misc_feature (91)..(91): Xaa can be any naturally occurring amino acid
KKKCKHPVYKTVIRPIGLYASETWTMSKSGQVLLIVWERKVIKNIXGKIWNGMWIRRPNVELERMYGEPNIVGIIKSQIRWLGHIQRIPNXETSQKNTNGRNRRKKRKGRPKTRWKKDVEKYIEELKITNWKNNAANRRDWKGIVNQAMGLLGLES

SEQ ID NO: 35234 - protein, 58 aa, Diabrotica virgifera
  misc_feature: Coding regions on vcDNA: vcDNA=SeqID_14931; Strand=-; Position=44-220
RSHYNKSGSVATLAVGIRNYIVYSSHALIRVSNLDGRNFSSIQVIPRPSLAVDQSVKS

SEQ ID NO: 35235 - protein, 315 aa, Diabrotica virgifera
  misc_feature: Coding regions on vcDNA: vcDNA=SeqID_14932; Strand=-; Position=2-946
  misc_feature (3)..(10): Xaa can be any naturally occurring amino acid
  misc_feature (22)..(35): Xaa can be any naturally occurring amino acid
  misc_feature (37)..(314): Xaa can be any naturally occurring amino acid
GTXXXXXXXXPIINFYPTSSSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXK

SEQ ID NO: 35236 - protein, 76 aa, Diabrotica virgifera
  misc_feature: Coding regions on vcDNA: vcDNA=SeqID_14933; Strand=+; Position=129-359
  misc_feature (17)..(30): Xaa can be any naturally occurring amino acid
  misc_feature (37)..(46): Xaa can be any naturally occurring amino acid
NKLQSESIFFHIFCCIXXXXXXXXXXXXXXRHYFTIXXXXXXXXXXLQYFVIFHVLTYPQISILDFFFALVFFDWT

SEQ ID NO: 35237 - protein, 38 aa, Diabrotica virgifera
  misc_feature: Coding regions on vcDNA: vcDNA=SeqID_14934; Strand=-; Position=1-114
  misc_feature (1)..(38): Xaa can be any naturally occurring amino acid
XXXXXXXXXXXXXXXXXXXXXXXXXXXXXXXXXXXXXX

SEQ ID NO: 35238 - protein, 66 aa, Diabrotica virgifera
  misc_feature: Coding regions on vcDNA: vcDNA=SeqID_14935; Strand=-; Position=1-198
  misc_feature (3)..(13): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
SFXXXXXXXXXXXTNLAHTGLNXXXXXXXXRTXXXXXXXXXXXXXIQHRGRXXXXXXXXXXXXXLL

SEQ ID NO: 35239 - protein, 273 aa, Diabrotica virgifera
  misc_feature: Coding regions on vcDNA: vcDNA=SeqID_14936; Strand=+; Position=88-909
  misc_feature: Homolog annotation: Hit_ID=NP_608744.1; Match level="QueryCoverage =97%, HitCoverage=75%, E-value=9e-49, Identity=35%"; Hit description =CG17260-PA [Drosophila melanogaster] gb|AAF51154.1| CG17260-PA [Drosophila melanogaster]
  misc_feature (82)..(87): Xaa can be any naturally occurring amino acid
MGLIDDELTEVRKLCEHVVPGTKLVSCVRTMVRAEIKRTDFKKIVVCIQFPTDYPKVPLLIELKSKTLSEKLLQKLTDVCEXXXXXXLGKPQVLNTIKFLRNFIDENALSCCYDEITNIRKLLQSEDEIKLKQKSSSITLKINNSKYFLVCKVFIPDDYPISAIGIQEADTNFSPALQCHMLAQAKEIARKCVEPPLHKRPNQPPFQPGPSLQKSIEFLIDCVKRLPGETCQFCNKICFPPNPEQLEKDENSPKHIERIYCGHLFHQIVFSIT

SEQ ID NO: 35240 - protein, 104 aa, Diabrotica virgifera
  misc_feature: Coding regions on vcDNA: vcDNA=SeqID_14937; Strand=-; Position=530-844
  misc_feature (75)..(93): Xaa can be any naturally occurring amino acid
KHDNKIYRYMKVVIPYEALVPVVIPDGNHSFGYFLCFAVLLELLDIRLYIYLFTFSTVIPAVQKNRSTKNLVRSXXXXXXXXXXXXXXXXXXXVISILLLLQYC

SEQ ID NO: 35241 - protein, 101 aa, Diabrotica virgifera
  misc_feature: Coding regions on vcDNA: vcDNA=SeqID_14938; Strand=-; Position=133-438
HGKFIIISMYINVKYAGKGEYKKKGYFIICLNKPRCSFTKLLLKFSKNIQVYVHVLLLQVPTKNPTCFHFMGLVLTNIGQFIATIFFFEHLINKWRMTSIV

SEQ ID NO: 35242 - protein, 114 aa, Diabrotica virgifera
  misc_feature: Coding regions on vcDNA: vcDNA=SeqID_14939; Strand=-; Position=25-369
  misc_feature (5)..(33): Xaa can be any naturally occurring amino acid
  misc_feature (49)..(73): Xaa can be any naturally occurring amino acid
  misc_feature (84)..(96): Xaa can be any naturally occurring amino acid
  misc_feature (99)..(106): Xaa can be any naturally occurring amino acid
ILDHXXXXXXXXXXXXXXXXXXXXXXXXXXXXXNNISITKKLCIIFIFXXXXXXXXXXXXXXXXXXXXXXXXXIHKIQIINHSXXXXXXXXXXXXXFLXXXXXXXXGVAAILSM

SEQ ID NO: 35243 - protein, 285 aa, Diabrotica virgifera
  misc_feature: Coding regions on vcDNA: vcDNA=SeqID_14940; Strand=+; Position=1-855
  misc_feature (5)..(48): Xaa can be any naturally occurring amino acid
  misc_feature (51)..(205): Xaa can be any naturally occurring amino acid
  misc_feature (209)..(209): Xaa can be any naturally occurring amino acid
  misc_feature (214)..(214): Xaa can be any naturally occurring amino acid
  misc_feature (216)..(285): Xaa can be any naturally occurring amino acid
LNGVXXXXXXXXXXXXXXXXXXXXXXXXXXXXXXXXXXXXXXXXXXXXCVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFFXCLLKXCXXXXXXXXXXXXXXXXXXXXXXXXXXXXXXXXXXXXXXXXXXXXXXXXXXXXXXXXXXXXXXXXXXXXXX

SEQ ID NO: 35244 - protein, 52 aa, Diabrotica virgifera
  misc_feature: Coding regions on vcDNA: vcDNA=SeqID_14941; Strand=+; Position=164-322
  misc_feature (20)..(31): Xaa can be any naturally occurring amino acid
NAIFKQKKQQIKKNFNFRGXXXXXXXXXXXXSLFTNNYMTVVTSHFCCQSCV

SEQ ID NO: 35245 - protein, 210 aa, Diabrotica virgifera
  misc_feature: Coding regions on vcDNA: vcDNA=SeqID_14942; Strand=-; Position=328-960
  misc_feature (20)..(26): Xaa can be any naturally occurring amino acid
  misc_feature (30)..(42): Xaa can be any naturally occurring amino acid
  misc_feature (62)..(182): Xaa can be any naturally occurring amino acid
IPKKRLFNKCYKTFIRVFLXXXXXXXAFLXXXXXXXXXXXXXKFFYTTVLFIFIYPIRVLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDTIESTVDMHINTVMIHLESEVLSRVR

SEQ ID NO: 35246 - protein, 223 aa, Diabrotica virgifera
  misc_feature: Coding regions on vcDNA: vcDNA=SeqID_14943; Strand=+; Position=2-674
  misc_feature: Homolog annotation: Hit_ID=EAA00040.2; Match level="QueryCoverage =99%, HitCoverage=31%, E-value=1e-33, Identity=35%"; Hit description =ENSANGP00000014120 [Anopheles gambiae str. PEST] ref|XP_552496.1| ENSANGP00000014120 [Anopheles gambiae st
  misc_feature (179)..(179): Xaa can be any naturally occurring amino acid
LFLLGVFWSAIDSFLPWHIVNEENGEPLVIGMTVTVGAIPAVIFLIFAEIFVDYCGHNNILIFCFVNYICHHLGLMFFDNAWYILICEWLEVFTLHIMYITTVLYLRHLVPRKFTACGQALPIIAHFCLGRCIGVVLGGLAFSDFNSEYVFQNVHKYFCVAAVVVAIIYFCLYHFYLKXYCIPPVHLPPAPAPALIQSMNGNGAYTPLRVYHNSKSKKGHFRY

SEQ ID NO: 35247 - protein, 193 aa, Diabrotica virgifera
  misc_feature: Coding regions on vcDNA: vcDNA=SeqID_14944; Strand=-; Position=84-661
  misc_feature: Homolog annotation: Hit_ID=CAD22154.1; Match level="QueryCoverage =99%, HitCoverage=54%, E-value=2e-51, Identity=49%"; Hit description =pherophorin-dz1 protein [Volvox carteri f. nagariensis]
  misc_feature: Gene Ontology Annotation: Molecular function=profilin binding; Cellular component=extracellular space; Biological process=actin filament organization
  misc_feature (18)..(18): Xaa can be any naturally occurring amino acid
  misc_feature (25)..(25): Xaa can be any naturally occurring amino acid
QPPPSPTTPPTPPTPPTXSPPPHPXPPTQHYPPPNPPQTPPPTPLPNPPPPPLLSPPPPTPPTPPLPQSPQPPSQPSTVPPPNPPLPPNPMPSPSSPTPITSPTLYLAPNPPPPPLPTRPAFPLPPFLLPPSPISTHPIPHHHPPRPANKHQPTTLPPTLPNKIPTTPPPHPPHPAPHPTPTPRPNPPTPQNP

SEQ ID NO: 35248 - protein, 66 aa, Diabrotica virgifera; identical to SEQ ID NO: 26808
  misc_feature: Coding regions on vcDNA: vcDNA=SeqID_14945; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35249 - protein, 230 aa, Diabrotica virgifera
  misc_feature: Coding regions on vcDNA: vcDNA=SeqID_14946; Strand=+; Position=64-756
  misc_feature: Homolog annotation: Hit_ID=EAA11343.2; Match level="QueryCoverage =78%, HitCoverage=56%, E-value=5e-44, Identity=44%"; Hit description =ENSANGP00000018286 [Anopheles gambiae str. PEST] ref|XP_556196.1| ENSANGP00000018286 [Anopheles gambiae st
  misc_feature: Gene Ontology Annotation: Molecular function=binding; Cellular component=soluble fraction; Biological process=vitamin A metabolism
  misc_feature: Pfam annotation: Pfam_ID=CRAL_TRIO_N; Match level="Score=12.8, E -value=0.0013, Copies=1"; Pfam description=CRAL/TRIO, N-terminus
MTTSELIMVNSWNDHYNTDSCNIKIKNKKLKKELYEIASRELRESESSRKECLEHLRNWIKQNPDIENCLTDDTFLLRFLRVKKFSIPMAEQTLLKYLNYRKRFKYFMHNLDCCEPNVSEIIGDGFLYVSPFRDTCGRRVVLYDVSKFNLEKFNGADLAKVFSITYETLTDDEENQILGVKHVGNLEGASLNYIPLFTISDFAVMIRWGDEPAAMKRPIPFFLQCSLKKH

SEQ ID NO: 35250 - protein, 45 aa, Diabrotica virgifera
  misc_feature: Coding regions on vcDNA: vcDNA=SeqID_14947; Strand=-; Position=1-135
  misc_feature (9)..(9): Xaa can be any naturally occurring amino acid
  misc_feature (11)..(11): Xaa can be any naturally occurring amino acid
  misc_feature (15)..(16): Xaa can be any naturally occurring amino acid
  misc_feature (19)..(21): Xaa can be any naturally occurring amino acid
  misc_feature (24)..(24): Xaa can be any naturally occurring amino acid
  misc_feature (26)..(28): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
FLLLLLRNXNXKTFXXILXXXTIXLXXXFLGRNLTHXTXIXTLVR

SEQ ID NO: 35251 - protein, 179 aa, Diabrotica virgifera
  misc_feature: Coding regions on vcDNA: vcDNA=SeqID_14948; Strand=+; Position=7-546
MRIEDASQKQTVGAAIRQVYTDGLFIDKIGNAVEFFSDTSFGRSIIHHAKKQSQFSDVYFYQFSYYGSIPGVRPYIEGAYKVAHSDDNQYIWVSMNNSNLNTYPKGDVLTSERFLTLFTNFAKSLDPVANNTELLGITSWPKVTPNDFHYLDINETLTIKKDLKRDVYEGWVKVYEDTF

SEQ ID NO: 35252 - protein, 20 aa, Diabrotica virgifera
  misc_feature: Coding regions on vcDNA: vcDNA=SeqID_14949; Strand=-; Position=1-60
  misc_feature (3)..(17): Xaa can be any naturally occurring amino acid
INXXXXXXXXXXXXXXXAFN

SEQ ID NO: 35253 - protein, 42 aa, Diabrotica virgifera
  misc_feature: Coding regions on vcDNA: vcDNA=SeqID_14950; Strand=-; Position=0-125
  misc_feature (2)..(39): Xaa can be any naturally occurring amino acid
FXXXXXXXXXXXXXXXXXXXXXXXXXXXXXXXXXXXXXXLLT

SEQ ID NO: 35254 - protein, 41 aa, Diabrotica virgifera
  misc_feature: Coding regions on vcDNA: vcDNA=SeqID_14951; Strand=-; Position=100-225
VLHTIYWNSCIFIYNYREIKNTAPKAIKLSDIKLALASRIS

SEQ ID NO: 35255 - protein, 34 aa, Diabrotica virgifera
  misc_feature: Coding regions on vcDNA: vcDNA=SeqID_14952; Strand=-; Position=85-189
FYWGVQIDNKDCALDVGLKFIIGVAAILLSLFDF

SEQ ID NO: 35256 - protein, 90 aa, Diabrotica virgifera
  misc_feature: Coding regions on vcDNA: vcDNA=SeqID_14953; Strand=+; Position=138-410
  misc_feature (18)..(25): Xaa can be any naturally occurring amino acid
  misc_feature (57)..(63): Xaa can be any naturally occurring amino acid
  misc_feature (65)..(84): Xaa can be any naturally occurring amino acid
LYNTGRFFNEAIASICSXXXXXXXXSNFLKYANRLLKLTYFFLINLKKSLLPIFFQXXXXXXXLXXXXXXXXXXXXXXXXXXXXVPFKYF

SEQ ID NO: 35257 - protein, 86 aa, Diabrotica virgifera
  misc_feature: Coding regions on vcDNA: vcDNA=SeqID_14954; Strand=+; Position=3-264
  misc_feature: Homolog annotation: Hit_ID=XP_307144.1; Match level="QueryCoverage =77%, HitCoverage=18%, E-value=1e-09, Identity=44%"; Hit description =ENSANGP00000024852 [Anopheles gambiae]
  misc_feature (50)..(50): Xaa can be any naturally occurring amino acid
  misc_feature (67)..(67): Xaa can be any naturally occurring amino acid
SVYKLISLSTTIVYKTLIRIVLTHGADTWRPTQSDQELLKRFERKIVRRXYGEIKEQGLWRRRCNFXLYRSFGESNVVKFMHTFDG

SEQ ID NO: 35258 - protein, 205 aa, Diabrotica virgifera
  misc_feature: Coding regions on vcDNA: vcDNA=SeqID_14955; Strand=+; Position=2-619
  misc_feature (10)..(23): Xaa can be any naturally occurring amino acid
  misc_feature (28)..(61): Xaa can be any naturally occurring amino acid
  misc_feature (67)..(100): Xaa can be any naturally occurring amino acid
  misc_feature (104)..(123): Xaa can be any naturally occurring amino acid
  misc_feature (127)..(156): Xaa can be any naturally occurring amino acid
  misc_feature (159)..(164): Xaa can be any naturally occurring amino acid
  misc_feature (167)..(173): Xaa can be any naturally occurring amino acid
YRDRKIIVRXXXXXXXXXXXXXXSCVSXXXXXXXXXXXXXXXXXXXXXXXXXXXXXXXXXXKRSDTXXXXXXXXXXXXXXXXXXXXXXXXXXXXXXXXXXGEDXXXXXXXXXXXXXXXXXXXXHIIXXXXXXXXXXXXXXXXXXXXXXXXXXXXXXRGXXXXXXIVXXXXXXXGIIGVLHHFFLMCILKMCLCVLYIDSPLPCDY

SEQ ID NO: 35259 - protein, 91 aa, Diabrotica virgifera
  misc_feature: Coding regions on vcDNA: vcDNA=SeqID_14956; Strand=-; Position=24-299
LVYHFLTLEGRAGRTSAIEMQTISVICSTLENAYTEGAPPYRSHISSDGPYLDYRFGQYVRYASYWPFFAVSYHDIQATVGFYLRELYFRW

SEQ ID NO: 35260 - protein, 310 aa, Diabrotica virgifera
  misc_feature: Coding regions on vcDNA: vcDNA=SeqID_14957; Strand=+; Position=2-931
  misc_feature: Homolog annotation: Hit_ID=XP_341509.1; Match level="QueryCoverage =94%, HitCoverage=22%, E-value=2e-13, Identity=27%"; Hit description =nucleoporin 153kD [Rattus norvegicus]
  misc_feature: Gene Ontology Annotation: Molecular function=structural molecule activity; Cellular component=nuclear pore; Biological process =protein-nucleus import
GRVGCSTFTKVPTPVGTETKLNSSTTPTFSFGVKPSTEKKPEVEPPQPGGSKAVAVVSGTVLPEKTSSTISTFAKPEEKTALPTVAAAKELSTAPTAAVNDLNSASHKPAFSFAADKSKPIAKFEFSKPAVPAATNSVEPPPNKVIKSSLNPGFSFGKAVNSAGASTAPVFGQNTPSATPVFGQDTATSQSTFGQNSSTGITLFGQNKSSSSTSGNNGIDAKPAPAFGIPAKPAVDLPPTNTTVSKSFSFTKPNVEPATNAPVFNFGQSASQAVSAATTQSSGFSFGQAAKAPVFSFTGAKTDSGSTTNM

SEQ ID NO: 35261 - protein, 17 aa, Diabrotica virgifera
  misc_feature: Coding regions on vcDNA: vcDNA=SeqID_14958; Strand=-; Position=1-51
  misc_feature (1)..(17): Xaa can be any naturally occurring amino acid
XXXXXXXXXXXXXXXXX

SEQ ID NO: 35262 - protein, 57 aa, Diabrotica virgifera
  misc_feature: Coding regions on vcDNA: vcDNA=SeqID_14959; Strand=-; Position=783-956
  misc_feature (2)..(8): Xaa can be any naturally occurring amino acid
  misc_feature (16)..(16): Xaa can be any naturally occurring amino acid
EXXXXXXXYKNYIITXNIISPKIFVFFKCKKCSICLCIFLWYTFIKIYVVQSIWFLF

SEQ ID NO: 35263 - protein, 311 aa, Diabrotica virgifera
  misc_feature: Coding regions on vcDNA: vcDNA=SeqID_14960; Strand=-; Position=35-972
  misc_feature: Homolog annotation: Hit_ID=NP_000456.1; Match level="QueryCoverage =98%, HitCoverage=40%, E-value=1e-27, Identity=28%"; Hit description =BRCA1 associated RING domain 1 [Homo sapiens] gb|AAB38316.1| BRCA1 -associated RING domain
  misc_feature: Gene Ontology Annotation: Molecular function=transcription factor activity; Cellular component=nucleus; Biological process=regulation of transcription, DNA-dependent
  misc_feature: Pfam annotation: Pfam_ID=Ank; Match level="Score=52.7, E-value=1e-12, Copies=2"; Pfam description=Ankyrin repeat
  misc_feature (14)..(14): Xaa can be any naturally occurring amino acid
MLMLQDFSGWGPFXKLIERGSLEIVEMLLKHGALTNVPGQDYTTPLHKAVSCRNKSIIRLLLQYGADRNALDYFGKKPLECIDDPNEFKSIFLEQVDLIRQEPQLFCLKQMVAFCYYTDTIYKNKLKQYDCKKVTHFIIKKTHKISVKILTAMLEGCTIIPQEYIDDYVDNNYFIPITDYKFVDLPLLNIGIQKSIMNDMLKLPKLFDGISFYITGHVDMVNMNGCNVQKDNLATIIKAGGGQILQRAPTPSTCEKKVYFPFHAAKSNAKCCNYIVYEESNPPVLMYHMPELKHKSSKWLIDCVVNFAILD

SEQ ID NO: 35264 - protein, 65 aa, Diabrotica virgifera
  misc_feature: Coding regions on vcDNA: vcDNA=SeqID_14961; Strand=+; Position=9-206
  misc_feature (26)..(32): Xaa can be any naturally occurring amino acid
MFIISLSSSSPQQWSKWPGFIILQMXXXXXXXVKIITKHNSYILKSKTTKKEKVACKKHWLPIVA

SEQ ID NO: 35265 - protein, 226 aa, Diabrotica virgifera
  misc_feature: Coding regions on vcDNA: vcDNA=SeqID_14962; Strand=+; Position=37-717
  misc_feature: Homolog annotation: Hit_ID=AAV34821.1; Match level="QueryCoverage =94%, HitCoverage=98%, E-value=7e-94, Identity=80%"; Hit description =ribosomal protein L10A [Bombyx mori]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=186.8, E -value=4.5e-53, Copies=1"; Pfam description=Ribosomal protein L1p/L10e family
  misc_feature (21)..(29): Xaa can be any naturally occurring amino acid
  misc_feature (88)..(99): Xaa can be any naturally occurring amino acid
  misc_feature (215)..(215): Xaa can be any naturally occurring amino acid
MTSKVSRDTLYECVNGVLENXXXXXXXXXETVELQIGLKNYDPQKDKRFSGTVKLKHIPRPKMQVCILGDQQHCDEANANNVPFMDVXXXXXXXXXXXXVKKLAKKYDAFLASEALIKQIPRLLGPGLNKAGKFPGLLSHQESMTQKIDEVKATIKFQMKKVLCLSVAVGHVGMNQDELVQNVHLSINFLVSLLKKHWQNVRSLHVKSSMGPPQXRLLFTHLNVGI

SEQ ID NO: 35266 - protein, 178 aa, Diabrotica virgifera
  misc_feature: Coding regions on vcDNA: vcDNA=SeqID_14963; Strand=-; Position=1-534
  misc_feature (1)..(122): Xaa can be any naturally occurring amino acid
  misc_feature (125)..(161): Xaa can be any naturally occurring amino acid
  misc_feature (164)..(178): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISXXXXXXXXXXXXXXXXXXXXXXXXXXXXXXXXXXXXXPRXXXXXXXXXXXXXXX

SEQ ID NO: 35267 - protein, 26 aa, Diabrotica virgifera
  misc_feature: Coding regions on vcDNA: vcDNA=SeqID_14964; Strand=-; Position=1-78
  misc_feature (1)..(25): Xaa can be any naturally occurring amino acid
XXXXXXXXXXXXXXXXXXXXXXXXXQ

SEQ ID NO: 35268 - protein, 57 aa, Diabrotica virgifera
  misc_feature: Coding regions on vcDNA: vcDNA=SeqID_14965; Strand=-; Position=1-171
  misc_feature (2)..(57): Xaa can be any naturally occurring amino acid
TXXXXXXXXXXXXXXXXXXXXXXXXXXXXXXXXXXXXXXXXXXXXXXXXXXXXXXXX

SEQ ID NO: 35269 - protein, 76 aa, Diabrotica virgifera
  misc_feature: Coding regions on vcDNA: vcDNA=SeqID_14966; Strand=+; Position=432-662
TEKYPNSDIISQSHTLQNECNKQAKHGRLNMNYKLICGVAEYRFTPIQISHNKIRTLSIRIGNKHVANMIFKLQTV

SEQ ID NO: 35270 - protein, 180 aa, Diabrotica virgifera
  misc_feature: Coding regions on vcDNA: vcDNA=SeqID_14967; Strand=+; Position=379-918
  misc_feature: Homolog annotation: Hit_ID=AAH65357.1; Match level="QueryCoverage =98%, HitCoverage=22%, E-value=1e-81, Identity=84%"; Hit description =Cullin 3 [Danio rerio]
  misc_feature: Gene Ontology Annotation: Molecular function=molecular_function unknown; Cellular component=cellular_component unknown; Biological process=induction of apoptosis by intracellular signals
  misc_feature: Pfam annotation: Pfam_ID=Cullin; Match level="Score=-3.4, E-value=1e -07, Copies=1"; Pfam description=Cullin family
  misc_feature (142)..(142): Xaa can be any naturally occurring amino acid
MSSIKSGGLTKKEGKMRIRAFPMTMDEKYVESIWALLKNAIQEIQKKNNSGLSFEELYRNAYTMVLHKHGERLYTGLKEVVTQHLVKVREDVLRSLHNNFLMTLNQAWNDHQTSMVMIRDILMYMDRVYVQQNDVDNVYNLXLIIFRDQVVRYGCIRDHLRETLLDMVMRERRGEKVIEF

SEQ ID NO: 35271 - protein, 204 aa, Diabrotica virgifera
  misc_feature: Coding regions on vcDNA: vcDNA=SeqID_14968; Strand=+; Position=270-884
  misc_feature: Homolog annotation: Hit_ID=NP_610359.2; Match level="QueryCoverage =75%, HitCoverage=14%, E-value=2e-43, Identity=58%"; Hit description =CG8709-PA [Drosophila melanogaster] gb|AAF59125.2| CG8709-PA [Drosophila melanogaster]
  misc_feature: Gene Ontology Annotation: Molecular function=molecular_function unknown; Cellular component=nucleus; Biological process=adipocyte differentiation
  misc_feature: Pfam annotation: Pfam_ID=Lipin_N; Match level="Score=224.4, E-value =2.1e-64, Copies=1"; Pfam description=lipin, N-terminal conserved region
MHGMMKIFSNFKDFYNDINGATLTGAIDVIVVEQPDGSYNCSPFHVRFGKLGVLRSREKVVDIEINGEPQEIHMKLGESGEAFFVEELEEDDDEEIPEHLATSPIPVSDFETLFKKQGRRLSLEDISNLGLENEENDYKTRRNTADNESNKMRERNFIRRQLVLGNLEINNENSAEEMTLSIISGKLSSEDLSKSHNDISETIF

SEQ ID NO: 35272 - protein, 66 aa, Diabrotica virgifera; identical to SEQ ID NO: 26808
  misc_feature: Coding regions on vcDNA: vcDNA=SeqID_14969; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35273 - protein, 33 aa, Diabrotica virgifera
  misc_feature: Coding regions on vcDNA: vcDNA=SeqID_14970; Strand=+; Position=1-99
  misc_feature (2)..(25): Xaa can be any naturally occurring amino acid
  misc_feature (29)..(29): Xaa can be any naturally occurring amino acid
KXXXXXXXXXXXXXXXXXXXXXXXXNYLXYKFI

SEQ ID NO: 35274 - protein, 52 aa, Diabrotica virgifera
  misc_feature: Coding regions on vcDNA: vcDNA=SeqID_14971; Strand=+; Position=820-978
  misc_feature (29)..(29): Xaa can be any naturally occurring amino acid
  misc_feature (34)..(34): Xaa can be any naturally occurring amino acid
LCLANTEFLFYSLEFLLILISIRIYCFIXVHVLXVIAADIAIFYKNNESRGV

SEQ ID NO: 35275 - protein, 76 aa, Diabrotica virgifera
  misc_feature: Coding regions on vcDNA: vcDNA=SeqID_14972; Strand=-; Position=0-227
KHLSLEEERVIFFMHTCVLYMNSSSKINASYFSLQKTSEKSSENQRSAIQNVTLERCKNYHVFMNARQLYNTSKAA

SEQ ID NO: 35276 - protein, 290 aa, Diabrotica virgifera
  misc_feature: Coding regions on vcDNA: vcDNA=SeqID_14973; Strand=-; Position=0-869
  misc_feature (3)..(14): Xaa can be any naturally occurring amino acid
  misc_feature (22)..(22): Xaa can be any naturally occurring amino acid
  misc_feature (24)..(31): Xaa can be any naturally occurring amino acid
  misc_feature (34)..(46): Xaa can be any naturally occurring amino acid
  misc_feature (53)..(65): Xaa can be any naturally occurring amino acid
  misc_feature (68)..(289): Xaa can be any naturally occurring amino acid
SFXXXXXXXXXXXXPTWLTPVXTXXXXXXXXRTXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 35277 - protein, 216 aa, Diabrotica virgifera
  misc_feature: Coding regions on vcDNA: vcDNA=SeqID_14974; Strand=+; Position=277-927
  misc_feature: Homolog annotation: Hit_ID=XP_312929.1; Match level="QueryCoverage =55%, HitCoverage=28%, E-value=6e-09, Identity=25%"; Hit description =ENSANGP00000014719 [Anopheles gambiae]
  misc_feature: Pfam annotation: Pfam_ID=DUF227; Match level="Score=62.2, E-value =1.4e-15, Copies=1"; Pfam description=Domain of unknown function (DUF227)
MENHKIVSYIRKALRADCYEDFSIELQGKPKKTEGYASDMVFAKIRLADSDKKIQEYHLAIKFSKASMRKFEVFRNVYKNELLFYKEIMEVFNDHQNKQNVSKPFKAVAKCHATFSDEDVDIIFLDNLYQQGYILHDRHISMNMNHLKLLMKTYAKFHAISLSLKEQQNESFLKILENDLITKKTVDFGMSDFFHACVVKQTFKRRRTDKKWFIQF

SEQ ID NO: 35278 - protein, 88 aa, Diabrotica virgifera
  misc_feature: Coding regions on vcDNA: vcDNA=SeqID_14975; Strand=+; Position=46-312
  misc_feature: Homolog annotation: Hit_ID=XP_395455.1; Match level="QueryCoverage =94%, HitCoverage=22%, E-value=3e-39, Identity=96%"; Hit description =similar to eukaryotic translation initiation factor 4A, isoform 1 [Apis mellifera]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=Helicase_C; Match level="Score=37.3, E-value= 4.5e-08, Copies=1"; Pfam description=Helicase conserved C-terminal domain
MEYGKRVLITTDLLARGIDVQQVSLVINYDLPSNRENYIHRIGRGGRFGRKGVAINFVTDDDKRTLKDIEQFYNTKIDEMPMNVADLI

SEQ ID NO: 35279 - protein, 18 aa, Diabrotica virgifera
  misc_feature: Coding regions on vcDNA: vcDNA=SeqID_14976; Strand=-; Position=1-54
  misc_feature (6)..(15): Xaa can be any naturally occurring amino acid
YNNIKXXXXXXXXXXNKF

SEQ ID NO: 35280 - protein, 66 aa, Diabrotica virgifera
  misc_feature: Coding regions on vcDNA: vcDNA=SeqID_14977; Strand=+; Position=298-498
SFSEVPKQSMFLIPRPDEEFWKSSTPYSSWSFEFPGVASHFLVTERRRAFRLCYHRLDIAYGFSMA

SEQ ID NO: 35281 - protein, 78 aa, Diabrotica virgifera
  misc_feature: Coding regions on vcDNA: vcDNA=SeqID_14978; Strand=-; Position=2-235
  misc_feature (2)..(12): Xaa can be any naturally occurring amino acid
  misc_feature (14)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
LXXXXXXXXXXXPXXXXXXXXXXXXTNLAHTGLNXXXXXXXXSNXXXXXXXXXXXXXXPTSRSXXXXXXXXXXXXXXV

SEQ ID NO: 35282 - protein, 47 aa, Diabrotica virgifera
  misc_feature: Coding regions on vcDNA: vcDNA=SeqID_14979; Strand=-; Position=128-271
  misc_feature (36)..(44): Xaa can be any naturally occurring amino acid
FILIIYKYLLINIFLINTFNLYHKNFDIFIQAQPLXXXXXXXXXILQ

SEQ ID NO: 35283 - protein, 228 aa, Diabrotica virgifera
  misc_feature: Coding regions on vcDNA: vcDNA=SeqID_14980; Strand=+; Position=128-814
  misc_feature (216)..(216): Xaa can be any naturally occurring amino acid
KNSGIVFTAFLIMALSVLEDFVKDLLKENIIQNYTAQRITVREFYNKNYRNVGGMCFYEFNMELWRYWYINSFTTKTIKFDERWINYFALQVGGSSVNKKPFNEQVYINDKKCLLCNVTFDNRNKYVSHVDKQSHQVRLSYAKNKSSFKNNKELKITLIFNGKNYAERKLQVPVKTDMQATVRIQNISKKVINVMDIIKINNLFRDISIQEEFESXVLLNRLVPLMLL

SEQ ID NO: 35284 - protein, 89 aa, Diabrotica virgifera
  misc_feature: Coding regions on vcDNA: vcDNA=SeqID_14981; Strand=-; Position=2-268
  misc_feature (10)..(23): Xaa can be any naturally occurring amino acid
  misc_feature (26)..(36): Xaa can be any naturally occurring amino acid
  misc_feature (46)..(53): Xaa can be any naturally occurring amino acid
  misc_feature (75)..(88): Xaa can be any naturally occurring amino acid
GNKDKKFLNXXXXXXXXXXXXXXPFXXXXXXXXXXXTNLAHTGLNXXXXXXXXSNRLNNIAATPIINFNPTSRSXXXXXXXXXXXXXXV

SEQ ID NO: 35285 - protein, 17 aa, Diabrotica virgifera
  misc_feature: Coding regions on vcDNA: vcDNA=SeqID_14982; Strand=-; Position=1-51
  misc_feature (1)..(16): Xaa can be any naturally occurring amino acid
XXXXXXXXXXXXXXXXL

SEQ ID NO: 35286 - protein, 94 aa, Diabrotica virgifera
  misc_feature: Coding regions on vcDNA: vcDNA=SeqID_14983; Strand=-; Position=155-439
VICFTWYFVVNHFIIFHCGLFSTTDLNILYQLTRKVNEFFTRPKLFALVKLNHAYCTNILMILISILSYIFDFYSKFIRLMRNKNANIHDQFFT

SEQ ID NO: 35287 - protein, 136 aa, Diabrotica virgifera
  misc_feature: Coding regions on vcDNA: vcDNA=SeqID_14984; Strand=+; Position=69-479
  misc_feature: Homolog annotation: Hit_ID=XP_312567.1; Match level="QueryCoverage =93%, HitCoverage=83%, E-value=3e-22, Identity=40%"; Hit description =ENSANGP00000014869 [Anopheles gambiae]
  misc_feature: Pfam annotation: Pfam_ID=ubiquitin; Match level="Score=64.3, E-value =3.4e-16, Copies=1"; Pfam description=Ubiquitin family
SAKVKMKITIKCLNGGSTLVDVSETSTVAELKKTVEKDLKIPVFQQTIILHGKCLQDDKCLSEYPKIKEGTKLYVAIKKPESFSTTLHTFLKKYYSDEQCKVIVDEFMRNFHSKVESLSLDDLERIAKSELDNLET

SEQ ID NO: 35288 - protein, 26 aa, Diabrotica virgifera
  misc_feature: Coding regions on vcDNA: vcDNA=SeqID_14985; Strand=-; Position=4-84
IQKLILFTYTLYSTICKLSIHLNIHI

SEQ ID NO: 35289 - protein, 120 aa, Diabrotica virgifera
  misc_feature: Coding regions on vcDNA: vcDNA=SeqID_14986; Strand=+; Position=3-365
  misc_feature: Homolog annotation: Hit_ID=AAK61417.1; Match level="QueryCoverage =98%, HitCoverage=33%, E-value=9e-15, Identity=39%"; Hit description =transposase [Ceratitis rosa]
  misc_feature (40)..(62): Xaa can be any naturally occurring amino acid
  misc_feature (80)..(80): Xaa can be any naturally occurring amino acid
TSQNVRVNEDHYRAMITNYLVPEIEVRSLSDIWCQKYGAXXXXXXXXXXXXXXXXXXXXXXXVTWPPISCDITRLVVFLXGYLKSKVYMNKPATIEALEDSITRVTSQIPIEKLERVIKN

SEQ ID NO: 35290 - protein, 123 aa, Diabrotica virgifera
  misc_feature: Coding regions on vcDNA: vcDNA=SeqID_14987; Strand=-; Position=70-441
AHPLGLGMKSSHNSIYHNFALFIRVVVVTEGQYSNDACFWCSSLGHLAWFPLLSYRSGLSMTRLVSILPCRILACLDTGLSTYLYASFFRASPVGVSLASTICISSIQPLDGNLHFSHCVRMF

SEQ ID NO: 35291 - protein, 285 aa, Diabrotica virgifera
  misc_feature: Coding regions on vcDNA: vcDNA=SeqID_14988; Strand=+; Position=1-855
  misc_feature (8)..(25): Xaa can be any naturally occurring amino acid
  misc_feature (34)..(48): Xaa can be any naturally occurring amino acid
  misc_feature (53)..(93): Xaa can be any naturally occurring amino acid
  misc_feature (98)..(104): Xaa can be any naturally occurring amino acid
  misc_feature (107)..(114): Xaa can be any naturally occurring amino acid
  misc_feature (124)..(134): Xaa can be any naturally occurring amino acid
  misc_feature (138)..(144): Xaa can be any naturally occurring amino acid
  misc_feature (154)..(171): Xaa can be any naturally occurring amino acid
  misc_feature (180)..(222): Xaa can be any naturally occurring amino acid
  misc_feature (225)..(253): Xaa can be any naturally occurring amino acid
  misc_feature (257)..(271): Xaa can be any naturally occurring amino acid
  misc_feature (274)..(280): Xaa can be any naturally occurring amino acid
FFFSKLKXXXXXXXXXXXXXXXXXXEGGGGAVKXXXXXXXXXXXXXXXAVWMXXXXXXXXXXXXXXXXXXXXXXXXXXXXXXXXXXXXXXXXXERTPXXXXXXXGQXXXXXXXXGCIVNRIIHXXXXXXXXXXXSYQXXXXXXXVSKRKENCNXXXXXXXXXXXXXXXXXXGPPPSLSYXXXXXXXXXXXXXXXXXXXXXXXXXXXXXXXXXXXXXXXXXXXTPXXXXXXXXXXXXXXXXXXXXXXXXXXXXXHNSXXXXXXXXXXXXXXXFVXXXXXXXRGGRR

SEQ ID NO: 35292 - protein, 188 aa, Diabrotica virgifera
  misc_feature: Coding regions on vcDNA: vcDNA=SeqID_14989; Strand=-; Position=1-564
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(188): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35293 - protein, 287 aa, Diabrotica virgifera
  misc_feature: Coding regions on vcDNA: vcDNA=SeqID_14990; Strand=-; Position=2-862
  misc_feature (3)..(23): Xaa can be any naturally occurring amino acid
  misc_feature (25)..(80): Xaa can be any naturally occurring amino acid
  misc_feature (83)..(92): Xaa can be any naturally occurring amino acid
  misc_feature (94)..(287): Xaa can be any naturally occurring amino acid
KWXXXXXXXXXXXXXXXXXXXXXPXXXXXXXXXXXXXXXXXXXXXXXXXXXXXXXXXXXXXXXXXXXXXXXXXXXXXXXXPFXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35294 - protein, 65 aa, Diabrotica virgifera
  misc_feature: Coding regions on vcDNA: vcDNA=SeqID_14991; Strand=-; Position=319-516
TITIFTKQSPKTLITTIPTKSNDCFSYPYNTIVTFHFHINKTNFNLEHLTHPQLPILQFHYTMYM

SEQ ID NO: 35295 - protein, 53 aa, Diabrotica virgifera
  misc_feature: Coding regions on vcDNA: vcDNA=SeqID_14992; Strand=+; Position=398-556
LAVYVQSRDRENLALTQLNQPATHPPFILWSNSEHARYDRPSQQEPRRNDRMA

SEQ ID NO: 35296 - protein, 293 aa, Diabrotica virgifera
  misc_feature: Coding regions on vcDNA: vcDNA=SeqID_14993; Strand=+; Position=62-940
  misc_feature: Homolog annotation: Hit_ID=NP_609566.1; Match level="QueryCoverage =86%, HitCoverage=46%, E-value=4e-84, Identity=58%"; Hit description =CG6388-PA [Drosophila melanogaster] gb|AAF53189.1| CG6388-PA [Drosophila melanogaster]
  misc_feature: Gene Ontology Annotation: Molecular function=tRNA (guanine-N2-) -methyltransferase activity; Cellular component=nuclear outer membrane; Biological process=tRNA methylation
  misc_feature: Pfam annotation: Pfam_ID=TRM; Match level="Score=199.8, E-value=5.4e -57, Copies=1"; Pfam description=N2,N2-dimethylguanosine tRNA methyltr
  misc_feature (231)..(231): Xaa can be any naturally occurring amino acid
MYFCFRVKLKLSYESIRTISVGNYLQNMTEQSRTTEFQEICEGLANIRTGGKVFYNPVQEFNRDVSISVISAFARRFRKENEELRAKKEKNEVNTQLELWQAGTKYEDGISILEALSATGLRSIRYAKEIPGVKEIVANDFSLQAVDDIKNNVILNNVEHLVKPNHDDAVALMYQHKKQNQFDVIDLDPYGCPSMFLDSAVQAIKDGGLLLVTATDMAVLAGNSPETCYTXYGAISIRSRNCHEMALRILLQSIESHATRYGRYIEPLMSLSADFYIRVFVRVYSGAHKCKFS

SEQ ID NO: 35297 - protein, 130 aa, Diabrotica virgifera
  misc_feature: Coding regions on vcDNA: vcDNA=SeqID_14994; Strand=-; Position=437-829
  misc_feature (9)..(9): Xaa can be any naturally occurring amino acid
YYSKYLFFXTNLRTWNLQMICLLTEKIQHMQRKTEKLAEAGKVRLNINVRKTKIMKINTPRELEISLGGTGLETIEKFNYLGSILNNKGGIEENVEQRIGIAQNAFNVLRKMWSSHQMTRKSKIDYSTTM

SEQ ID NO: 35298 - protein, 108 aa, Diabrotica virgifera; identical to SEQ ID NO: 27732
  misc_feature: Coding regions on vcDNA: vcDNA=SeqID_14995; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 35299 - protein, 105 aa, Diabrotica virgifera
  misc_feature: Coding regions on vcDNA: vcDNA=SeqID_14996; Strand=-; Position=3-317
  misc_feature: Homolog annotation: Hit_ID=CAC16871.1; Match level="QueryCoverage =90%, HitCoverage=7%, E-value=1e-11, Identity=40%"; Hit description =pol [Drosophila melanogaster]
  misc_feature: Pfam annotation: Pfam_ID=RnaseH; Match level="Score=-8.5, E-value =0.0014, Copies=1"; Pfam description=RNase H
MTENHFRLPKYFSIFSAELYAILKALEHVNKNKISKCLILSDSLGALQTLNHVYPKNPLEKMVKSELEEAQENSRRITFIWIPSHIGIDGNKAADQCARKVSESV

SEQ ID NO: 35300 - protein, 66 aa, Diabrotica virgifera; identical to SEQ ID NO: 28562
  misc_feature: Coding regions on vcDNA: vcDNA=SeqID_14997; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35301 - protein, 17 aa, Diabrotica virgifera
  misc_feature: Coding regions on vcDNA: vcDNA=SeqID_14998; Strand=-; Position=1-51
  misc_feature (4)..(15): Xaa can be any naturally occurring amino acid
FYKXXXXXXXXXXXXSF

SEQ ID NO: 35302 - protein, 57 aa, Diabrotica virgifera; identical to SEQ ID NO: 32497
  misc_feature: Coding regions on vcDNA: vcDNA=SeqID_14999; Strand=-; Position=215-388
  misc_feature (1)..(12): Xaa can be any naturally occurring amino acid
  misc_feature (14)..(38): Xaa can be any naturally occurring amino acid

SEQ ID NO: 35303 - protein, 90 aa, Diabrotica virgifera
  misc_feature: Coding regions on vcDNA: vcDNA=SeqID_15000; Strand=-; Position=90-362
VYLFGTVIGAVKFTFELSVHISIKKVKYQSARPGQNMVGHSIWAVARRVVTVHAKIQVFNKRVKERSPEFRLFLRIIFSAGILISNLSLI

SEQ ID NO: 35304 - protein, 42 aa, Diabrotica virgifera
  misc_feature: Coding regions on vcDNA: vcDNA=SeqID_15001; Strand=-; Position=2-127
  misc_feature (11)..(11): Xaa can be any naturally occurring amino acid
  misc_feature (14)..(41): Xaa can be any naturally occurring amino acid
IDSPDKITLYXLSXXXXXXXXXXXXXXXXXXXXXXXXXXXXS

SEQ ID NO: 35305 - protein, 117 aa, Diabrotica virgifera
  misc_feature: Coding regions on vcDNA: vcDNA=SeqID_15002; Strand=-; Position=224-576
  misc_feature: Homolog annotation: Hit_ID=XP_313621.1; Match level="QueryCoverage =89%, HitCoverage=23%, E-value=2e-14, Identity=41%"; Hit description =ENSANGP00000024261 [Anopheles gambiae]
  misc_feature (84)..(84): Xaa can be any naturally occurring amino acid
MGLLIMYISRNNQSIERINQNITIDDFNFERVREFKYLGTTKTEDINGSQEINIRIQAGNRCLYALKNIITSKQLTRRTKIQVXIKTIIRPVVMYGSETWTMTKAKEDRLRVWEKNP

SEQ ID NO: 35306 - protein, 79 aa, Diabrotica virgifera
  misc_feature: Coding regions on vcDNA: vcDNA=SeqID_15003; Strand=-; Position=554-793
ILLHLSDITLSTRYVRCPLFCVLNFQNAKFCFKKYLKNSKNQTDDFCFCLQKGTQTFINNEKSTFVLIYAHSKFCNIFI

SEQ ID NO: 35307 - protein, 44 aa, Diabrotica virgifera
  misc_feature: Coding regions on vcDNA: vcDNA=SeqID_15004; Strand=-; Position=1-132
  misc_feature (3)..(27): Xaa can be any naturally occurring amino acid
  misc_feature (29)..(44): Xaa can be any naturally occurring amino acid
KKXXXXXXXXXXXXXXXXXXXXXXXXXNXXXXXXXXXXXXXXXX

SEQ ID NO: 35308 - protein, 114 aa, Diabrotica virgifera
  misc_feature: Coding regions on vcDNA: vcDNA=SeqID_15005; Strand=+; Position=475-816
  misc_feature: Homolog annotation: Hit_ID=CAC12696.1; Match level="QueryCoverage =93%, HitCoverage=27%, E-value=7e-23, Identity=55%"; Hit description =prophenoloxidase activating factor [Tenebrio molitor]
  misc_feature (16)..(16): Xaa can be any naturally occurring amino acid
  misc_feature (60)..(60): Xaa can be any naturally occurring amino acid
  misc_feature (83)..(83): Xaa can be any naturally occurring amino acid
  misc_feature (95)..(95): Xaa can be any naturally occurring amino acid
VTLPTPDTVVCGHMNXRGYVERISGTTDVEAEFGEIPWMVAILREESEQSNPLKLNVYEXCDALIHPLDALTAAHRAARKNKXIMVIVGECDTQXTEKELYPFQDREVQSDCCS

SEQ ID NO: 35309 - protein, 66 aa, Diabrotica virgifera; identical to SEQ ID NO: 26808
  misc_feature: Coding regions on vcDNA: vcDNA=SeqID_15006; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35310 - protein, 286 aa, Diabrotica virgifera
  misc_feature: Coding regions on vcDNA: vcDNA=SeqID_15007; Strand=+; Position=64-921
  misc_feature: Homolog annotation: Hit_ID=EAL32584.1; Match level="QueryCoverage =94%, HitCoverage=24%, E-value=1e-47, Identity=40%"; Hit description =GA21474-PA [Drosophila pseudoobscura]
RTLFQTKYVKSQSSDIIVKDVTIPQMLYESMEPNLKYIGAISGTTGRSYTFEQIRIKSRNFSKVLREKFKLKDGDVIAMFLPNVPEYVICFLGSLEARLIVTTMNPMYTADEIAKQIIDASPKLIVTQANLVSTARSALELTKRQLPLIIVKETQAESLPEGTIDLSELINTHLDVPDLLPGKADDVAIMPYSSGTTGLPKGVLLTHKNMTSNLTQMSHPDFSSVEPPTDNFQDMSPAVLPFYHIYGLTLNFLFICQGTRCVALDKFTSESYIAAFENNPISMIFA

SEQ ID NO: 35311 - protein, 256 aa, Diabrotica virgifera
  misc_feature: Coding regions on vcDNA: vcDNA=SeqID_15008; Strand=+; Position=153-920
  misc_feature: Homolog annotation: Hit_ID=AAH61203.1; Match level="QueryCoverage =60%, HitCoverage=85%, E-value=1e-22, Identity=36%"; Hit description =Unknown (protein for MGC:74346) [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=42.3, E-value =1.4e-09, Copies=2"; Pfam description=Zinc finger, C2H2 type
  misc_feature (148)..(157): Xaa can be any naturally occurring amino acid
  misc_feature (178)..(185): Xaa can be any naturally occurring amino acid
  misc_feature (198)..(213): Xaa can be any naturally occurring amino acid
MSAMDFKVEIKDEPVEYIQKDTESQLSTSIDLENFKNEKEDKSEMGLNAEIKEEFSDSCQVYTKDQLFTSPDLKDLVNEADEDNSGLSQTGMDTMKTELACTTEQQISANTEKTTSKNYICECKICFKQFRQAGSLKRHIKTHNAEKXXXXXXXXXXFSHKHLLKDHVRLHTVETPYXXXXXXXXFSQKSNLNIHLRXXXXXXXXXXXXXXXXFSQKCNLNTHLRVHTGEKPYKVQICFKQFSQESKFEIHLRVHT

SEQ ID NO: 35312 - protein, 82 aa, Diabrotica virgifera
  misc_feature: Coding regions on vcDNA: vcDNA=SeqID_15009; Strand=-; Position=2-247
  misc_feature (4)..(16): Xaa can be any naturally occurring amino acid
  misc_feature (19)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid
PFVXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 35313 - protein, 301 aa, Diabrotica virgifera
  misc_feature: Coding regions on vcDNA: vcDNA=SeqID_15010; Strand=-; Position=2-904
  misc_feature (23)..(300): Xaa can be any naturally occurring amino acid
LIQHRGRNLYYRFDSPNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXK

SEQ ID NO: 35314 - protein, 306 aa, Diabrotica virgifera
  misc_feature: Coding regions on vcDNA: vcDNA=SeqID_15011; Strand=+; Position=1-918
  misc_feature: Homolog annotation: Hit_ID=EAL34424.1; Match level="QueryCoverage =83%, HitCoverage=59%, E-value=2e-55, Identity=37%"; Hit description =GA18010-PA [Drosophila pseudoobscura]
  misc_feature: Gene Ontology Annotation: Biological process=courtship behavior
  misc_feature: Pfam annotation: Pfam_ID=MRJP; Match level="Score=227.4, E-value=2.7e- 65, Copies=1"; Pfam description=Major royal jelly protein
  misc_feature (278)..(278): Xaa can be any naturally occurring amino acid
EEFTWHRITYAWPRGQGNGPRNRVQRYAQYAGAGGSSSPIIYEDPNLPNSGWNPSEGIDYNHGNVSRVRPTTLVMMDLTTDKIIRSFQIPADQIRPTSGLASVTVDVTKDTCDDAYAYIPDLGGYGLIVYSLREDRSWRITHNYFYLEPLAGEFDISGHRFQWNDGIFSVELTNVKPDENRDLYFHSMAGTHMYRVPTNIVKNHTLATRSYHGEDFQNLGDRGAGSQTSSADIHKPSGIMFLGLVNQNALGCWNTKKPLSTISVVQKDDAKMIYPCDXKVSNDKVYVLTNAMPEFLYGALNYDQIN

SEQ ID NO: 35315 - protein, 48 aa, Diabrotica virgifera; identical to SEQ ID NO: 28504
  misc_feature: Coding regions on vcDNA: vcDNA=SeqID_15012; Strand=+; Position=1-147
  misc_feature (2)..(16): Xaa can be any naturally occurring amino acid
  misc_feature (18)..(25): Xaa can be any naturally occurring amino acid

SEQ ID NO: 35316 - protein, 154 aa, Diabrotica virgifera
  misc_feature: Coding regions on vcDNA: vcDNA=SeqID_15013; Strand=+; Position=2-466
  misc_feature: Homolog annotation: Hit_ID=XP_320445.1; Match level="QueryCoverage =98%, HitCoverage=62%, E-value=2e-70, Identity=89%"; Hit description =ENSANGP00000016863 [Anopheles gambiae]
  misc_feature: Gene Ontology Annotation: Molecular function=transporter activity; Cellular component=proton-transporting ATP synthase, catalytic core (sensu Eukarya); Biological process=energy pathways
  misc_feature: Pfam annotation: Pfam_ID=ATP-synt_ab_C; Match level="Score=153.8, E -value=3.8e-43, Copies=1"; Pfam description=ATP synthase alpha/beta chain, C term
  misc_feature (104)..(109): Xaa can be any naturally occurring amino acid
TTFAHLDATTVLSRAIAELGIYPAVDPLDSTSRIMDPNIIGAEHYKVARDVQKILQDYKSLQDIIAILGMDELSEDDKLTVSRARKIQRFLSQPFQVAEVFTGXXXXXXPLEETIKGFQKILAGELDHLPEVAFYMVGPIEEVVQKAEKLAEST

SEQ ID NO: 35317 - protein, 66 aa, Diabrotica virgifera
  misc_feature: Coding regions on vcDNA: vcDNA=SeqID_15014; Strand=+; Position=315-515
  misc_feature (22)..(35): Xaa can be any naturally occurring amino acid
RRIIIKKIISSNCIRALKLLNXXXXXXXXXXXXXXKASEIMSKGHEGKNSILILEFECNLLRLFHE

SEQ ID NO: 35318 - protein, 85 aa, Diabrotica virgifera
  misc_feature: Coding regions on vcDNA: vcDNA=SeqID_15015; Strand=+; Position=756 -1013
  misc_feature (12)..(12): Xaa can be any naturally occurring amino acid
  misc_feature (15)..(15): Xaa can be any naturally occurring amino acid
  misc_feature (34)..(34): Xaa can be any naturally occurring amino acid
NRPFRQSTAAMXPKXWTVGCRKTGTCHINICINXKLSFEQDRSHLSLSNINNKVLRYKVFIYYISFSCFLEKNRNNSKFVPENFY

SEQ ID NO: 35319 - protein, 125 aa, Diabrotica virgifera
  misc_feature: Coding regions on vcDNA: vcDNA=SeqID_15016; Strand=+; Position=1-375
  misc_feature (1)..(110): Xaa can be any naturally occurring amino acid
  misc_feature (113)..(113): Xaa can be any naturally occurring amino acid
  misc_feature (115)..(115): Xaa can be any naturally occurring amino acid
  misc_feature (120)..(121): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNYXIXFLVLXXIIYK

SEQ ID NO: 35320 - protein, 72 aa, Diabrotica virgifera
  misc_feature: Coding regions on vcDNA: vcDNA=SeqID_15017; Strand=-; Position=269-487
  misc_feature (27)..(48): Xaa can be any naturally occurring amino acid
HYQIYRMSNVSFASKFLCIITATFEVXXXXXXXXXXXXXXXXXXXXXXNICYFCYFIHFDGNLNTIISLLCE

SEQ ID NO: 35321 - protein, 253 aa, Diabrotica virgifera
  misc_feature: Coding regions on vcDNA: vcDNA=SeqID_15018; Strand=-; Position=1-759
  misc_feature (1)..(9): Xaa can be any naturally occurring amino acid
  misc_feature (11)..(253): Xaa can be any naturally occurring amino acid
XXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35322 - protein, 106 aa, Diabrotica virgifera
  misc_feature: Coding regions on vcDNA: vcDNA=SeqID_15019; Strand=-; Position=612-932
  misc_feature (21)..(21): Xaa can be any naturally occurring amino acid
GKVLSVRRTDRRRNEDIRQDXGTKTLKVKAEEKKLKWWGHMIRMNETRQVKKIWEARRIGKNCRGRPRKTWNRSINEILEERGKTWSEAKELARDRKEWRKFVDKI

SEQ ID NO: 35323 - protein, 36 aa, Diabrotica virgifera
  misc_feature: Coding regions on vcDNA: vcDNA=SeqID_15020; Strand=-; Position=0-107
  misc_feature (7)..(31): Xaa can be any naturally occurring amino acid
  misc_feature (34)..(34): Xaa can be any naturally occurring amino acid
RCYPLRXXXXXXXXXXXXXXXXXXXXXXXXXYFXSP

SEQ ID NO: 35324 - protein, 54 aa, Diabrotica virgifera
  misc_feature: Coding regions on vcDNA: vcDNA=SeqID_15021; Strand=-; Position=31-195
FLDFLECVNDNYVIKILLYMIVRVHKRNFLFCNNIVGLSNVNCVSIKDMWQGCS

SEQ ID NO: 35325 - protein, 37 aa, Diabrotica virgifera
  misc_feature: Coding regions on vcDNA: vcDNA=SeqID_15022; Strand=-; Position=0-110
  misc_feature (9)..(34): Xaa can be any naturally occurring amino acid
PNNKIIYNXXXXXXXXXXXXXXXXXXXXXXXXXXLLT

SEQ ID NO: 35326 - protein, 146 aa, Diabrotica virgifera
  misc_feature: Coding regions on vcDNA: vcDNA=SeqID_15023; Strand=+; Position=1-440
  misc_feature: Homolog annotation: Hit_ID=AAN39288.1; Match level="QueryCoverage =97%, HitCoverage=23%, E-value=1e-13, Identity=35%"; Hit description =transposase [Drosophila melanogaster]
  misc_feature (63)..(63): Xaa can be any naturally occurring amino acid
RYCSLVFDEISLSQKLSYDKFSDKVIGYVDLGPLGRKNEYADHALVFMLNGLHKSWKQPIAFXFTQHSVKSHDLKVLISQVISQVEIETGLKILCTVCDQGATNRAAINLLCRENNEPGPHFFINNHKILTIFDPPHLLKSTRNAI

SEQ ID NO: 35327 - protein, 92 aa, Diabrotica virgifera
  misc_feature: Coding regions on vcDNA: vcDNA=SeqID_15024; Strand=+; Position=1-279
  misc_feature (53)..(59): Xaa can be any naturally occurring amino acid
RCINVVARQVNCHFIPGVRIKLFFFCPSSHHPVEYSSIYKVLKLKPNYSLMFXXXXXXXLVRLCWIIKKLGALTPSRVLHECRMFLNKCDRH

SEQ ID NO: 35328 - protein, 77 aa, Diabrotica virgifera
  misc_feature: Coding regions on vcDNA: vcDNA=SeqID_15025; Strand=-; Position=418-651
  misc_feature (4)..(12): Xaa can be any naturally occurring amino acid
PCFXXXXXXXXXGTESFECPLSRGRGMVASSLVSLFTVAMQGSVRKRPFLFHLYRIFFVRSDSLIIIIADKMPLSFF

SEQ ID NO: 35329 - protein, 31 aa, Diabrotica virgifera
  misc_feature: Coding regions on vcDNA: vcDNA=SeqID_15026; Strand=-; Position=1-93
  misc_feature (1)..(30): Xaa can be any naturally occurring amino acid
XXXXXXXXXXXXXXXXXXXXXXXXXXXXXXK

SEQ ID NO: 35330 - protein, 208 aa, Diabrotica virgifera
  misc_feature: Coding regions on vcDNA: vcDNA=SeqID_15027; Strand=-; Position=1-624
  misc_feature (8)..(18): Xaa can be any naturally occurring amino acid
  misc_feature (20)..(33): Xaa can be any naturally occurring amino acid
  misc_feature (37)..(208): Xaa can be any naturally occurring amino acid
NKIRYKLXXXXXXXXXXXVXXXXXXXXXXXXXXRSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35331 - protein, 96 aa, Diabrotica virgifera
  misc_feature: Coding regions on vcDNA: vcDNA=SeqID_15028; Strand=-; Position=524-814
  misc_feature (24)..(24): Xaa can be any naturally occurring amino acid
NLSITLSTQLNREYCCFGETKINXRVLNVVYLKSFGRYGRMDDLTLNTAQFVSIQRVQKILRQTPYRTVLQLYHPTRFSLKLVLDFILKRMSIFHC

SEQ ID NO: 35332 - protein, 76 aa, Diabrotica virgifera
  misc_feature: Coding regions on vcDNA: vcDNA=SeqID_15029; Strand=+; Position=287-517
NEWRSRYNNELETLFEQGNIVRYIKANRLRWAGHVVRSDDNRLISNVFCERPDDFIYLAYGLSQYDKYTQTLKYNE

SEQ ID NO: 35333 - protein, 92 aa, Diabrotica virgifera
  misc_feature: Coding regions on vcDNA: vcDNA=SeqID_15030; Strand=+; Position=607-885
GLSYYLKKFGRRLKNPQIHISSTYWTYSVLVGTNWGTFILDSSFGSNWAIIYHPMASMPFLFLYSKTYFVCIRHLVNNSPKKRYRNKNRYIL

SEQ ID NO: 35334 - protein, 99 aa, Diabrotica virgifera
  misc_feature: Coding regions on vcDNA: vcDNA=SeqID_15031; Strand=-; Position=261-560
  misc_feature (38)..(44): Xaa can be any naturally occurring amino acid
  misc_feature (46)..(52): Xaa can be any naturally occurring amino acid
VSGCSLVSLISGRFSSPYTWLIAMMQTQINNPVVFILXXXXXXXFXXXXXXXYIRSVIRQFYTYQNADLCPIVSLIIIITPIKIVILNNLLNILLIQCL

SEQ ID NO: 35335 - protein, 288 aa, Diabrotica virgifera
  misc_feature: Coding regions on vcDNA: vcDNA=SeqID_15032; Strand=-; Position=2-865
  misc_feature (11)..(18): Xaa can be any naturally occurring amino acid
  misc_feature (20)..(33): Xaa can be any naturally occurring amino acid
  misc_feature (45)..(45): Xaa can be any naturally occurring amino acid
  misc_feature (54)..(288): Xaa can be any naturally occurring amino acid
KPPGLTPVKLXXXXXXXXEXXXXXXXXXXXXXXSNIEVAIFIIDXNSPIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35336 - protein, 113 aa, Diabrotica virgifera
  misc_feature: Coding regions on vcDNA: vcDNA=SeqID_15033; Strand=-; Position=1-339
  misc_feature (2)..(113): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35337 - protein, 57 aa, Diabrotica virgifera
  misc_feature: Coding regions on vcDNA: vcDNA=SeqID_15034; Strand=-; Position=1-171
  misc_feature (3)..(40): Xaa can be any naturally occurring amino acid
  misc_feature (43)..(57): Xaa can be any naturally occurring amino acid
RFXXXXXXXXXXXXXXXXXXXXXXXXXXXXXXXXXXXXXXEVXXXXXXXXXXXXXXX

SEQ ID NO: 35338 - protein, 80 aa, Diabrotica virgifera
  misc_feature: Coding regions on vcDNA: vcDNA=SeqID_15035; Strand=-; Position=327-569
  misc_feature (64)..(70): Xaa can be any naturally occurring amino acid
ENLVIGRWMSLIIQEKVKKNNTTAPPFLQRVDSSLLFSKLAFRISTSNLFFSIFPECVFFCEYXXXXXXXSSLLSILFYG

SEQ ID NO: 35339 - protein, 111 aa, Diabrotica virgifera
  misc_feature: Coding regions on vcDNA: vcDNA=SeqID_15036; Strand=+; Position=25-360
  misc_feature (8)..(16): Xaa can be any naturally occurring amino acid
  misc_feature (58)..(67): Xaa can be any naturally occurring amino acid
FEISQWRXXXXXXXXXTITRRCANDEYKIVICLPKMRNNYLLKPTKSGFHVSTGLNKXXXXXXXXXXRSLKGEFSAPRTLEAKHLRTCVCRAICHCFYMWNCPLKFFILTC

SEQ ID NO: 35340 - protein, 163 aa, Diabrotica virgifera
  misc_feature: Coding regions on vcDNA: vcDNA=SeqID_15037; Strand=-; Position=150-641
  misc_feature (7)..(18): Xaa can be any naturally occurring amino acid
  misc_feature (31)..(58): Xaa can be any naturally occurring amino acid
  misc_feature (60)..(118): Xaa can be any naturally occurring amino acid
  misc_feature (125)..(141): Xaa can be any naturally occurring amino acid
  misc_feature (145)..(159): Xaa can be any naturally occurring amino acid
TGDRKVXXXXXXXXXXXXHMQLINPNTIIIXXXXXXXXXXXXXXXXXXXXXXXXXXXXLXXXXXXXXXXXXXXXXXXXXXXXXXXXXXXXXXXXXXXXXXXXXXXXXXXXXXXXXXXXLISNYIXXXXXXXXXXXXXXXXXFSAXXXXXXXXXXXXXXXPLFI

SEQ ID NO: 35341 - protein, 237 aa, Diabrotica virgifera
  misc_feature: Coding regions on vcDNA: vcDNA=SeqID_15038; Strand=+; Position=242-949
  misc_feature: Homolog annotation: Hit_ID=XP_314765.1; Match level="QueryCoverage =74%, HitCoverage=84%, E-value=1e-30, Identity=40%"; Hit description =ENSANGP00000014203 [Anopheles gambiae]
  misc_feature: Gene Ontology Annotation: Molecular function=phosphatidate phosphatase activity; Cellular component=integral to membrane; Biological process=germ-cell migration
  misc_feature: Pfam annotation: Pfam_ID=PAP2; Match level="Score=52.9, E-value=9.2e -13, Copies=1"; Pfam description=PAP2 superfamily
  misc_feature (154)..(154): Xaa can be any naturally occurring amino acid
  misc_feature (212)..(212): Xaa can be any naturally occurring amino acid
  misc_feature (225)..(225): Xaa can be any naturally occurring amino acid
MRIHRFFVFLALLVLLEYGFIPGNKLGYYCQDPQISHKYTGEVISPMVLGLGSLLVPLIALLVTEVLSKQSFKKINVREVWYYYRECATGCILVLLLTEFAKILVGEHRPHFLDVCAPDTASSCRANEYVDTYICTNPKYSKYFLIDSSKSFPXGHSSVSWFIGAFSAYVIQTRLSTMYTGRLLKPFLISVCLFWSILCSLTRITDRRHHWXWDVLAGCVLGLLXALYTRENSAQEN

SEQ ID NO: 35342 - protein, 313 aa, Diabrotica virgifera
  misc_feature: Coding regions on vcDNA: vcDNA=SeqID_15039; Strand=+; Position=1-939
  misc_feature: Homolog annotation: Hit_ID=XP_321857.1; Match level="QueryCoverage =99%, HitCoverage=30%, E-value=1e-106, Identity=57%"; Hit description= ENSANGP00000020306 [Anopheles gambiae]
  misc_feature: Gene Ontology Annotation: Molecular function=DNA binding; Cellular component=DNA replication factor C complex; Biological process=DNA replication
  misc_feature (292)..(292): Xaa can be any naturally occurring amino acid
  misc_feature (295)..(295): Xaa can be any naturally occurring amino acid
  misc_feature (297)..(297): Xaa can be any naturally occurring amino acid
RSKKLLHEEVAQLLSTTTIAGFAAGKTKTDKKRVLLMDEVDGMAGNEDRGGIQELINLIKTTSVPIICMCNDRNHQKMRSLVNYCFDLRFSKPRLEQIRGAMMSICFKEGLKLSPNILSEIISGTGCDIRQTLNHLTMWSAQKDNLTLEEVQNKAKQSKKDTVLGPWEVVRTVFTESEKKNMSVADKARLFFYDYSMGPLFVQENYLGVTPNCPKSEVMKRVALAADSISRGDLIDAKIRGSNNWALLESQAFFASVLPGHYMSGHVSSRINFPRMVGKNSAANKRKRMLKXLHXHXRMSTSGSLLAMKLDYI

SEQ ID NO: 35343 - protein, 181 aa, Diabrotica virgifera
  misc_feature: Coding regions on vcDNA: vcDNA=SeqID_15040; Strand=-; Position=2-544
  misc_feature (1)..(1): Xaa can be any naturally occurring amino acid
  misc_feature (5)..(5): Xaa can be any naturally occurring amino acid
  misc_feature (8)..(181): Xaa can be any naturally occurring amino acid
XINLXYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35344 - protein, 88 aa, Diabrotica virgifera
  misc_feature: Coding regions on vcDNA: vcDNA=SeqID_15041; Strand=+; Position=1-267
  misc_feature (4)..(15): Xaa can be any naturally occurring amino acid
  misc_feature (18)..(44): Xaa can be any naturally occurring amino acid
  misc_feature (52)..(59): Xaa can be any naturally occurring amino acid
  misc_feature (61)..(72): Xaa can be any naturally occurring amino acid
IFLXXXXXXXXXXXXQKXXXXXXXXXXXXXXXXXXXXXXXXXXXPPPDYYLXXXXXXXXNXXXXXXXXXXXXITISHNFFRNEIVIRF

SEQ ID NO: 35345 - protein, 22 aa, Diabrotica virgifera
  misc_feature: Coding regions on vcDNA: vcDNA=SeqID_15042; Strand=-; Position=1-66
LKSSYLIFSGYKIAPPRRLSTG

SEQ ID NO: 35346 - protein, 303 aa, Diabrotica virgifera
  misc_feature: Coding regions on vcDNA: vcDNA=SeqID_15043; Strand=+; Position=1-909
  misc_feature: Homolog annotation: Hit_ID=XP_392702.1; Match level="QueryCoverage =28%, HitCoverage=5%, E-value=2e-12, Identity=45%"; Hit description =similar to CG30387-PA [Apis mellifera]
KNSNKSINTSEKEKVPEDGQQRPQRKQSIIEKQVTLEDQMICGALQTLNEEACEDVMEETEDTKITIEPDVPQTSVIPPSPDQNQDFPSRGYRSRTNSTSGIGETDFILLQSSPVGHMHWQPISIGVAGNSESLSDHSSRCSSQPPSPVPERKISVGSMGKYSNLKSSSSENSSKGRHVVIKTELPETNPRICISTTKASVSYETPLLQEHKTTASQTKQRPSSLNFHKGERRLRTRSKSIDNSPKGEKRENKINLDTLHRLKEKLLHSSPDLNETSDNESTPLVSEVSTPSSGHSEIKTPSS

SEQ ID NO: 35347 - protein, 91 aa, Diabrotica virgifera
  misc_feature: Coding regions on vcDNA: vcDNA=SeqID_15044; Strand=-; Position=24-299
  misc_feature (15)..(26): Xaa can be any naturally occurring amino acid
VYIRCLQIIKNLSNXXXXXXXXXXXXVPIIYTKWTKLKLCILARFKITTKFCNQFKKGKCRYSRINSAFDFIGIDRRIALIYHSVLLNLNN

SEQ ID NO: 35348 - protein, 56 aa, Diabrotica virgifera
  misc_feature: Coding regions on vcDNA: vcDNA=SeqID_15045; Strand=-; Position=626-796
SIRFGVKNVCVVSEMVVVDFTLGQNITFPISNLLGIFQDVGVSLEIEYTLRLYGYC

SEQ ID NO: 35349 - protein, 323 aa, Diabrotica virgifera
  misc_feature: Coding regions on vcDNA: vcDNA=SeqID_15046; Strand=+; Position=1-972
  misc_feature: Homolog annotation: Hit_ID=AAO52024.1; Match level="QueryCoverage =92%, HitCoverage=62%, E-value=9e-47, Identity=32%"; Hit description =similar to Dictyostelium discoideum (Slime mold). Homeobox -containing protein (Fragment)
  misc_feature: Gene Ontology Annotation: Molecular function=molecular_function unknown; Cellular component=cellular_component unknown; Biological process=DNA repair
EQYKPFFKYIVGFIIIITGRYAFADNIKLKDVLRNSNNRSGSNNSSNNNYNSNNDDDILKSEVTKVVELCGSSGNNRNQENNNNRYSGNGDNTDTYRRINSNGDYYKNVGYSNDDYGEKNYGHNSRNNRQNSNNRNNNRNDRYGLSNSYSDNDDNPYTSSNRNNHNNDDNPYTSSNRNNYNNDDNPYTSSNRNNHDSERNNNPYNSFGNSNNPYSSSSSYSNNYNDNNRNRNNGYSNRNLNNMNSRYNSDGQNNGYGFNNRHNSNGFNYNGGGDAYGNDYNYGYDSNSRDAMGNSNTQSTAETVYGYNREYTRQHRNDKKRRV

SEQ ID NO: 35350 - protein, 226 aa, Diabrotica virgifera
  misc_feature: Coding regions on vcDNA: vcDNA=SeqID_15047; Strand=-; Position=164-844
  misc_feature: Pfam annotation: Pfam_ID=Phage_integrase; Match level="Score=-27.1, E- value=0.0089, Copies=1"; Pfam description=Phage integrase family
VALIGVAGACRGKELVDLEIDDVRDLGDSFLIAIRNTKNKIDRNFVIKNSENSAISFVAIFRKYVALRKTGTTHSKFFVQYINKECTTRVVGKNMFGTIPRQIAAFLKLENATSYTGHCFRRTSASLLADSGATIDVLKRHGGWKSSNVAEGYIESQVADSSTIVMPQSSFSLPVSAGSSKQTPVQYEKDLSVTRQLPAALTQERLVNMTNCHNINLNINVNYHSN

SEQ ID NO: 35351 - protein, 41 aa, Diabrotica virgifera
  misc_feature: Coding regions on vcDNA: vcDNA=SeqID_15048; Strand=-; Position=3-125
  misc_feature (6)..(41): Xaa can be any naturally occurring amino acid
NKLILXXXXXXXXXXXXXXXXXXXXXXXXXXXXXXXXXXXX

SEQ ID NO: 35352 - protein, 46 aa, Diabrotica virgifera
  misc_feature: Coding regions on vcDNA: vcDNA=SeqID_15049; Strand=+; Position=1-138
TKFIVLLNFVIQWKYTTPPFTHTSYTYKLKNYVYIILELNKEKHNT

SEQ ID NO: 35353 - protein, 139 aa, Diabrotica virgifera
  misc_feature: Coding regions on vcDNA: vcDNA=SeqID_15050; Strand=-; Position=23-439
  misc_feature: Homolog annotation: Hit_ID=CAD22154.1; Match level="QueryCoverage =100%, HitCoverage=51%, E-value=2e-36, Identity=49%"; Hit description= pherophorin-dz1 protein [Volvox carteri f. nagariensis]
  misc_feature: Gene Ontology Annotation: Molecular function=protein binding; Cellular component=extracellular space; Biological process=response to pathogenic bacteria
PPDPPPLYPHPPAPLPLPSPKPPPTTPPPPSATLRPPRSPPPPPTKPHTAHPPHQHLPLTSSPPHPSHPTPTPSNTHTPSPPHTTPAPSPNPPRSPPHPPRTACPTPTKKPPPPPPPPHARPSPPPSHPPPAPHTRPPP

SEQ ID NO: 35354 - protein, 282 aa, Diabrotica virgifera
  misc_feature: Coding regions on vcDNA: vcDNA=SeqID_15051; Strand=-; Position=0-845
  misc_feature (4)..(27): Xaa can be any naturally occurring amino acid
  misc_feature (30)..(51): Xaa can be any naturally occurring amino acid
  misc_feature (59)..(95): Xaa can be any naturally occurring amino acid
  misc_feature (100)..(121): Xaa can be any naturally occurring amino acid
  misc_feature (124)..(185): Xaa can be any naturally occurring amino acid
  misc_feature (187)..(281): Xaa can be any naturally occurring amino acid
FLLXXXXXXXXXXXXXXXXXXXXXXXXSYXXXXXXXXXXXXXXXXXXXXXXTPGGGPGXXXXXXXXXXXXXXXXXXXXXXXXXXXXXXXXXXXXXPPPQXXXXXXXXXXXXXXXXXXXXXXTHXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 35355 - protein, 61 aa, Diabrotica virgifera
  misc_feature: Coding regions on vcDNA: vcDNA=SeqID_15052; Strand=-; Position=104-289
AVQNVNYYQKNWSHQNVSYKDTFVSGFIDRSLNTVNQCVTRTKIQAVNADTPLYILLYNIF

SEQ ID NO: 35356 - protein, 279 aa, Diabrotica virgifera
  misc_feature: Coding regions on vcDNA: vcDNA=SeqID_15053; Strand=+; Position=131-963
  misc_feature: Homolog annotation: Hit_ID=XP_312562.1; Match level="QueryCoverage =98%, HitCoverage=80%, E-value=3e-83, Identity=51%"; Hit description =ENSANGP00000014820 [Anopheles gambiae]
  misc_feature (97)..(97): Xaa can be any naturally occurring amino acid
  misc_feature (185)..(192): Xaa can be any naturally occurring amino acid
  misc_feature (272)..(272): Xaa can be any naturally occurring amino acid
MVMENSLLSKYVTIFLVVSGYWIVSITTVFVNKTLLSNINLDAPMFINFTQTLITAVICYFKKSLSDVYPNKFKFPDVDVWDKHTVKTVMPLSLFYXTMICTNNLCLKYASVAYYYIGRSLTTIFNVMFTFLILGETTSKSCIACCAVIISGFWLGVDQENLAGSLSIPGFVFGILGSLSLSLFXXXXXXXXPKLNGEVWPLSYVNNVYASILLLPVMILNNEIKELYNYTNFGSPYFWSIVVAGGLCGFTIGFFYTMQIKYTSALTHNISXGTAKACA

SEQ ID NO: 35357 - protein, 290 aa, Diabrotica virgifera
  misc_feature: Coding regions on vcDNA: vcDNA=SeqID_15054; Strand=-; Position=2-871
  misc_feature (4)..(290): Xaa can be any naturally occurring amino acid
INNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35358 - protein, 69 aa, Diabrotica virgifera
  misc_feature: Coding regions on vcDNA: vcDNA=SeqID_15055; Strand=-; Position=750-959
  misc_feature (15)..(15): Xaa can be any naturally occurring amino acid
  misc_feature (29)..(30): Xaa can be any naturally occurring amino acid
  misc_feature (42)..(42): Xaa can be any naturally occurring amino acid
LKGRYPLFVLKRGVXLRIIRTIENIYQTXXIKVKVEEELTYXIDADNGIRQGDSLSPLLFNLMDEIIKK

SEQ ID NO: 35359 - protein, 106 aa, Diabrotica virgifera
  misc_feature: Coding regions on vcDNA: vcDNA=SeqID_15056; Strand=-; Position=553-873
KMGADLDMVYKPEDDPVRDVQKQKSCVNSTFHQMNRSQQLCKCNRISVLLHRFSLQGLYTSRNKCIDVQGEPQNLFNSLLYSSETLNKGSYDCPYEQFAKCKFLTM

SEQ ID NO: 35360 - protein, 209 aa, Diabrotica virgifera
  misc_feature: Coding regions on vcDNA: vcDNA=SeqID_15057; Strand=-; Position=0-626
  misc_feature (1)..(204): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPPGG

SEQ ID NO: 35361 - protein, 296 aa, Diabrotica virgifera
  misc_feature: Coding regions on vcDNA: vcDNA=SeqID_15058; Strand=+; Position=1-888
  misc_feature: Homolog annotation: Hit_ID=XP_320637.1; Match level="QueryCoverage =96%, HitCoverage=23%, E-value=3e-76, Identity=48%"; Hit description =ENSANGP00000021239 [Anopheles gambiae]
  misc_feature (160)..(171): Xaa can be any naturally occurring amino acid
QFLEIVNLGAFRNAANFITFVGLDKPPVPSNSEDACGINRGNIIFCVNLLLGAVKRCAWPDDPERATRGGFVVSLTESGNPVCRNPAAPHVVPLLPHILSLIKIFNELFTPETQSLIHDSYKGCLAMQETERMNLLGLMGHTIGTEAAESQVVQSPLERXXXXXXXXXXXXYHMMGSLGPSLGRDLYNIPDLGLAIVNSVLSFIQYIPDYRIRPIIRVYLRQFIFSCPAPFYEVVVLPIMTHLSPIILSRLHTKWQQVIEFRNREAQEDNQDTQEVLEDILTRAITREYLDLLKVA

SEQ ID NO: 35362 - protein, 202 aa, Diabrotica virgifera
  misc_feature: Coding regions on vcDNA: vcDNA=SeqID_15059; Strand=+; Position=119-727
  misc_feature: Homolog annotation: Hit_ID=XP_392044.1; Match level="QueryCoverage =81%, HitCoverage=16%, E-value=1e-42, Identity=49%"; Hit description =similar to ENSANGP00000011285 [Apis mellifera]
  misc_feature: Gene Ontology Annotation: Cellular component=endoplasmic reticulum membrane; Biological process=response to stress
DMRTTCYLLLLLLLSTSLCENSKRRLSSLELVKDKDSRLLVFSTLDGTLTGIEQNSGNVKWTVKEKPIVQVPLKVSNAIVPFYLPDPRDGSLYLIGDVREPLKKLPFTIPQLVSTSPCRSSDGILYTGKKKDTWFKLDPKSGKKQLIMGWDDYSPTCPIDTKSSVYIGRTQYILRMVDEKKLIISGTLLFMIIQLGLWVSKN

SEQ ID NO: 35363 - protein, 293 aa, Diabrotica virgifera
  misc_feature: Coding regions on vcDNA: vcDNA=SeqID_15060; Strand=+; Position=41-919
  misc_feature: Homolog annotation: Hit_ID=P08775; Match level="QueryCoverage=88%, HitCoverage=20%, E-value=2e-25, Identity=35%"; Hit description=DNA -directed RNA polymerase II largest subunit (RPB1)
  misc_feature: Gene Ontology Annotation: Molecular function=DNA binding; Cellular component=nucleus; Biological process=regulation of transcription, DNA-dependent
MINKSKVTVILVLYVIICDIECRRFGGGFRSSGFRSSGSHISSHPSYHYSSPSYSHPSYHPSPSYSHPSPSYSHPSPSYSHPSPSYSHPSPSYSHPSPSYSHPSPSYSHPSPSYSHPSAVSHPSAPIPAYHPLPAAPVYRPIGWNVGGSHPDSHASSGPIGPPKHVSGVGSSNTNHGPEITRPIGFATGGSTGHNIGSQPIGPPKTIAGVGNSGAHYGEKPPAYNPNYNPAGYGHPPAYNVHNSPQAGGGFNFPPPAYSPAGHPGYSSGGYHAPPAYSANPSSHVTIINKYNH

SEQ ID NO: 35364 - protein, 80 aa, Diabrotica virgifera
  misc_feature: Coding regions on vcDNA: vcDNA=SeqID_15061; Strand=-; Position=1-240
  misc_feature (2)..(80): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35365 - protein, 282 aa, Diabrotica virgifera
  misc_feature: Coding regions on vcDNA: vcDNA=SeqID_15062; Strand=+; Position=1-846
  misc_feature (1)..(209): Xaa can be any naturally occurring amino acid
  misc_feature (215)..(223): Xaa can be any naturally occurring amino acid
  misc_feature (233)..(246): Xaa can be any naturally occurring amino acid
  misc_feature (248)..(255): Xaa can be any naturally occurring amino acid
  misc_feature (265)..(273): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLWITXXXXXXXXXDKDCDLDVGXXXXXXXXXXXXXXFXXXXXXXXSLNRCEPGWXXXXXXXXXVVRKDQIYN

SEQ ID NO: 35366 - protein, 80 aa, Diabrotica virgifera
  misc_feature: Coding regions on vcDNA: vcDNA=SeqID_15063; Strand=+; Position=104-346
INISRDGIRQGDRRKSTTPVPGTHGPSWDRQIGASKSSKRNAGKRVKAHPSVPGYSATATTRATQCNTVDIDWRLLLAAT

SEQ ID NO: 35367 - protein, 133 aa, Diabrotica virgifera
  misc_feature: Coding regions on vcDNA: vcDNA=SeqID_15064; Strand=+; Position=1-402
  misc_feature: Homolog annotation: Hit_ID=EAL25565.1; Match level="QueryCoverage =88%, HitCoverage=80%, E-value=2e-31, Identity=51%"; Hit description =GA10804-PA [Drosophila pseudoobscura]
  misc_feature: Pfam annotation: Pfam_ID=Lys; Match level="Score=118.2, E-value=2e -32, Copies=1"; Pfam description=C-type lysozyme/alpha-lactalbumin fami
VVYQVDAKVYTKCGLAQDLVKIGFDRSMVGNWVCMVESESGRDTSKQKAKANGGKALGLFQINSKDWCTFGKAGGKCNAKCEDFLDDEITKDATCAKKIQAELGFRYWDGWTQSCYGRSYPSTIVPLCFPTAG

SEQ ID NO: 35368 - protein, 286 aa, Diabrotica virgifera
  misc_feature: Coding regions on vcDNA: vcDNA=SeqID_15065; Strand=-; Position=1-858
  misc_feature (20)..(28): Xaa can be any naturally occurring amino acid
  misc_feature (31)..(283): Xaa can be any naturally occurring amino acid
YSATPIINLNPTSRSQSYYXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASG

SEQ ID NO: 35369 - protein, 229 aa, Diabrotica virgifera
  misc_feature: Coding regions on vcDNA: vcDNA=SeqID_15066; Strand=-; Position=1-687
  misc_feature (3)..(15): Xaa can be any naturally occurring amino acid
  misc_feature (22)..(34): Xaa can be any naturally occurring amino acid
  misc_feature (40)..(229): Xaa can be any naturally occurring amino acid
RTXXXXXXXXXXXXXIQHRGRXXXXXXXXXXXXXLLSLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35370 - protein, 88 aa, Diabrotica virgifera
  misc_feature: Coding regions on vcDNA: vcDNA=SeqID_15067; Strand=+; Position=62-328
RCKAFYFDPILSSSIFTPILSYNVCCKSSIIRNSEGGSSLKACAVFSFIASNLVLLCRFYLGKQQIKIAQRKIQRINHLFQLWNSILI

SEQ ID NO: 35371 - protein, 25 aa, Diabrotica virgifera
  misc_feature: Coding regions on vcDNA: vcDNA=SeqID_15068; Strand=+; Position=3-80
NYLRDNSVILLESQIDNKIATLDVD

SEQ ID NO: 35372 - protein, 117 aa, Diabrotica virgifera
  misc_feature: Coding regions on vcDNA: vcDNA=SeqID_15069; Strand=-; Position=2-354
  misc_feature: Homolog annotation: Hit_ID=AAT40504.1; Match level="QueryCoverage =98%, HitCoverage=15%, E-value=1e-12, Identity=33%"; Hit description =putative polyprotein [Solanum demissum]
  misc_feature (80)..(80): Xaa can be any naturally occurring amino acid
  misc_feature (96)..(96): Xaa can be any naturally occurring amino acid
MKETVEENLYKKKKKRKRRHTTQFLGKIYGDVWLQLAESFPVTVDLHQGSLLSPYLFNLVIDVLTAKVREETSWSILFGXNVIVLVEESKEILEEXWRRAIEEGGLKVRTSKMEYMS

SEQ ID NO: 35373 - protein, 95 aa, Diabrotica virgifera
  misc_feature: Coding regions on vcDNA: vcDNA=SeqID_15070; Strand=-; Position=2-289
CTYAYNSSQQKKSSTRNLNSKSVQINSKFDINTILYRAECSDIKPVTFTSFATQMQTASSATQTNIQSYNISEPFYSVHYTYIRYFSSYTNSNRQ

SEQ ID NO: 35374 - protein, 36 aa, Diabrotica virgifera
  misc_feature: Coding regions on vcDNA: vcDNA=SeqID_15071; Strand=-; Position=1-108
  misc_feature (3)..(16): Xaa can be any naturally occurring amino acid
  misc_feature (22)..(34): Xaa can be any naturally occurring amino acid
STXXXXXXXXXXXXXXHHRGRXXXXXXXXXXXXXLL

SEQ ID NO: 35375 - protein, 38 aa, Diabrotica virgifera
  misc_feature: Coding regions on vcDNA: vcDNA=SeqID_15072; Strand=-; Position=0-113
  misc_feature (10)..(36): Xaa can be any naturally occurring amino acid
NYAVIPKVIXXXXXXXXXXXXXXXXXXXXXXXXXXXHL

SEQ ID NO: 35376 - protein, 300 aa, Diabrotica virgifera
  misc_feature: Coding regions on vcDNA: vcDNA=SeqID_15073; Strand=+; Position=1-903
  misc_feature: Homolog annotation: Hit_ID=XP_316223.1; Match level="QueryCoverage =37%, HitCoverage=5%, E-value=5e-24, Identity=46%"; Hit description =ENSANGP00000017802 [Anopheles gambiae]
  misc_feature: Gene Ontology Annotation: Cellular component=nucleus; Biological process=establishment and/or maintenance of chromatin architecture
  misc_feature (39)..(49): Xaa can be any naturally occurring amino acid
ADLAEFDENLPLDDQEKEPEISKAEQEINNIIEKLTPIXXXXXXXXXXXESAWSAEQLAAAAREIEEQKKEWEQNRLAAMREEEERRARELEEESDIITYSRDDATNQVSRYNKILSNKRVRLKKDGDEDVEKKDDVEKKDGVEKRLKKTRTRRLSQKSKDVEVEEPDACESQEESQINGGDTDNSDSDSDSDSESSSSMESKTTLNHVDPNSPRTRSRGTVAINLWTLDVSPILPGEKPMKKYGENHRKNIKRVRSVSNDNDGDKDGRKRLRRKYPTSFRTSEEENSNQSRENLLRNVR

SEQ ID NO: 35377 - protein, 32 aa, Diabrotica virgifera
  misc_feature: Coding regions on vcDNA: vcDNA=SeqID_15074; Strand=-; Position=0-95
QLGEFNRRLYQYFNSVYVQHHVQGVRYRWLQA

SEQ ID NO: 35378 - protein, 94 aa, Diabrotica virgifera
  misc_feature: Coding regions on vcDNA: vcDNA=SeqID_15075; Strand=+; Position=443-727
ELCEHAPFPWRCIPLKCPECSFFPNTRTHMSLHITLPHGRLKTPFMVASGPTVAEEFQYSDSLHMKFFRYFLRKNPNCFHHLILTTRVPLTAIV

SEQ ID NO: 35379 - protein, 22 aa, Diabrotica virgifera
  misc_feature: Coding regions on vcDNA: vcDNA=SeqID_15076; Strand=-; Position=31-99
HRGRDLYYRFELYNKITLLSLR

SEQ ID NO: 35380 - protein, 74 aa, Diabrotica virgifera
  misc_feature: Coding regions on vcDNA: vcDNA=SeqID_15077; Strand=-; Position=689-913
  misc_feature (7)..(7): Xaa can be any naturally occurring amino acid
VCCISSXQVSERLICLPLSQNPVNFVSRLVARASKQLCLKTQEIPKKFKTTYNLNNCGVIVYSFSLIFYVPYCF

SEQ ID NO: 35381 - protein, 50 aa, Diabrotica virgifera
  misc_feature: Coding regions on vcDNA: vcDNA=SeqID_15078; Strand=-; Position=123-275
DLTSPVNQRSNITNSYASAASHSFPSKTQAIVFSCIDNAKLQDYLIPVIN

SEQ ID NO: 35382 - protein, 78 aa, Diabrotica virgifera
  misc_feature: Coding regions on vcDNA: vcDNA=SeqID_15079; Strand=-; Position=45-281
  misc_feature (2)..(12): Xaa can be any naturally occurring amino acid
  misc_feature (22)..(29): Xaa can be any naturally occurring amino acid
  misc_feature (32)..(45): Xaa can be any naturally occurring amino acid
  misc_feature (51)..(63): Xaa can be any naturally occurring amino acid
LXXXXXXXXXXXTNLAHTGLNXXXXXXXXSNXXXXXXXXXXXXXXPTSRSXXXXXXXXXXXXXLRDNSVIYYYKNKLP

SEQ ID NO: 35383 - protein, 38 aa, Diabrotica virgifera
  misc_feature: Coding regions on vcDNA: vcDNA=SeqID_15080; Strand=+; Position=1-114
GSKSDGACYVGPHGSFALIFFTHCINKIQKQQRIQNLF

SEQ ID NO: 35384 - protein, 316 aa, Diabrotica virgifera
  misc_feature: Coding regions on vcDNA: vcDNA=SeqID_15081; Strand=-; Position=1-948
  misc_feature: Homolog annotation: Hit_ID=EAL26687.1; Match level="QueryCoverage =94%, HitCoverage=63%, E-value=5e-49, Identity=35%"; Hit description =GA21065-PA [Drosophila pseudoobscura]
  misc_feature (27)..(27): Xaa can be any naturally occurring amino acid
  misc_feature (46)..(46): Xaa can be any naturally occurring amino acid
QGQARVKGGEGAAALLQGLGSLLGQAXEQGQGQGQGGEGAAALLQXLGSLLGQANDQGEGRAQGGDGAAAILNGLGSLLNQGGAGGQKLDLGSMLNFFASEDEEKPKKKSVGSKKVRKGDPKAESDFNLNDILSLAGSFLGQSGQDGKKGGSNFLSLLPTILQTMNAFVGPEARSREKSHAGHSSLMPPFLEKLHLMFDHFIHSEMGKNTIAALGAEKSFKVFLDDKGRFSYKKFGELMENHSYRRQWIRILTDRIAEFLQYASDPKVYKSYFVTAQVFFNSYLQKEGFPKSTQFDPKRPVETISAFVNYVGKRAA

SEQ ID NO: 35385 - protein, 97 aa, Diabrotica virgifera
  misc_feature: Coding regions on vcDNA: vcDNA=SeqID_15082; Strand=-; Position=2-292
YKSCETLLSRYSRQPENSSGDPSMTAQYKNAGLAGGQRLFSPKIPPKAKKKGQKLLLQKTSLTRLQSKSKHSNIKKTNRPGDLRAIATLQDTCMGVP

SEQ ID NO: 35386 - protein, 78 aa, Diabrotica virgifera
  misc_feature: Coding regions on vcDNA: vcDNA=SeqID_15083; Strand=+; Position=67-303
LPSFTIYQRKSIPGEDYFLNYINLPQFIYISMPHEPIHEVLTEAGGQIAYSLLYMMAKGDVCQPQPNLRPPAFGISHP

SEQ ID NO: 35387 - protein, 105 aa, Diabrotica virgifera
  misc_feature: Coding regions on vcDNA: vcDNA=SeqID_15084; Strand=+; Position=225-542
DCHADYEHHTESHIVWNTGTEQCHVSYTMTVTQISRLYKSRYLDKYHRNINSNVWGRTDRYIIYYNAAAAYLGCEMQFNALRPLPDPGSSHSCLPRTLSPVTTNV

SEQ ID NO: 35388 - protein, 288 aa, Diabrotica virgifera
  misc_feature: Coding regions on vcDNA: vcDNA=SeqID_15085; Strand=+; Position=81-944
  misc_feature: Homolog annotation: Hit_ID=NP_651461.1; Match level="QueryCoverage =100%, HitCoverage=93%, E-value=1e-90, Identity=56%"; Hit description= CG14544-PA [Drosophila melanogaster] gb|AAF56565.1| CG14544-PA [Drosophila melanogaster]
  misc_feature: Gene Ontology Annotation: Molecular function=tRNA methyltransferase activity; Cellular component=nucleus; Biological process =gametogenesis
  misc_feature (238)..(243): Xaa can be any naturally occurring amino acid
MSFNGYQNIIKEGDTVILYLTISQVYPIKAQSKTINKKGVEVENVFQTSYGALKCADLIGKNYGTKISLSKGWGYALQPTPELWTITLPHRTQIIYTPDISMIILQLELSPGSVVIESGTGSGSLSHALIRAVKPHGHLYTFDFHEDRAKTASDEFSEHGFSEYVTVKHRDVCENGFGEDLDGKADAVFLDLPHPWFAITHALKSIKTTGGRICSFSPCIEQVQKSCLILLKLGFQEXXXXXXLQTQLSVQQRTIPIVSLDFLKTEDENEREKQKEYSKTVVSVPPAT

SEQ ID NO: 35389 - protein, 66 aa, Diabrotica virgifera; identical to SEQ ID NO: 26808
  misc_feature: Coding regions on vcDNA: vcDNA=SeqID_15086; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35390 - protein, 53 aa, Diabrotica virgifera
  misc_feature: Coding regions on vcDNA: vcDNA=SeqID_15087; Strand=-; Position=1-159
  misc_feature (14)..(38): Xaa can be any naturally occurring amino acid
  misc_feature (40)..(53): Xaa can be any naturally occurring amino acid
TAFNQTSNDYATIXXXXXXXXXXXXXXXXXXXXXXXXXRXXXXXXXXXXXXXX

SEQ ID NO: 35391 - protein, 21 aa, Diabrotica virgifera
  misc_feature: Coding regions on vcDNA: vcDNA=SeqID_15088; Strand=-; Position=1-63
  misc_feature (5)..(19): Xaa can be any naturally occurring amino acid
DQKIXXXXXXXXXXXXXXXIT

SEQ ID NO: 35392 - protein, 239 aa, Diabrotica virgifera
  misc_feature: Coding regions on vcDNA: vcDNA=SeqID_15089; Strand=+; Position=146-862
  misc_feature: Homolog annotation: Hit_ID=XP_317058.1; Match level="QueryCoverage =86%, HitCoverage=72%, E-value=4e-30, Identity=35%"; Hit description =ENSANGP00000019732 [Anopheles gambiae]
  misc_feature (107)..(124): Xaa can be any naturally occurring amino acid
  misc_feature (178)..(185): Xaa can be any naturally occurring amino acid
MPVVNTSMALLPVAEASNAEPTENQPRQPMSLQGLLRFSMEATRAEDAPSNSEFAPMDEERKKFLEEALNSMSVDVVQIMQRQIAFLKGVESVDPSECNTNYLEAIXXXXXXXXXXXXXXXXXXIGGFTTIYPCMKSNDSKIRAAGCELLAVLCQNNPYCQTVVLDNEFIPKLLHMIXXXXXXXXVTKAIYALGGIVRDNPEGLTQLIHYNGLTVLLNCLKSNHEKCIIKSAFLLGTLC

SEQ ID NO: 35393 - protein, 215 aa, Diabrotica virgifera
  misc_feature: Coding regions on vcDNA: vcDNA=SeqID_15090; Strand=+; Position=105-752
  misc_feature: Homolog annotation: Hit_ID=XP_393945.1; Match level="QueryCoverage =97%, HitCoverage=43%, E-value=8e-65, Identity=58%"; Hit description =similar to CG2121-PA [Apis mellifera]
  misc_feature: Pfam annotation: Pfam_ID=DUF895; Match level="Score=-55.3, E-value =0.00087, Copies=1"; Pfam description=Eukaryotic protein of unknown functio
MEAKFHQISTSENNEGTDKAEVRRIWKNVMLINLAFMVHFTAFWGASNLQSSVNAEGALGTFTLASIYGSLLISNILLPALVIKWLGAKRTIAVSFIMYMPFILAQFHPAFYTLIPAGLAVGFGGGPLWCAKCTYLTIIAETYAQITDVEAEGVITRFFGIFFMFFSFAQVWGNLISSAVLSSGDSETPLPLSTTTEALIPKSLFTNATKSCAEN

SEQ ID NO: 35394 - protein, 207 aa, Diabrotica virgifera
  misc_feature: Coding regions on vcDNA: vcDNA=SeqID_15091; Strand=+; Position=272-892
  misc_feature: Homolog annotation: Hit_ID=AAC61263.1; Match level="QueryCoverage =98%, HitCoverage=29%, E-value=7e-39, Identity=43%"; Hit description =soluble guanylyl cyclase alpha-1 subunit [Manduca sexta]
  misc_feature (150)..(150): Xaa can be any naturally occurring amino acid
MTACPFRRPSGSTAVQNGGGGAALKRTFTTKQNSIQITDDQFEEDRNTLNLKHLNEAILILTSPTNEAVQQGLTSLLIKEGPTNRYKYSCLDPLPESVTSCSHYAYLEDLYDMVKCENDIDINTFFDNLGQELIAASLNSRTERAFICLXGDLNEFLTTLDGVYDVLKYQENDRESEHETEAFVCTAINEKNLQLDFSTEKPAIAYL

SEQ ID NO: 35395 - protein, 25 aa, Diabrotica virgifera
  misc_feature: Coding regions on vcDNA: vcDNA=SeqID_15092; Strand=-; Position=1-75
  misc_feature (6)..(23): Xaa can be any naturally occurring amino acid
KKLDSXXXXXXXXXXXXXXXXXXPQ

SEQ ID NO: 35396 - protein, 137 aa, Diabrotica virgifera
  misc_feature: Coding regions on vcDNA: vcDNA=SeqID_15093; Strand=+; Position=80-493
  misc_feature: Homolog annotation: Hit_ID=XP_309156.1; Match level="QueryCoverage =90%, HitCoverage=68%, E-value=3e-30, Identity=51%"; Hit description =ENSANGP00000018748 [Anopheles gambiae]
MAISRLSIIKFLELAIAIACIGLHYKSKTNDLDTDTLSSAAFGGYVIILIGGFAGYLMSTPFNKRIDIFFSLVGCALFVAAGALNIKIYDKYGKSEWRDFGLAKASLAIVNGALFLLDSLLTWRGDFNIPTDKLAIC

SEQ ID NO: 35397 - protein, 17 aa, Diabrotica virgifera
  misc_feature: Coding regions on vcDNA: vcDNA=SeqID_15094; Strand=-; Position=0-50
  misc_feature (3)..(3): Xaa can be any naturally occurring amino acid
  misc_feature (5)..(15): Xaa can be any naturally occurring amino acid
KKXIXXXXXXXXXXXKV

SEQ ID NO: 35398 - protein, 231 aa, Diabrotica virgifera
  misc_feature: Coding regions on vcDNA: vcDNA=SeqID_15095; Strand=+; Position=75-770
  misc_feature (6)..(11): Xaa can be any naturally occurring amino acid
FNSIMXXXXXXLNSDPEPLIPGKMEGSFVKAGPPDGLVGMKNLLSSTEIPERPENRKPTDQKFLIVFAVAVIILLPFLIYTLVYSDFDHNKGYDQCGNVCGQKNMKYDNWACSGEDNTNKPYLLYYTSVHNLEGERKCVERCEDGDYPGNGAYCTKITSSDDFGDGLSDYLNKHAGTIVFACFLSLGVGLIMLFLFKSATDVVVLGRSSMSSIFWNIFVLRTWYCYFIFTM

SEQ ID NO: 35399 - protein, 88 aa, Diabrotica virgifera
  misc_feature: Coding regions on vcDNA: vcDNA=SeqID_15096; Strand=+; Position=3-266
  misc_feature: Homolog annotation: Hit_ID=XP_313843.1; Match level="QueryCoverage =95%, HitCoverage=9%, E-value=2e-35, Identity=84%"; Hit description =ENSANGP00000011728 [Anopheles gambiae]
RTSPREKEAAYQERLRAWETRERRKAKDYEKEREKERTKEEERERDAKRLKEFLEDYDDERDDLKYYKGRELQKRLAERVKEADGDGR

SEQ ID NO: 35400 - protein, 125 aa, Diabrotica virgifera
  misc_feature: Coding regions on vcDNA: vcDNA=SeqID_15097; Strand=-; Position=538-915
  misc_feature (2)..(22): Xaa can be any naturally occurring amino acid
  misc_feature (25)..(38): Xaa can be any naturally occurring amino acid
  misc_feature (41)..(95): Xaa can be any naturally occurring amino acid
LXXXXXXXXXXXXXXXXXXXXXDEXXXXXXXXXXXXXXIRXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 35401 - protein, 79 aa, Diabrotica virgifera
  misc_feature: Coding regions on vcDNA: vcDNA=SeqID_15098; Strand=-; Position=1-237
  misc_feature (1)..(16): Xaa can be any naturally occurring amino acid
  misc_feature (18)..(79): Xaa can be any naturally occurring amino acid
XXXXXXXXXXXXXXXXKXXXXXXXXXXXXXXXXXXXXXXXXXXXXXXXXXXXXXXXXXXXXXXXXXXXXXXXXXXXXXX

SEQ ID NO: 35402 - protein, 83 aa, Diabrotica virgifera; identical to SEQ ID NO: 28726
  misc_feature: Coding regions on vcDNA: vcDNA=SeqID_15099; Strand=-; Position=2-250
  misc_feature (1)..(17): Xaa can be any naturally occurring amino acid
  misc_feature (20)..(30): Xaa can be any naturally occurring amino acid
  misc_feature (40)..(47): Xaa can be any naturally occurring amino acid
  misc_feature (50)..(63): Xaa can be any naturally occurring amino acid
  misc_feature (69)..(82): Xaa can be any naturally occurring amino acid

SEQ ID NO: 35403 - protein, 80 aa, Diabrotica virgifera
  misc_feature: Coding regions on vcDNA: vcDNA=SeqID_15100; Strand=+; Position=187-429
  misc_feature (6)..(29): Xaa can be any naturally occurring amino acid
  misc_feature (65)..(70): Xaa can be any naturally occurring amino acid
RIYVHXXXXXXXXXXXXXXXXXXXXXXXXFRTTYSINLVYLDLIVKSSSIKTLTSFFSITCKCHXXXXXXCVFNYEKRTI

SEQ ID NO: 35404 - protein, 97 aa, Diabrotica virgifera
  misc_feature: Coding regions on vcDNA: vcDNA=SeqID_15101; Strand=+; Position=392-685
  misc_feature (66)..(75): Xaa can be any naturally occurring amino acid
YSRIDTTIIGTSTKYENRQAIHCTRSIICNTLITCSSTRCYSSYLDDTRSGGHSSLVRYCFTHFLXXXXXXXXXXLQRACDYCYTDYVTDYTLQTES

SEQ ID NO: 35405 - protein, 267 aa, Diabrotica virgifera
  misc_feature: Coding regions on vcDNA: vcDNA=SeqID_15102; Strand=-; Position=1-801
  misc_feature (2)..(267): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35406 - protein, 109 aa, Diabrotica virgifera
  misc_feature: Coding regions on vcDNA: vcDNA=SeqID_15103; Strand=+; Position=7-336
  misc_feature (18)..(43): Xaa can be any naturally occurring amino acid
CPLSGPCSTFRLTDRSVXXXXXXXXXXXXXXXXXXXXXXXXXXSVYLLRLVFPNRLHWFSYFELSIISFLPFVNISFCFTGFTVLINLCTHLYYKVTNTEPVKKRNYVC

SEQ ID NO: 35407 - protein, 25 aa, Diabrotica virgifera
  misc_feature: Coding regions on vcDNA: vcDNA=SeqID_15104; Strand=-; Position=0-74
  misc_feature (1)..(24): Xaa can be any naturally occurring amino acid
XXXXXXXXXXXXXXXXXXXXXXXXP

SEQ ID NO: 35408 - protein, 31 aa, Diabrotica virgifera
  misc_feature: Coding regions on vcDNA: vcDNA=SeqID_15105; Strand=-; Position=0-92
  misc_feature (1)..(30): Xaa can be any naturally occurring amino acid
XXXXXXXXXXXXXXXXXXXXXXXXXXXXXXP

SEQ ID NO: 35409 - protein, 66 aa, Diabrotica virgifera
  misc_feature: Coding regions on vcDNA: vcDNA=SeqID_15106; Strand=-; Position=1-198
  misc_feature (3)..(13): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
PFXXXXXXXXXXXTNLAHTGLNXXXXXXXXRTXXXXXXXXXXXXXIQHRGRXXXXXXXXXXXXXLL

SEQ ID NO: 35410 - protein, 297 aa, Diabrotica virgifera
  misc_feature: Coding regions on vcDNA: vcDNA=SeqID_15107; Strand=+; Position=2-894
  misc_feature: Homolog annotation: Hit_ID=EAL34565.1; Match level="QueryCoverage =100%, HitCoverage=38%, E-value=1e-99, Identity=59%"; Hit description= GA21641-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=UPF0120; Match level="Score=191.2, E-value =2.1e-54, Copies=1"; Pfam description=Uncharacterised protein family (UPF012
  misc_feature (262)..(262): Xaa can be any naturally occurring amino acid
  misc_feature (270)..(270): Xaa can be any naturally occurring amino acid
  misc_feature (293)..(293): Xaa can be any naturally occurring amino acid
LELGPAVRRFLGLQVKSKQPPHKCKKFIKIKKYLKAYFTDILKLLQGVTSSNIQTVLLKHLHYMSSLLTSFPHITKSIVKRLVTFWGTAEDSVRVVAFFCILRITNNQQSTILDTVLKSMYMTYVKNSKFVSFKGLPVINFMRRSLVEMFALDVNFAYQHVFLYIRQLAIHLRNAITVNKKENIQAVYNWQFVNSLKLWGNLLAVTYNKKIMQQLVYPLVQICIGTIKLIPTAQYYPLRFHIVQILMDLSKETGVFIPVLPXLLEVLTSXDFNKKHKKVSMKPLHFTCLLRLXKSQL

SEQ ID NO: 35411 - protein, 286 aa, Diabrotica virgifera
  misc_feature: Coding regions on vcDNA: vcDNA=SeqID_15108; Strand=+; Position=90-946
  misc_feature: Homolog annotation: Hit_ID=XP_392152.1; Match level="QueryCoverage =74%, HitCoverage=15%, E-value=8e-33, Identity=40%"; Hit description =similar to ENSANGP00000011094 [Apis mellifera]
  misc_feature (262)..(262): Xaa can be any naturally occurring amino acid
MLDDISETKATMQADELEAVICKKVEFPSEMTFKSEDLNHSIIKEEPQVEELSSEIDSIRYKGINLEDDIEKVEVTSHDSSEETEDFENTPSPKEDDQNVFSQIPTQSPNESIKSWLQRITEVQSEMQKKYFSELGNSGPIASNSALNSSSSLTNSSTSTSQNSSRVVKYQDLPYMGEMTLDNSKPRRGRKPKKADICHLIYKNYGTIFPGTPNPGNYLEKDPNLFKKSALVDSNREDSLNRSDVHNRIISSLLEKRLTQDXSTTNDIKKSSKEDKSNHDEPLNLC

SEQ ID NO: 35412 - protein, 156 aa, Diabrotica virgifera
  misc_feature: Coding regions on vcDNA: vcDNA=SeqID_15109; Strand=+; Position=1-471
  misc_feature: Homolog annotation: Hit_ID=EAL27755.1; Match level="QueryCoverage =57%, HitCoverage=19%, E-value=4e-10, Identity=39%"; Hit description =GA19017-PA [Drosophila pseudoobscura]
PRFEFDDEDDRPVWDKGTNDINDKEYNRPARPPSNGATIPLSAQDEDTLNEIFTTKTTQSPPNRQTRPTRPTRPTRPTRPTQRTRPTTPRTPTPTPTTRRTPKTDGPSDCVWAVVSCCSANSDMYPEGCFEARGCPGPFWGNSPCALKYYRPSARK

SEQ ID NO: 35413 - protein, 279 aa, Diabrotica virgifera
  misc_feature: Coding regions on vcDNA: vcDNA=SeqID_15110; Strand=-; Position=1-837
  misc_feature (2)..(279): Xaa can be any naturally occurring amino acid
TXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35414 - protein, 20 aa, Diabrotica virgifera
  misc_feature: Coding regions on vcDNA: vcDNA=SeqID_15111; Strand=-; Position=1-60
  misc_feature (3)..(3): Xaa can be any naturally occurring amino acid
  misc_feature (5)..(18): Xaa can be any naturally occurring amino acid
NNXIXXXXXXXXXXXXXXIN

SEQ ID NO: 35415 - protein, 81 aa, Diabrotica virgifera
  misc_feature: Coding regions on vcDNA: vcDNA=SeqID_15112; Strand=-; Position=0-242
  misc_feature (8)..(66): Xaa can be any naturally occurring amino acid
  misc_feature (68)..(78): Xaa can be any naturally occurring amino acid
KKWDQKIXXXXXXXXXXXXXXXXXXXXXXXXXXXXXXXXXXXXXXXXXXXXXXXXXXXXXXXXXXXNXXXXXXXXXXXHPT

SEQ ID NO: 35416 - protein, 66 aa, Diabrotica virgifera; identical to SEQ ID NO: 26808
  misc_feature: Coding regions on vcDNA: vcDNA=SeqID_15113; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35417 - protein, 171 aa, Diabrotica virgifera
  misc_feature: Coding regions on vcDNA: vcDNA=SeqID_15114; Strand=+; Position=252-768
  misc_feature: Homolog annotation: Hit_ID=CAE47497.1; Match level="QueryCoverage =99%, HitCoverage=53%, E-value=3e-28, Identity=43%"; Hit description =cathepsin L-like proteinase [Diabrotica virgifera virgifera]
  misc_feature: Gene Ontology Annotation: Cellular component=extracellular space
  misc_feature: Pfam annotation: Pfam_ID=Peptidase_C1; Match level="Score=-85.0, E -value=3.6e-05, Copies=1"; Pfam description=Papain family cysteine protease
  misc_feature (31)..(31): Xaa can be any naturally occurring amino acid
  misc_feature (64)..(64): Xaa can be any naturally occurring amino acid
  misc_feature (80)..(80): Xaa can be any naturally occurring amino acid
  misc_feature (89)..(89): Xaa can be any naturally occurring amino acid
  misc_feature (122)..(122): Xaa can be any naturally occurring amino acid
PNAEFKAMIDSQMAQRPQLLIAETFQADSNXQLPTNDDWRNKNVDWGARNHRSCGSCWAITSRXHIEGQLAIHKKQHASXLAEQELVDXRPSIDNGCNDTLNDRCSLTTLERHALAIQMKYXHTVNVDKCNNVHKQVSSLSGFVNLAITETALHNALANDTPISIYADADT

SEQ ID NO: 35418 - protein, 235 aa, Diabrotica virgifera
  misc_feature: Coding regions on vcDNA: vcDNA=SeqID_15115; Strand=+; Position=3-710
  misc_feature (1)..(71): Xaa can be any naturally occurring amino acid
  misc_feature (74)..(119): Xaa can be any naturally occurring amino acid
  misc_feature (125)..(161): Xaa can be any naturally occurring amino acid
  misc_feature (164)..(186): Xaa can be any naturally occurring amino acid
  misc_feature (190)..(212): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXIYXXXXXXXXXXXXXXXXXXXXXXXXXXXXXXXXXXXXXXXXXXXXXXLRYHNXXXXXXXXXXXXXXXXXXXXXXXXXXXXXXXXXXXXXKTXXXXXXXXXXXXXXXXXXXXXXXIYFXXXXXXXXXXXXXXXXXXXXXXXILLIIRISYLKDNSVILLESSNR

SEQ ID NO: 35419 - protein, 163 aa, Diabrotica virgifera
  misc_feature: Coding regions on vcDNA: vcDNA=SeqID_15116; Strand=+; Position=108-600
  misc_feature: Homolog annotation: Hit_ID=CAE47497.1; Match level="QueryCoverage =89%, HitCoverage=46%, E-value=2e-22, Identity=40%"; Hit description =cathepsin L-like proteinase [Diabrotica virgifera virgifera]
  misc_feature: Gene Ontology Annotation: Cellular component=extracellular space
  misc_feature (38)..(38): Xaa can be any naturally occurring amino acid
  misc_feature (54)..(54): Xaa can be any naturally occurring amino acid
  misc_feature (82)..(82): Xaa can be any naturally occurring amino acid
  misc_feature (106)..(106): Xaa can be any naturally occurring amino acid
MAKHSKQYKLLKNKLRYPIFPKNLHEIKKHNAKYTKGXVICAQGISTFSHCTKXEIKALLKRQSASKPKLDNRLGMYTAHPXVNVPASVDRRTDNAILPGTYHGSXATGWVFFMGISLQGQISIHYNQRVPLNPQYLVDCSEENDGCGAVYPGYLSRLIDITV

SEQ ID NO: 35420 - protein, 53 aa, Diabrotica virgifera
  misc_feature: Coding regions on vcDNA: vcDNA=SeqID_15117; Strand=-; Position=1-159
  misc_feature (3)..(14): Xaa can be any naturally occurring amino acid
  misc_feature (16)..(50): Xaa can be any naturally occurring amino acid
KKXXXXXXXXXXXXFXXXXXXXXXXXXXXXXXXXXXXXXXXXXXXXXXXXKKM

SEQ ID NO: 35421 - protein, 34 aa, Diabrotica virgifera; identical to SEQ ID NO: 27603
  misc_feature: Coding regions on vcDNA: vcDNA=SeqID_15118; Strand=-; Position=80-184

SEQ ID NO: 35422 - protein, 108 aa, Diabrotica virgifera; identical to SEQ ID NO: 27732
  misc_feature: Coding regions on vcDNA: vcDNA=SeqID_15119; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 35423 - protein, 23 aa, Diabrotica virgifera
  misc_feature: Coding regions on vcDNA: vcDNA=SeqID_15120; Strand=-; Position=1-69
  misc_feature (1)..(23): Xaa can be any naturally occurring amino acid
XXXXXXXXXXXXXXXXXXXXXXX

SEQ ID NO: 35424 - protein, 95 aa, Diabrotica virgifera
  misc_feature: Coding regions on vcDNA: vcDNA=SeqID_15121; Strand=-; Position=620-907
IEIWKGNRVIVEWHRGNGVRKPMSKRAPRPSSGHRSHSRIGHVSHRHKGHRVHRRKGHGTDRQKAHGATIEGHRTIVESFTMSWSKCTKSIGNVV

SEQ ID NO: 35425 - protein, 82 aa, Diabrotica virgifera
  misc_feature: Coding regions on vcDNA: vcDNA=SeqID_15122; Strand=+; Position=103-351
  misc_feature: Homolog annotation: Hit_ID=XP_317573.1; Match level="QueryCoverage =96%, HitCoverage=75%, E-value=9e-36, Identity=93%"; Hit description =ENSANGP00000010151 [Anopheles gambiae]
  misc_feature: Pfam annotation: Pfam_ID=ubiquitin; Match level="Score=118.7, E-value= 1.4e-32, Copies=1"; Pfam description=Ubiquitin family
YITMLIKVKTLTGKEIEIDIEPTDKVERIKERVEEKEGIPPQQQRLIFSGKQMNDEKTAQDYKVQGGSVLHLVLALRGGKPV

SEQ ID NO: 35426 - protein, 66 aa, Diabrotica virgifera; identical to SEQ ID NO: 26808
  misc_feature: Coding regions on vcDNA: vcDNA=SeqID_15123; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35427 - protein, 68 aa, Diabrotica virgifera
  misc_feature: Coding regions on vcDNA: vcDNA=SeqID_15124; Strand=-; Position=9-215
  misc_feature (50)..(57): Xaa can be any naturally occurring amino acid
LKTNTTFYIFVIRELIPIIQYDDNEIAQYHSKVYSMLFLKCSATSILDFXXXXXXXXLCITGGVKIFY

SEQ ID NO: 35428 - protein, 285 aa, Diabrotica virgifera
  misc_feature: Coding regions on vcDNA: vcDNA=SeqID_15125; Strand=+; Position=66-918
  misc_feature: Homolog annotation: Hit_ID=XP_317142.1; Match level="QueryCoverage =98%, HitCoverage=54%, E-value=5e-71, Identity=48%"; Hit description =ENSANGP00000018313 [Anopheles gambiae]
  misc_feature: Gene Ontology Annotation: Molecular function=protein binding; Cellular component=integral to plasma membrane; Biological process =intracellular signaling cascade
  misc_feature: Pfam annotation: Pfam_ID=PDZ; Match level="Score=56.0, E-value=1e-13, Copies=1"; Pfam description=PDZ domain (Also known as DHR or GLGF
  misc_feature (271)..(271): Xaa can be any naturally occurring amino acid
MSVEDEQVHEIEDDIPVIPKPESTEGRDLLKEVQIRCSLSWNIDARELGTLLNSPEIKTLIDCHDDIAKIYENPKPEKDNSPKLFPNGMTGEEYRMVGVRKKPGEPLGLTVQVDENGNLTIALIIEGGMIEKQGLLHVGDIILEVNGTPVATPEDLQTEIAKTKDHVTLKVHSDTGNGEVTHSNIVMANGNNGVTKKLTCYMRALYEYIPQEDTLLPCKEIGLPFDRGDIFQIVDQRDPNWWQAKKVGGDGTTGLIPSFRVEERRKPSYPXEADFVHTISICGAR

SEQ ID NO: 35429 - protein, 70 aa, Diabrotica virgifera
  misc_feature: Coding regions on vcDNA: vcDNA=SeqID_15126; Strand=-; Position=2-211
  misc_feature (7)..(17): Xaa can be any naturally occurring amino acid
  misc_feature (25)..(25): Xaa can be any naturally occurring amino acid
  misc_feature (27)..(34): Xaa can be any naturally occurring amino acid
  misc_feature (37)..(50): Xaa can be any naturally occurring amino acid
  misc_feature (56)..(69): Xaa can be any naturally occurring amino acid
YILVPFXXXXXXXXXXXTNWAHTGXNXXXXXXXXSNXXXXXXXXXXXXXXPTSRSXXXXXXXXXXXXXXV

SEQ ID NO: 35430 - protein, 78 aa, Diabrotica virgifera
  misc_feature: Coding regions on vcDNA: vcDNA=SeqID_15127; Strand=-; Position=2-235
  misc_feature (3)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
YYXXXXXXXXXXSFXXXXXXXXXXXTNLAHTGLNXXXXXXXXSNXXXXXXXXXXXXXXPTSRSXXXXXXXXXXXXXXV

SEQ ID NO: 35431 - protein, 286 aa, Diabrotica virgifera
  misc_feature: Coding regions on vcDNA: vcDNA=SeqID_15128; Strand=+; Position=110-967
  misc_feature: Homolog annotation: Hit_ID=EAA20445.1; Match level="QueryCoverage =89%, HitCoverage=49%, E-value=3e-09, Identity=26%"; Hit description =hypothetical protein [Plasmodium yoelii yoelii]
  misc_feature (136)..(143): Xaa can be any naturally occurring amino acid
  misc_feature (155)..(174): Xaa can be any naturally occurring amino acid
  misc_feature (267)..(267): Xaa can be any naturally occurring amino acid
MSWFNFNDSLNIVKGQISNLANNVLADGEEDQEIKDGDYKQLQELCQQQELEIKKLRKINEELNDRQTQPHNASSNGSWNWAEDSSTTTPHDTISDLRKQIHVLENEKSELLGQLDQLDADNQENLANIMEMKEKXXXXXXXXKENLLKVKKDNXXXXXXXXXXXXXXXXXXXXEKGEHVEGDNEEVDQKSRELEEANRKLISELEDLKKEKVERLQHTEKAEHVEGHKEEVDQKFIELEEANRKLISEIEELKKEMSILQTSYQTXEKALEDTKTSGSNKNETPQ

SEQ ID NO: 35432 - protein, 74 aa, Diabrotica virgifera
  misc_feature: Coding regions on vcDNA: vcDNA=SeqID_15129; Strand=+; Position=57-281
  misc_feature: Homolog annotation: Hit_ID=NP_610390.1; Match level="QueryCoverage =95%, HitCoverage=14%, E-value=4e-13, Identity=48%"; Hit description =CG2397-PA [Drosophila melanogaster] gb|AAF59076.1| CG2397-PA [Drosophila melanogaster]
ISKRMSFGFIFFVEGPRTCIGLRFGKLQSKVGLCYVLRNYKVTLNEKTKLPIRYESNFISTVKDGIWLNLEPVS

SEQ ID NO: 35433 - protein, 80 aa, Diabrotica virgifera
  misc_feature: Coding regions on vcDNA: vcDNA=SeqID_15130; Strand=-; Position=363-605
  misc_feature (22)..(28): Xaa can be any naturally occurring amino acid
  misc_feature (62)..(71): Xaa can be any naturally occurring amino acid
NKLTFFTSLDLSNCCQFFGLVXXXXXXXTYEVLRPLSSYLHLHRRNDKINTKFLWFITLVSXXXXXXXXXXALNFPARLV

SEQ ID NO: 35434 - protein, 19 aa, Diabrotica virgifera
  misc_feature: Coding regions on vcDNA: vcDNA=SeqID_15131; Strand=-; Position=1-57
LKSSYLIFSGYKIAPPRRL

SEQ ID NO: 35435 - protein, 302 aa, Diabrotica virgifera
  misc_feature: Coding regions on vcDNA: vcDNA=SeqID_15132; Strand=+; Position=2-910
  misc_feature: Homolog annotation: Hit_ID=AAF87756.1; Match level="QueryCoverage =100%, HitCoverage=68%, E-value=1e-114, Identity=72%"; Hit description=cytochrome oxidase subunit I [Diabrotica lemniscata]
  misc_feature: Pfam annotation: Pfam_ID=COX1; Match level="Score=104.9, E-value=2.1e- 28, Copies=1"; Pfam description=Cytochrome C and Quinol oxidase polyp
  misc_feature (16)..(16): Xaa can be any naturally occurring amino acid
  misc_feature (61)..(69): Xaa can be any naturally occurring amino acid
  misc_feature (73)..(79): Xaa can be any naturally occurring amino acid
  misc_feature (90)..(97): Xaa can be any naturally occurring amino acid
  misc_feature (118)..(118): Xaa can be any naturally occurring amino acid
  misc_feature (153)..(153): Xaa can be any naturally occurring amino acid
  misc_feature (170)..(170): Xaa can be any naturally occurring amino acid
  misc_feature (173)..(179): Xaa can be any naturally occurring amino acid
  misc_feature (206)..(212): Xaa can be any naturally occurring amino acid
  misc_feature (226)..(226): Xaa can be any naturally occurring amino acid
  misc_feature (234)..(250): Xaa can be any naturally occurring amino acid
  misc_feature (280)..(280): Xaa can be any naturally occurring amino acid
  misc_feature (294)..(294): Xaa can be any naturally occurring amino acid
IRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISFIXVLFLNFII

SEQ ID NO: 35436 - protein, 23 aa, Diabrotica virgifera
  misc_feature: Coding regions on vcDNA: vcDNA=SeqID_15133; Strand=-; Position=1-69
  misc_feature (2)..(21): Xaa can be any naturally occurring amino acid
KXXXXXXXXXXXXXXXXXXXXSF

SEQ ID NO: 35437 - protein, 319 aa, Diabrotica virgifera
  misc_feature: Coding regions on vcDNA: vcDNA=SeqID_15134; Strand=+; Position=2-958
  misc_feature: Homolog annotation: Hit_ID=AAH84502.1; Match level="QueryCoverage =82%, HitCoverage=82%, E-value=5e-63, Identity=48%"; Hit description =Unknown (protein for MGC:89558) [Xenopus tropicalis]
  misc_feature: Gene Ontology Annotation: Cellular component=nucleus; Biological process=cell growth
  misc_feature (299)..(299): Xaa can be any naturally occurring amino acid
MTSTTVTKRHREKNSAKATSQENWKGKAKDEITDKKDKESQPKDFKYGPLPRFPSQRVWSRGVMIIGVLVYLWYFSKSTNETVLAKQNTVYNRRSQVVECGPEFVEDIKQYKSCIPEKCGRFVSDKIVTDQEADILLRLAVRIMAQGGSSGGASIIDLHTGALSYKDRFINIYEQSGSKNILTESERTIYHLVRSKIQEAIAQNFGIQADSLYLTYPTFFSRLTNVDPKTRHDEYWHEHIDKRTYESFHYTSLLYLNDYGKDFKGGRFIFQDNIAKPTKNVTVEPRKGRVSMFTSGSEXPHFVERVEEGMRFAITVSFT

SEQ ID NO: 35438 - protein, 161 aa, Diabrotica virgifera
  misc_feature: Coding regions on vcDNA: vcDNA=SeqID_15135; Strand=+; Position=451-933
  misc_feature: Homolog annotation: Hit_ID=AAH82383.1; Match level="QueryCoverage =89%, HitCoverage=21%, E-value=7e-09, Identity=26%"; Hit description =MGC81767 protein [Xenopus laevis]
  misc_feature (3)..(3): Xaa can be any naturally occurring amino acid
  misc_feature (106)..(106): Xaa can be any naturally occurring amino acid
SKXMYIVSASTTIKFHEFPDGNVIHNYQPGKVEGPIRSVSWSQDGNWLVVVPHSGQTEIVSTKDQLKLLKTIHEVDEPTVACFQNTTKKLVGIGTKSGLVLIYDIXSRNVKKRFARASTQVTHVAFTAKDTHCVAGCKNGEILVYNNVTNSPPSNLRVSKS

SEQ ID NO: 35439 - protein, 24 aa, Diabrotica virgifera
  misc_feature: Coding regions on vcDNA: vcDNA=SeqID_15136; Strand=-; Position=0-71
  misc_feature (3)..(22): Xaa can be any naturally occurring amino acid
KKXXXXXXXXXXXXXXXXXXXXIT

SEQ ID NO: 35440 - protein, 263 aa, Diabrotica virgifera
  misc_feature: Coding regions on vcDNA: vcDNA=SeqID_15137; Strand=-; Position=0-788
  misc_feature (5)..(19): Xaa can be any naturally occurring amino acid
  misc_feature (30)..(40): Xaa can be any naturally occurring amino acid
  misc_feature (42)..(60): Xaa can be any naturally occurring amino acid
  misc_feature (62)..(118): Xaa can be any naturally occurring amino acid
  misc_feature (121)..(141): Xaa can be any naturally occurring amino acid
  misc_feature (145)..(186): Xaa can be any naturally occurring amino acid
  misc_feature (189)..(210): Xaa can be any naturally occurring amino acid
  misc_feature (215)..(221): Xaa can be any naturally occurring amino acid
  misc_feature (229)..(239): Xaa can be any naturally occurring amino acid
  misc_feature (241)..(262): Xaa can be any naturally occurring amino acid
PPLPXXXXXXXXXXXXXXXKVRRKNKINNXXXXXXXXXXXSXXXXXXXXXXXXXXXXXXXRXXXXXXXXXXXXXXXXXXXXXXXXXXXXXXXXXXXXXXXXXXXXXXXXXXXXXXXXXPPXXXXXXXXXXXXXXXXXXXXXRPTXXXXXXXXXXXXXXXXXXXXXXXXXXXXXXXXXXXXXXXXXXVLXXXXXXXXXXXXXXXXXXXXXXPHTPXXXXXXXGGEGRRAXXXXXXXXXXXGXXXXXXXXXXXXXXXXXXXXXXG

SEQ ID NO: 35441 - protein, 18 aa, Diabrotica virgifera
  misc_feature: Coding regions on vcDNA: vcDNA=SeqID_15138; Strand=-; Position=0-53
  misc_feature (8)..(16): Xaa can be any naturally occurring amino acid
ITLYPLRXXXXXXXXXGS

SEQ ID NO: 35442 - protein, 158 aa, Diabrotica virgifera
  misc_feature: Coding regions on vcDNA: vcDNA=SeqID_15139; Strand=+; Position=205-681
  misc_feature: Homolog annotation: Hit_ID=NP_610264.1; Match level="QueryCoverage =89%, HitCoverage=80%, E-value=2e-17, Identity=35%"; Hit description =CG11086-PA [Drosophila melanogaster] gb|AAF59278.1| CG11086-PA [Drosophila melanogaster]
  misc_feature: Pfam annotation: Pfam_ID=Ribosomal_L7Ae; Match level="Score=5.5, E -value=0.043, Copies=1"; Pfam description=Ribosomal protein L7Ae/L30e/S12e/Gadd
MCVETENQKSEMFNRTKLSRAMHAMLTQAKSNSRLICGLLPTITHLESSPEDVIFCLLPQTRPGDASAHMQTVLLQAFCYENYIPVIQVDSSEKLADYCGETYSEKQTNCTCAIVTRDFSLPSTPEDEIPMSPTEKMLADFYDFTLEQSTKPIIELPS

SEQ ID NO: 35443 - protein, 312 aa, Diabrotica virgifera
  misc_feature: Coding regions on vcDNA: vcDNA=SeqID_15140; Strand=+; Position=18-952
  misc_feature: Homolog annotation: Hit_ID=XP_394301.1; Match level="QueryCoverage =99%, HitCoverage=21%, E-value=1e-67, Identity=42%"; Hit description =similar to RE14504p [Apis mellifera]
  misc_feature: Pfam annotation: Pfam_ID=I-set; Match level="Score=22.9, E-value=9.9e- 06, Copies=1"; Pfam description=Immunoglobulin I-set domain
  misc_feature (1)..(1): Xaa can be any naturally occurring amino acid
  misc_feature (205)..(212): Xaa can be any naturally occurring amino acid
  misc_feature (272)..(272): Xaa can be any naturally occurring amino acid
  misc_feature (289)..(289): Xaa can be any naturally occurring amino acid
XLTSITLDITLIEKIHNTELLGVPKLNVLNLRRNKKLKIIETYVFADTPFLNELDISGNNLTFLPQSIANLTYLTKLNISNNPWACDCRMYWFASWVPNIKMKGNMVLSDLTCPDAYTNDMLPTLQHLNCTSPRIVYKTPTRRYRLNSDALLECRFAANPSPSITWVTPKREVYHWNPDQSIPDAFNKHPHAHDQLMIPLRVIPXXXXXXXXGTLWVKNVTREDCGRYTCYASNPIANLTDNVLLHIDPTDWNHVRIISLIVGTQSAAGFLXLTLIIQFLRYLAAKFGXLHNFCSFCKRDRVSPRARQIYAM

SEQ ID NO: 35444 - protein, 287 aa, Diabrotica virgifera
  misc_feature: Coding regions on vcDNA: vcDNA=SeqID_15141; Strand=+; Position=19-882
  misc_feature: Homolog annotation: Hit_ID=AAC64004.1; Match level="QueryCoverage =89%, HitCoverage=67%, E-value=3e-40, Identity=38%"; Hit description =prophenol oxidase activating enzyme precursor [Manduca sexta]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=13.7, E-value =5.6e-05, Copies=1"; Pfam description=Trypsin
  misc_feature (278)..(278): Xaa can be any naturally occurring amino acid
  misc_feature (284)..(284): Xaa can be any naturally occurring amino acid
MEKLYLWFVCVFYFEVFKIADAQRGQPCLTPNGNLEICKSIDDCRHFVRAIRRQNPSELNFVKKSQCGYDTSSLVCCGADADFVTSRNPSSILRKRALPSGNSNTLPEWASISDRNICGFQEYDNEAYIFGHGGIEAAINEHPWMALLGYTTRFGRIKWSCGGSLISNRYVLTAAHCVTGEVEVQVGKVTYVKLGVHDKTKEITCTKGGSCTEKAVTAGIESFFFHENYDANNKVSSNDIAVIKLNQTVEYTAFIRPICLPESNNELSRNDDLEIAGXGETEYXSTN

SEQ ID NO: 35445 - protein, 66 aa, Diabrotica virgifera; identical to SEQ ID NO: 26808
  misc_feature: Coding regions on vcDNA: vcDNA=SeqID_15142; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35446 - protein, 52 aa, Diabrotica virgifera
  misc_feature: Coding regions on vcDNA: vcDNA=SeqID_15143; Strand=-; Position=143-301
TNLLALSSREVLFFQMRILFFVYLYLLDSIIERILVVMGLFDKYHSSYPVRG

SEQ ID NO: 35447 - protein, 39 aa, Diabrotica virgifera
  misc_feature: Coding regions on vcDNA: vcDNA=SeqID_15144; Strand=-; Position=1-117
  misc_feature (1)..(39): Xaa can be any naturally occurring amino acid
XXXXXXXXXXXXXXXXXXXXXXXXXXXXXXXXXXXXXXX

SEQ ID NO: 35448 - protein, 202 aa, Diabrotica virgifera
  misc_feature: Coding regions on vcDNA: vcDNA=SeqID_15145; Strand=+; Position=123-731
  misc_feature (176)..(201): Xaa can be any naturally occurring amino acid
DIIMAFILPDNILETLLCSFCHKYLSVKPTKVYPNRLIQCGRCVDKKEQEQSIHDFEAVESQYGKIAENILFKCVNRFDGCRELLTYSQVKDHEQVCLEKIHECPICGEEMASFFLLRHFDSNHKDAILDCPAFVFKLNDLLEMPSVYIYQEEDNLFFLYISYTKSENTIKLYLVXXXXXXXXXXXXXXXXXXXXXXXXXXK

SEQ ID NO: 35449 - protein, 260 aa, Diabrotica virgifera
  misc_feature: Coding regions on vcDNA: vcDNA=SeqID_15146; Strand=-; Position=3-782
  misc_feature (4)..(11): Xaa can be any naturally occurring amino acid
  misc_feature (13)..(23): Xaa can be any naturally occurring amino acid
  misc_feature (33)..(41): Xaa can be any naturally occurring amino acid
  misc_feature (43)..(56): Xaa can be any naturally occurring amino acid
  misc_feature (63)..(75): Xaa can be any naturally occurring amino acid
  misc_feature (77)..(260): Xaa can be any naturally occurring amino acid
LNIXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35450 - protein, 90 aa, Diabrotica virgifera
  misc_feature: Coding regions on vcDNA: vcDNA=SeqID_15147; Strand=-; Position=1-270
ILSFTSLLTKITIYLRTLLSSHHGKDGYGCLCNYKVQMALLMIHQRASRLSNLSAQSPDAATWKKHMHFSRVNIVHFLPTFHQQSLNKPI

SEQ ID NO: 35451 - protein, 251 aa, Diabrotica virgifera
  misc_feature: Coding regions on vcDNA: vcDNA=SeqID_15148; Strand=+; Position=135-887
  misc_feature: Homolog annotation: Hit_ID=NP_609118.1; Match level="QueryCoverage =78%, HitCoverage=43%, E-value=2e-51, Identity=53%"; Hit description =CG5261-PB, isoform B [Drosophila melanogaster] gb|AAF52514.1| CG5261- PB, isoform B [Drosophila
  misc_feature: Gene Ontology Annotation: Molecular function=dihydrolipoamide S -acetyltransferase activity; Cellular component=mitochondrion; Biological process=acetyl-CoA biosynthesis from pyruvate
  misc_feature: Pfam annotation: Pfam_ID=Biotin_lipoyl; Match level="Score=39.6, E -value=9.5e-09, Copies=1"; Pfam description=Biotin-requiring enzyme
  misc_feature (113)..(118): Xaa can be any naturally occurring amino acid
  misc_feature (151)..(158): Xaa can be any naturally occurring amino acid
MFRTIILRNDVLRSKTLRNVSIECCKRRHYHRALFGNEHSQVLQRWVKAEHNFVRYYAADLPSHTKVTLPALSPTMELGTIVSWEKKEGDKLNEGDLLAEIETDKATMGFETXXXXXXARIIIPAGTKDVPIGKLVCIIVENEADIAAFKXXXXXXXXAPAPPKAAAPSAPAPSPAAPVAAAPPAPAMVADVSSTGRVYVSPMAKRLAEQRNIRLQAALEAASAAHPMAAALPSAGASASPFVDIPVTGNE

SEQ ID NO: 35452 - protein, 59 aa, Diabrotica virgifera
  misc_feature: Coding regions on vcDNA: vcDNA=SeqID_15149; Strand=+; Position=34-210
  misc_feature: Homolog annotation: Hit_ID=AAG44630.1; Match level="QueryCoverage =100%, HitCoverage=8%, E-value=2e-20, Identity=79%"; Hit description =90-kDa heat shock protein HSP83 [Spodoptera frugiperda]
  misc_feature: Gene Ontology Annotation: Molecular function=chaperonin ATPase activity; Cellular component=centrosome; Biological process =regulation of sleep
  misc_feature (25)..(33): Xaa can be any naturally occurring amino acid
KPTWTRNADDITQEEYGEFYKSLTXXXXXXXXXKHFSVEGQLEFRALLFVPRRVPFDLF

SEQ ID NO: 35453 - protein, 64 aa, Diabrotica virgifera
  misc_feature: Coding regions on vcDNA: vcDNA=SeqID_15150; Strand=+; Position=1-195
  misc_feature (20)..(27): Xaa can be any naturally occurring amino acid
KCYLHCNFTKIYAGLNNTSXXXXXXXXGLQVHTLVIEHCDIMLTLSLNGTSSHKYSLINIDPER

SEQ ID NO: 35454 - protein, 95 aa, Diabrotica virgifera
  misc_feature: Coding regions on vcDNA: vcDNA=SeqID_15151; Strand=-; Position=20-307
MPIIYTFRLTASASTDKYVLRKCANNRDPFDSGHFYRQQLEDERVTNNCTSNPLRRHGKYTQVTIIRQVHESFESGLRVDNIVRNRLNRNNILQT

SEQ ID NO: 35455 - protein, 57 aa, Diabrotica virgifera
  misc_feature: Coding regions on vcDNA: vcDNA=SeqID_15152; Strand=-; Position=1-171
  misc_feature (1)..(57): Xaa can be any naturally occurring amino acid
XXXXXXXXXXXXXXXXXXXXXXXXXXXXXXXXXXXXXXXXXXXXXXXXXXXXXXXXX

SEQ ID NO: 35456 - protein, 276 aa, Diabrotica virgifera
  misc_feature: Coding regions on vcDNA: vcDNA=SeqID_15153; Strand=+; Position=99-929
  misc_feature: Homolog annotation: Hit_ID=EAL28511.1; Match level="QueryCoverage =91%, HitCoverage=83%, E-value=1e-34, Identity=30%"; Hit description =GA15415-PA [Drosophila pseudoobscura]
  misc_feature: Gene Ontology Annotation: Molecular function=tocopherol binding; Cellular component=cytosol; Biological process=transport
  misc_feature: Pfam annotation: Pfam_ID=CRAL_TRIO; Match level="Score=-3.2, E-value =7e-05, Copies=1"; Pfam description=CRAL/TRIO domain
  misc_feature (241)..(241): Xaa can be any naturally occurring amino acid
  misc_feature (261)..(261): Xaa can be any naturally occurring amino acid
MTTNELLLTEHSKVRQQWGKSSKDVLQDIQILREWCETQKHFPEIPDDNMIEFFLTNCKYSIEKAKKNIDMYYTLPPLIPEVYEKRNPNLPGYQENVEKSGMIVTMPKLTESLQRVAIYAVKEDSTHFDPMTLVSHLQNVYEIRMHVDVVMGEFLIMDASNLKMGHVVKYTPIVFKTMVLILQNIMRNRITQIHIFHYPPYINIIMAVAKGILKKKLYDRIYLHENLESLYKHISPEFLPXDYGGKQKSMEELNELWKEEXVKWSDRFDKNQNASR

SEQ ID NO: 35457 - protein, 183 aa, Diabrotica virgifera
  misc_feature: Coding regions on vcDNA: vcDNA=SeqID_15154; Strand=+; Position=388-936
  misc_feature: Homolog annotation: Hit_ID=XP_314867.1; Match level="QueryCoverage =98%, HitCoverage=25%, E-value=5e-28, Identity=39%"; Hit description =ENSANGP00000005174 [Anopheles gambiae]
  misc_feature (33)..(33): Xaa can be any naturally occurring amino acid
  misc_feature (53)..(53): Xaa can be any naturally occurring amino acid
  misc_feature (163)..(163): Xaa can be any naturally occurring amino acid
  misc_feature (168)..(176): Xaa can be any naturally occurring amino acid
VKLTQLTMQNVSSCVRIQGENSTFFDINNGLRXGDALACLLFNIALEKSVRNXIRMNGTIFNRSTQILAFADDIIIVGRSVKDMVQCFTRLADAASELGLVVNEEKTIYMLVSKNFRNIEQRIQIINHTFEQVKEFTYLGSLVNSINTTSDDIKSIAIANRIXKRLQXXXXXXXXXRAIKAHI

SEQ ID NO: 35458 - protein, 283 aa, Diabrotica virgifera
  misc_feature: Coding regions on vcDNA: vcDNA=SeqID_15155; Strand=+; Position=3-854
  misc_feature: Homolog annotation: Hit_ID=XP_310746.1; Match level="QueryCoverage =74%, HitCoverage=35%, E-value=2e-11, Identity=28%"; Hit description =ENSANGP00000010045 [Anopheles gambiae]
EDDLEFEALAAESLSRPIVANQSFPVGTGSVVPENIKWGAFGDELKEEDEDVLADDPFDTTFAEIVVPDFNREIVTTGVSLKTNSTNGKNFADPISRVPETGLNLIKPEDRDLLGGSNSDLATSVSISTPAFKPVTEIKVDNESDDEFDPRADEEPRSRTVSRPDVLNITSSKTVSFDLPSPDLNTLNTEAKIIKPLTPFYTRKVSIAEAPASEDPFDTSFASNVTPGKIELRLIENELFDPNLEKRLSINDNSFNPRDEAQTKIDKVVNTIKEISKRNLQHL

SEQ ID NO: 35459 - protein, 155 aa, Diabrotica virgifera
  misc_feature: Coding regions on vcDNA: vcDNA=SeqID_15156; Strand=-; Position=388-855
  misc_feature (47)..(57): Xaa can be any naturally occurring amino acid
LSCHSQLSIIIVFRYALRGNIYETFLGFRDVSKSNKAKYIFGVLKNXXXXXXXXXXXVGQSYDDVAVMCGELNGLQTKVKTIALQALFIQYYAHIMNLVLHKCKKIKNIVFSCQFSSPKRITGLEQIFVRRDEILNLRLVLSKQIISGSFSNRFS

SEQ ID NO: 35460 - protein, 28 aa, Diabrotica virgifera
  misc_feature: Coding regions on vcDNA: vcDNA=SeqID_15157; Strand=-; Position=1-84
  misc_feature (2)..(25): Xaa can be any naturally occurring amino acid
KXXXXXXXXXXXXXXXXXXXXXXXXINY

SEQ ID NO: 35461 - protein, 144 aa, Diabrotica virgifera
  misc_feature: Coding regions on vcDNA: vcDNA=SeqID_15158; Strand=+; Position=14-448
ELSLIYLTFVSPLWPALTVAIITHVPHATELLAAMMTYALALPDLKLSMRFGLTDKPTYANMSYYPSTIYSWTPPSPHTNDSKQDAKGFCKNLTVGRRECSIRIFLSALLLLKFTLPPENVTQMSDWNKHKLLDLTGSSLLLLL

SEQ ID NO: 35462 - protein, 314 aa, Diabrotica virgifera
  misc_feature: Coding regions on vcDNA: vcDNA=SeqID_15159; Strand=+; Position=21-962
  misc_feature: Homolog annotation: Hit_ID=NP_729843.1; Match level="QueryCoverage =93%, HitCoverage=62%, E-value=3e-66, Identity=42%"; Hit description =CG10960-PC, isoform C [Drosophila melanogaster] ref|NP_729842.1| CG10960-PA, isoform A [Drosophila
  misc_feature: Gene Ontology Annotation: Molecular function=glucose transporter activity; Cellular component=integral to plasma membrane; Biological process=glucose transport
  misc_feature: Pfam annotation: Pfam_ID=Sugar_tr; Match level="Score=-100.1, E-value= 0.00071, Copies=1"; Pfam description=Sugar (and other) transporter
  misc_feature (80)..(85): Xaa can be any naturally occurring amino acid
  misc_feature (261)..(261): Xaa can be any naturally occurring amino acid
  misc_feature (285)..(285): Xaa can be any naturally occurring amino acid
  misc_feature (296)..(307): Xaa can be any naturally occurring amino acid
MRKVSLGFPSRKIKNKMADSGQAKTFPQYIAALSVCLGAVAAGAVLGWTSNISKDLQKGGLNDLVISDDQLGWIGSFVTXXXXXXCFPIGYICDLIGRKWGCLLTLIPFTVGWLLVIFSSSVSVIYVGRFLTGLAGGSFCVAAPIYTAEIAQASIRGALGSYFQLLLTVGILIVYVGGAWMHPKDLAILSAVIPIVFAVVFFFQPETPIYLMKKNRPEEAKKALQRLRGNAYDCDAELKEIQLSFEQGSSEKSFMTVLKTXAAIKACLITFSLMFFPAMSGINAXIFYTGKIFEAXXXXXXXXXXXXIVGILQR

SEQ ID NO: 35463 - protein, 245 aa, Diabrotica virgifera
  misc_feature: Coding regions on vcDNA: vcDNA=SeqID_15160; Strand=-; Position=0-734
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(238): Xaa can be any naturally occurring amino acid
  misc_feature (240)..(244): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 35464 - protein, 220 aa, Diabrotica virgifera
  misc_feature: Coding regions on vcDNA: vcDNA=SeqID_15161; Strand=-; Position=0-659
  misc_feature (1)..(90): Xaa can be any naturally occurring amino acid
  misc_feature (96)..(125): Xaa can be any naturally occurring amino acid
  misc_feature (128)..(151): Xaa can be any naturally occurring amino acid
  misc_feature (153)..(172): Xaa can be any naturally occurring amino acid
  misc_feature (178)..(215): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRRGGXXXXXXXXXXXXXXXXXXXXXXXXXXXXXXKEXXXXXXXXXXXXXXXXXXXXXXXXYXXXXXXXXXXXXXXXXXXXXYPPPTXXXXXXXXXXXXXXXXXXXXXXXXXXXXXXXXXXXXXXPFFPP

SEQ ID NO: 35465 - protein, 238 aa, Diabrotica virgifera
  misc_feature: Coding regions on vcDNA: vcDNA=SeqID_15162; Strand=-; Position=0-713
  misc_feature (1)..(237): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXA

SEQ ID NO: 35466 - protein, 261 aa, Diabrotica virgifera
  misc_feature: Coding regions on vcDNA: vcDNA=SeqID_15163; Strand=+; Position=38-820
  misc_feature: Homolog annotation: Hit_ID=XP_319685.1; Match level="QueryCoverage =88%, HitCoverage=43%, E-value=6e-44, Identity=42%"; Hit description =ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=-29.7, E-value =0.046, Copies=1"; Pfam description=Major Facilitator Superfamily
  misc_feature (21)..(27): Xaa can be any naturally occurring amino acid
  misc_feature (215)..(215): Xaa can be any naturally occurring amino acid
MTNTPTLDKPGLPRFGERHRXXXXXXXLAAVAIAMRVQLSVAIVAMNDPEASPNPSVPVYDWKNKSVILSSFFWGYIGLQLFAADWGRRYGSKRFLLGAMTINCTALALVPLLAEHFGSIGVMCSRVVQGLCQGFVYPSISNLLGRWTHISERSRLGSLTLSGAPFGTIMSLPVNGFIAASWLGWPYCFYIYSIAGYLWVIMFYFLGASTAAESXRISAAEREYIEKSTNIKGQNKLTVPWKEIVNVDILGAVFGTRWPNL

SEQ ID NO: 35467 - protein, 164 aa, Diabrotica virgifera
  misc_feature: Coding regions on vcDNA: vcDNA=SeqID_15164; Strand=+; Position=101-593
  misc_feature: Homolog annotation: Hit_ID=AAL67868.1; Match level="QueryCoverage =99%, HitCoverage=27%, E-value=3e-24, Identity=45%"; Hit description =NADH dehydrogenase subunit 5 [Crioceris duodecimpunctata] ref|NP _569067.1| NADH dehydrogenase subunit 5
  misc_feature (37)..(37): Xaa can be any naturally occurring amino acid
  misc_feature (61)..(61): Xaa can be any naturally occurring amino acid
  misc_feature (75)..(75): Xaa can be any naturally occurring amino acid
  misc_feature (84)..(84): Xaa can be any naturally occurring amino acid
  misc_feature (108)..(108): Xaa can be any naturally occurring amino acid
  misc_feature (130)..(130): Xaa can be any naturally occurring amino acid
  misc_feature (152)..(152): Xaa can be any naturally occurring amino acid
FVIFISSIVLYYSEEYIRGDISKNRLILLAVLFVFSXLTLMHKSYINFPFITLRWSYSLIXYRLAMDDPHTYSYXAGILTALSXNRIGDVAWIDTDCLNIIFWELKFXFYLDVIKNDFTIQVNHLITYLXAITKSASSSYIISAYLPHSAAXPTPASSIAPSSP

SEQ ID NO: 35468 - protein, 266 aa, Diabrotica virgifera
  misc_feature: Coding regions on vcDNA: vcDNA=SeqID_15165; Strand=+; Position=1-798
  misc_feature: Homolog annotation: Hit_ID=AAT01082.1; Match level="QueryCoverage =93%, HitCoverage=85%, E-value=6e-37, Identity=41%"; Hit description =putative mitochondrial ATP synthase gamma-subunit [Homalodisca coagulata]
  misc_feature: Pfam annotation: Pfam_ID=ATP-synt; Match level="Score=-130.9, E-value= 0.0001, Copies=1"; Pfam description=ATP synthase
  misc_feature (131)..(131): Xaa can be any naturally occurring amino acid
  misc_feature (152)..(152): Xaa can be any naturally occurring amino acid
  misc_feature (161)..(182): Xaa can be any naturally occurring amino acid
  misc_feature (224)..(224): Xaa can be any naturally occurring amino acid
PTRSVGDFAIVVPLVHQNGQQQLHTLMATLIPISIRLKSHKIIQNITMSMKMEYATNYTKLERELPVVHPISDVYNQVYDKPEIHPLPNVPLNITIDITSYGGLCAAVPPNVSPYFRTELRNNDQNIKVDXARYISRPIYQRIYVINSMVAXHEPPPLPPXXXXXXXXXXXXXXXXXXXXXXNIVNSEVSSDASYFTMTLSMVSSAAATFSPYLSVYDSLDDKXLQIYLEFSLSYLLIYSVREGACSQISPLMTAMDNASKIVDEM

SEQ ID NO: 35469 - protein, 222 aa, Diabrotica virgifera
  misc_feature: Coding regions on vcDNA: vcDNA=SeqID_15166; Strand=-; Position=0-665
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(219): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRG

SEQ ID NO: 35470 - protein, 242 aa, Diabrotica virgifera
  misc_feature: Coding regions on vcDNA: vcDNA=SeqID_15167; Strand=+; Position=3-731
  misc_feature: Homolog annotation: Hit_ID=EAL26086.1; Match level="QueryCoverage =97%, HitCoverage=42%, E-value=3e-89, Identity=69%"; Hit description =GA20931-PA [Drosophila pseudoobscura]
  misc_feature: Gene Ontology Annotation: Molecular function=glucose-6-phosphate isomerase activity; Cellular component=cytosol; Biological process =neurogenesis
  misc_feature: Pfam annotation: Pfam_ID=PGI; Match level="Score=-34.7, E-value=3.9e -11, Copies=1"; Pfam description=Phosphoglucose isomerase
  misc_feature (39)..(45): Xaa can be any naturally occurring amino acid
PKPLLTTEPSWQKLQQYYDSKGNKLVIKDLFASDPARFXXXXXXXATPNDGDILIDFSKNRIDEEGLKLLLDLARSRKVEAARDAMFNGSKINFTENRAVLHIALRNRSNRPILVDGKDVMPDVNAVLNHMKSFTEQVLSGAWKGYSGKKITDVVNIGIGGSDLGPLMVTEALKPYSKGLNLHFVSNIDGTHLAEVLKKVNPETVLFIIASKTFTTQETCTNAKSAKDWFLATAQDVRNVYM

SEQ ID NO: 35471 - protein, 23 aa, Diabrotica virgifera
  misc_feature: Coding regions on vcDNA: vcDNA=SeqID_15168; Strand=+; Position=1-69
PPPGPTPKSPPPPPPPPHQHNIS

SEQ ID NO: 35472 - protein, 24 aa, Diabrotica virgifera
  misc_feature: Coding regions on vcDNA: vcDNA=SeqID_15169; Strand=-; Position=0-71
  misc_feature (4)..(23): Xaa can be any naturally occurring amino acid
KKWXXXXXXXXXXXXXXXXXXXXP

SEQ ID NO: 35473 - protein, 279 aa, Diabrotica virgifera
  misc_feature: Coding regions on vcDNA: vcDNA=SeqID_15170; Strand=+; Position=45-881
  misc_feature: Homolog annotation: Hit_ID=NP_062648.1; Match level="QueryCoverage =100%, HitCoverage=90%, E-value=1e-157, Identity=94%"; Hit description=protein phosphatase 4, catalytic subunit [Mus musculus] ref|XP_547067.1| PREDICTED: similar to
  misc_feature: Gene Ontology Annotation: Molecular function=protein phosphatase type 2A, intrinsic catalyst activity; Cellular component=protein phosphatase type 2A complex; Biological process=R7 cell fate commitment
  misc_feature: Pfam annotation: Pfam_ID=Metallophos; Match level="Score=155.4, E -value=1.3e-43, Copies=1"; Pfam description=Calcineurin-like phosphoesterase
  misc_feature (246)..(246): Xaa can be any naturally occurring amino acid
  misc_feature (263)..(263): Xaa can be any naturally occurring amino acid
MGDTSDLDRQIDQLKRCEVIKESEVKALCAKAREILVEESNVQRVDSPVTVCGDIHGQFYDLKELFKVGGDVPETNYLFMGDFVDRGFYSVETFLLLLALKVRYPDRITLIRGNHESRQITQVYGFYDECLRKYGSITVWRYCTEIFDYLSLSAIIDGKIFCVHGGLSPSIQTLDQIRVIDRKQEVPHDGPMCDLLWSDPEDTQGWGVSPRGAGYLFGSDVVAQFNAANDIDMICRAHQLVMEGYXWHFNETVLTVWSAPNYXYRCGNVARILETDEHL

SEQ ID NO: 35474 - protein, 222 aa, Diabrotica virgifera
  misc_feature: Coding regions on vcDNA: vcDNA=SeqID_15171; Strand=-; Position=0-665
  misc_feature (1)..(6): Xaa can be any naturally occurring amino acid
  misc_feature (12)..(21): Xaa can be any naturally occurring amino acid
  misc_feature (23)..(55): Xaa can be any naturally occurring amino acid
  misc_feature (58)..(69): Xaa can be any naturally occurring amino acid
  misc_feature (75)..(83): Xaa can be any naturally occurring amino acid
  misc_feature (87)..(124): Xaa can be any naturally occurring amino acid
  misc_feature (138)..(158): Xaa can be any naturally occurring amino acid
  misc_feature (161)..(169): Xaa can be any naturally occurring amino acid
  misc_feature (188)..(195): Xaa can be any naturally occurring amino acid
  misc_feature (203)..(218): Xaa can be any naturally occurring amino acid
XXXXXXVGVWCXXXXXXXXXXHXXXXXXXXXXXXXXXXXXXXXXXXXXXXXXXXXWGXXXXXXXXXXXXRPRPRXXXXXXXXXHTPXXXXXXXXXXXXXXXXXXXXXXXXXXXXXXXXXXXXXXGCVFPSPPPTPHHXXXXXXXXXXXXXXXXXXXXXPSXXXXXXXXXAAPPPLPPLPLFLCVGHPXXXXXXXXRPHPKREXXXXXXXXXXXXXXXXARTP

SEQ ID NO: 35475 - protein, 123 aa, Diabrotica virgifera
  misc_feature: Coding regions on vcDNA: vcDNA=SeqID_15172; Strand=-; Position=2-369
  misc_feature: Homolog annotation: Hit_ID=NP_510856.1; Match level="QueryCoverage =98%, HitCoverage=14%, E-value=3e-18, Identity=40%"; Hit description =predicted CDS, reverse transcriptase family member (XS300) [Caenorhabditis elegans]
  misc_feature: Gene Ontology Annotation: Molecular function=molecular_function unknown; Cellular component=cellular_component unknown; Biological process=biological_process unknown
  misc_feature (68)..(68): Xaa can be any naturally occurring amino acid
LRIEKSVEYNKPLVLIFVDYEKVFDTISHQKMLKALMECRIDHRYINMIKYIYQNATASVKLADKKTXAFKIKRGVRQGDTISPKLFTTLLEHMFKNVNLSEKRINVNGEILSHLLRFADDIV

SEQ ID NO: 35476 - protein, 238 aa, Diabrotica virgifera
  misc_feature: Coding regions on vcDNA: vcDNA=SeqID_15173; Strand=+; Position=135-848
  misc_feature: Homolog annotation: Hit_ID=AAK97625.1; Match level="QueryCoverage =94%, HitCoverage=46%, E-value=2e-64, Identity=54%"; Hit description =kynurenine aminotransferase [Aedes aegypti]
  misc_feature: Gene Ontology Annotation: Molecular function=arylformamidase activity; Cellular component=cellular_component unknown; Biological process=nitrogen metabolism
  misc_feature (211)..(218): Xaa can be any naturally occurring amino acid
MFKVVSSSIKRFYKSPNSILKMSVRSASASCDKSNSIDQKFGLPKRYAGSKESVWTEYIQMAIDLKPLNLGQGFPDFPAPQFIMDALATVSNKSDYMLHQYTRGFGHPRLVKALAKFYSKLIGREINEKTEVITTIGAYEALNAAIMGHTEVGDEVIIIEPFYDCYEPMVKYAGGVARYIPLRLNQPADGRLPSSADFTLDKKELEGLFNXXXXXXXXNTPNNPLGKVFTERDSYCPI

SEQ ID NO: 35477 - protein, 66 aa, Diabrotica virgifera; identical to SEQ ID NO: 26808
  misc_feature: Coding regions on vcDNA: vcDNA=SeqID_15174; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35478 - protein, 307 aa, Diabrotica virgifera
  misc_feature: Coding regions on vcDNA: vcDNA=SeqID_15175; Strand=+; Position=27-946
  misc_feature: Homolog annotation: Hit_ID=XP_308573.1; Match level="QueryCoverage =100%, HitCoverage=25%, E-value=4e-67, Identity=46%"; Hit description= ENSANGP00000015955 [Anopheles gambiae]
  misc_feature: Gene Ontology Annotation: Molecular function=pre-mRNA splicing factor activity; Cellular component=spliceosome complex; Biological process =RNA splicing
  misc_feature (119)..(125): Xaa can be any naturally occurring amino acid
  misc_feature (287)..(287): Xaa can be any naturally occurring amino acid
  misc_feature (294)..(294): Xaa can be any naturally occurring amino acid
MDELQKLEYLSLVSKVCTELENHLGMNDKDLAEFIIHLSEKNGTFESFKKALIENGAEFSDSFISNLLRIIQHMKPKKNKSKVEADVYQKETLATKFPGLALPNEKQKPLFIDEEAPAXXXXXXXIVADLMKQFEADAPSNSQIQTTTKSGSASPIERKRSSRSRSRSKPRKRRKSRSRDRDSRKDKRRSRSRDQKKNRRDRSGSRNKRNKERSRSRNRRSRSRDRRSRSRDRRNRSKDRKYKNYSRDKDRRERSNSRDIKRDRSTEKKFKSEKDNPEFEDDPTPGXIYNGKVXNIVPFGCFVQLEG

SEQ ID NO: 35479 - protein, 54 aa, Diabrotica virgifera
  misc_feature: Coding regions on vcDNA: vcDNA=SeqID_15176; Strand=+; Position=208-369
TEQLNLDVTNCTVTNLHSYELSSLRVSRYELAATTCTATKCRVTRCHGTEITRY

SEQ ID NO: 35480 - protein, 182 aa, Diabrotica virgifera
  misc_feature: Coding regions on vcDNA: vcDNA=SeqID_15177; Strand=+; Position=562 -1107
  misc_feature (21)..(21): Xaa can be any naturally occurring amino acid
  misc_feature (33)..(41): Xaa can be any naturally occurring amino acid
  misc_feature (53)..(70): Xaa can be any naturally occurring amino acid
  misc_feature (73)..(100): Xaa can be any naturally occurring amino acid
  misc_feature (104)..(121): Xaa can be any naturally occurring amino acid
  misc_feature (123)..(157): Xaa can be any naturally occurring amino acid
  misc_feature (160)..(171): Xaa can be any naturally occurring amino acid
LITLDDFNDSKTQIIYDQHTXVRLGGGETTKYXXXXXXXXXPRKKPPPPPPPXXXXXXXXXXXXXXXXXXPCXXXXXXXXXXXXXXXXXXXXXXXXXXXXKIPXXXXXXXXXXXXXXXXXXGXXXXXXXXXXXXXXXXXXXXXXXXXXXXXXXXXXXPPXXXXXXXXXXXXPPPLTHHPNKR

SEQ ID NO: 35481 - protein, 30 aa, Diabrotica virgifera
  misc_feature: Coding regions on vcDNA: vcDNA=SeqID_15178; Strand=+; Position=1-90
  misc_feature (4)..(26): Xaa can be any naturally occurring amino acid
  misc_feature (28)..(28): Xaa can be any naturally occurring amino acid
YNLXXXXXXXXXXXXXXXXXXXXXXXSXFF

SEQ ID NO: 35482 - protein, 17 aa, Diabrotica virgifera
  misc_feature: Coding regions on vcDNA: vcDNA=SeqID_15179; Strand=-; Position=2-52
RIVRVVPAHLIGRVFNF

SEQ ID NO: 35483 - protein, 36 aa, Diabrotica virgifera
  misc_feature: Coding regions on vcDNA: vcDNA=SeqID_15180; Strand=-; Position=2-109
  misc_feature (4)..(10): Xaa can be any naturally occurring amino acid
  misc_feature (15)..(15): Xaa can be any naturally occurring amino acid
  misc_feature (22)..(35): Xaa can be any naturally occurring amino acid
STDXXXXXXXPIINXNPTSRSXXXXXXXXXXXXXXV

SEQ ID NO: 35484 - protein, 306 aa, Diabrotica virgifera
  misc_feature: Coding regions on vcDNA: vcDNA=SeqID_15181; Strand=+; Position=3-920
  misc_feature: Homolog annotation: Hit_ID=XP_396674.1; Match level="QueryCoverage =99%, HitCoverage=67%, E-value=5e-87, Identity=49%"; Hit description =similar to ENSANGP00000010673 [Apis mellifera]
  misc_feature: Gene Ontology Annotation: Molecular function=molecular_function unknown; Cellular component=nucleus; Biological process=transcription
  misc_feature: Pfam annotation: Pfam_ID=WD40; Match level="Score=96.2, E-value=8.7e -26, Copies=5"; Pfam description=WD domain, G-beta repeat
LVGHVEGDVSLLEVYIYNEQEESLYVHHDIMLSSFPLCLEPLNYEPKMPKGNYCAVGSMSPVIEVWDVDIMNVIEPSFTLGRPASKKKNKEHIGHTDAVLSLAWNKTFEHVLASGSVDQTIHLWDMEIKKPSTTIKSFQEKVQCLEWHPLEAQTLLGGGCDKSARVFDGRTPETHQTWLLDGEAERLCWNPLEPFTFLAGTSSGSVQCFDCRKGQLWSVKAHSKEVTGLVLSKQCQGLLITSSTDETVKIWDLATLEAEPKLVNEKEFNMGNIHCLDLCPDLPFCISVGGDKKVNNFTVFDVQNID

SEQ ID NO: 35485 - protein, 70 aa, Diabrotica virgifera
  misc_feature: Coding regions on vcDNA: vcDNA=SeqID_15182; Strand=+; Position=331-543
IRSSFRIFYGNHNISLSLSNKSTAIFMEIYPSRKTVRTIGLGRLSYIVQNDVKRYITILKYLSKTLTSMI

SEQ ID NO: 35486 - protein, 192 aa, Diabrotica virgifera
  misc_feature: Coding regions on vcDNA: vcDNA=SeqID_15183; Strand=-; Position=494 -1072
  misc_feature (5)..(11): Xaa can be any naturally occurring amino acid
  misc_feature (19)..(25): Xaa can be any naturally occurring amino acid
  misc_feature (35)..(42): Xaa can be any naturally occurring amino acid
  misc_feature (83)..(90): Xaa can be any naturally occurring amino acid
  misc_feature (115)..(121): Xaa can be any naturally occurring amino acid
  misc_feature (142)..(150): Xaa can be any naturally occurring amino acid
  misc_feature (172)..(180): Xaa can be any naturally occurring amino acid
EGGGXXXXXXXPPKKPPQXXXXXXXKGEKSRENRXXXXXXXXGKKKFPQGKNPGFSPGKRGKKTFYPARGGAPFREPPAPLNXXXXXXXXPANPFNLGNPKGGPRLYKTKGEKQXXXXXXXRPNPEGGGERGGTKLWAPFWXXXXXXXXXNPPSGGVPIAISGGQFFEKGPXXXXXXXXXGGGKRGILFNCL

SEQ ID NO: 35487 - protein, 161 aa, Diabrotica virgifera
  misc_feature: Coding regions on vcDNA: vcDNA=SeqID_15184; Strand=+; Position=89-577
  misc_feature: Homolog annotation: Hit_ID=AAW51390.1; Match level="QueryCoverage =61%, HitCoverage=66%, E-value=3e-11, Identity=37%"; Hit description =GekBS074P [Gekko japonicus]
  misc_feature (35)..(35): Xaa can be any naturally occurring amino acid
  misc_feature (50)..(50): Xaa can be any naturally occurring amino acid
KEHPLLTIVGFFHTVLGNINGDVQKIIHDPERGAXLTRITFLRDLLVTDXLELRVVADRVHPGEFLECASRAYVQSGDVLPAGPMADSTIAGKLLAGVSETYATVVADTRYAHKTIAEYFLETLTVFDLRTSACRLSLVEVAILTNHSYSHGMVTLSTNLD

SEQ ID NO: 35488 - protein, 271 aa, Diabrotica virgifera
  misc_feature: Coding regions on vcDNA: vcDNA=SeqID_15185; Strand=+; Position=121-933
  misc_feature: Homolog annotation: Hit_ID=XP_488264.1; Match level="QueryCoverage =42%, HitCoverage=59%, E-value=5e-26, Identity=44%"; Hit description =similar to hypothetical protein FLJ38281 [Mus musculus]
  misc_feature: Gene Ontology Annotation: Molecular function=protein binding; Cellular component=nucleus; Biological process=neuroblast cell fate determination
  misc_feature: Pfam annotation: Pfam_ID=zf-C2H2; Match level="Score=63.0, E-value =8.3e-16, Copies=2"; Pfam description=Zinc finger, C2H2 type
  misc_feature (226)..(233): Xaa can be any naturally occurring amino acid
  misc_feature (256)..(256): Xaa can be any naturally occurring amino acid
MELSEDSIEDKDGDGDSLVHHVNVQIKSELEECTIESNNYYTEDSLSDSYSNNIKIDEHMLQYDISNPFPVITKQEVKTEIKEELDEHNLQVNHGCNTLFNSTDTEKLDLERDVKLQIGASTEIDDEKRCRSMKTEKLLPSIEKKGVRQNEINTKCEGSLITPTRESSYKCEICLKEFTVLRYLKKHLQIHTGDKPYKCKICSKQFSRNENLKVHVRLHTGEKPYXXXXXXXXFNKSDSLKTHLIKHTGEKPLQCXICLKQFGEAKTLKNH

SEQ ID NO: 35489 - protein, 71 aa, Diabrotica virgifera
  misc_feature: Coding regions on vcDNA: vcDNA=SeqID_15186; Strand=+; Position=217-432
NNVANFVVAVLGCSNESIPLATKDDGLFCRAPIITHYYTYHCWSHRPMVETIGASNDVTISFSIREVELLM

SEQ ID NO: 35490 - protein, 128 aa, Diabrotica virgifera
  misc_feature: Coding regions on vcDNA: vcDNA=SeqID_15187; Strand=+; Position=424-810
  misc_feature: Homolog annotation: Hit_ID=NP_650423.1; Match level="QueryCoverage =85%, HitCoverage=28%, E-value=1e-23, Identity=50%"; Hit description =CG6803-PB, isoform B [Drosophila melanogaster] gb|AAF55133.2| CG6803- PB, isoform B [Drosophila
MDRLAELDKLYPSLWPSVGSRRPTPIKAGEFAPRPNEVAFNYAGQPIYTRGGLYPSKKLFDDILNPSPNLPVSAVSRDPFWWDSPLKPASVHNPWGKSPFYLRDSYLSPVKRTFLWDKHPVRPFAAVY

SEQ ID NO: 35491 - protein, 270 aa, Diabrotica virgifera
  misc_feature: Coding regions on vcDNA: vcDNA=SeqID_15188; Strand=-; Position=1-810
  misc_feature (1)..(267): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYF

SEQ ID NO: 35492 - protein, 206 aa, Diabrotica virgifera
  misc_feature: Coding regions on vcDNA: vcDNA=SeqID_15189; Strand=-; Position=0-617
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(200): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGRGEG

SEQ ID NO: 35493 - protein, 25 aa, Diabrotica virgifera
  misc_feature: Coding regions on vcDNA: vcDNA=SeqID_15190; Strand=-; Position=0-74
  misc_feature (1)..(7): Xaa can be any naturally occurring amino acid
XXXXXXXLIVDIIIYKQLNVIFNRG

SEQ ID NO: 35494 - protein, 166 aa, Diabrotica virgifera
  misc_feature: Coding regions on vcDNA: vcDNA=SeqID_15191; Strand=+; Position=135-635
  misc_feature: Homolog annotation: Hit_ID=CAG02681.1; Match level="QueryCoverage =84%, HitCoverage=85%, E-value=5e-13, Identity=29%"; Hit description =unnamed protein product [Tetraodon nigroviridis]
  misc_feature: Pfam annotation: Pfam_ID=Globin; Match level="Score=97.9, E-value =2.7e-26, Copies=1"; Pfam description=Globin
MGPIWSAFGATNTGRTDDADSTTGLTSRDRYLLKSSWAGVMKNPTDNGVALLLLMFKKFPETKTVFPFKDIPNEELANNVRFRAHCNSVVYAITSMVDAIDDPSLLVGILEKVGRDHKRRSIPQKYFEGLQETIIELFSTFMKPNEINSWNKALGVILKVVADNVK

SEQ ID NO: 35495 - protein, 263 aa, Diabrotica virgifera
  misc_feature: Coding regions on vcDNA: vcDNA=SeqID_15192; Strand=+; Position=59-848
  misc_feature: Homolog annotation: Hit_ID=XP_311362.1; Match level="QueryCoverage =91%, HitCoverage=78%, E-value=3e-67, Identity=50%"; Hit description =ENSANGP00000016734 [Anopheles gambiae]
  misc_feature: Gene Ontology Annotation: Molecular function=structural constituent of ribosome; Cellular component=mitochondrial large ribosomal subunit; Biological process=protein biosynthesis
  misc_feature: Pfam annotation: Pfam_ID=TGS; Match level="Score=6.1, E-value=0.0058, Copies=1"; Pfam description=TGS domain
  misc_feature (51)..(51): Xaa can be any naturally occurring amino acid
  misc_feature (250)..(250): Xaa can be any naturally occurring amino acid
  misc_feature (260)..(260): Xaa can be any naturally occurring amino acid
MNSLNTFSKRLQRPVFCHIKRCLSDDTKQQNDIFNMEQSRQREAVGRIEKXIEINYVGAPKNEILLMNKNVSTPYDCAKHMGDTVRNKSVVGLVNGETLWHLHKCLPGACKLELLHYHSPNPTFVNKTFWRTCSFLMGAVASQAFKDNVRVCLHSFPSPNVKSGSFVYDIQLELEDWKPTTSELKVLSIEMIKMCQQELPLECLDVSKDIAFDIFKNNPHKTKQIPSIAEHNGGKVTLFRAGTHIDISKXPMIPNTNHMXKST

SEQ ID NO: 35496 - protein, 88 aa, Diabrotica virgifera
  misc_feature: Coding regions on vcDNA: vcDNA=SeqID_15193; Strand=-; Position=578-844
KIMNTGWFIPFASVSARKTTRHSKKNSSQKYTEPLIIQSKNNVNYTGCSKKEWYIKVISLPMECPISDDTIELTPKNKLHFHKCSPYT

SEQ ID NO: 35497 - protein, 272 aa, Diabrotica virgifera
  misc_feature: Coding regions on vcDNA: vcDNA=SeqID_15194; Strand=+; Position=108-924
  misc_feature: Homolog annotation: Hit_ID=EAL28850.1; Match level="QueryCoverage =96%, HitCoverage=69%, E-value=6e-87, Identity=55%"; Hit description =GA18817-PA [Drosophila pseudoobscura]
  misc_feature: Gene Ontology Annotation: Molecular function=GTPase activator activity; Cellular component=microtubule associated complex; Biological process=gametogenesis
  misc_feature: Pfam annotation: Pfam_ID=TBC; Match level="Score=96.6, E-value=6.4e -26, Copies=1"; Pfam description=TBC domain
  misc_feature (241)..(241): Xaa can be any naturally occurring amino acid
MIAFPANMTSADTISVCSEASTLIDGSVISTVPDRHGFLGGAQYSPEPRNGPPAETVLRRERKWLKMLSQWSFYMDSNYRKVKERCRKGIPQSMRPRAWLYLCGGKVLLEKQPDKYEECLRAEADPKCIDDIKKDIHRQFPLHEMFSSEDKPGQQELFNVLKAYTVHFPDIGYCQAQAPVAAFLLMHMPSIQAFWCLVSISNKYLEDYYSPSMDVVKRDGLILEGLLKKVCPPVYRHLKKXTQPMFYCTEWFLCAFTRTLPWDTLLRVWDVF

SEQ ID NO: 35498 - protein, 36 aa, Diabrotica virgifera
  misc_feature: Coding regions on vcDNA: vcDNA=SeqID_15195; Strand=-; Position=1-108
  misc_feature (3)..(31): Xaa can be any naturally occurring amino acid
  misc_feature (35)..(35): Xaa can be any naturally occurring amino acid
KNXXXXXXXXXXXXXXXXXXXXXXXXXXXXXLYNXI

SEQ ID NO: 35499 - protein, 33 aa, Diabrotica virgifera
  misc_feature: Coding regions on vcDNA: vcDNA=SeqID_15196; Strand=-; Position=2-100
  misc_feature (2)..(14): Xaa can be any naturally occurring amino acid
  misc_feature (18)..(33): Xaa can be any naturally occurring amino acid
IXXXXXXXXXXXXXAKKXXXXXXXXXXXXXXXX

SEQ ID NO: 35500 - protein, 29 aa, Diabrotica virgifera
  misc_feature: Coding regions on vcDNA: vcDNA=SeqID_15197; Strand=-; Position=1-87
YFAKRCIHLPLYHFQQSIKIPLTRTRGKS

SEQ ID NO: 35501 - protein, 70 aa, Diabrotica virgifera
  misc_feature: Coding regions on vcDNA: vcDNA=SeqID_15198; Strand=-; Position=2-211
  misc_feature (4)..(10): Xaa can be any naturally occurring amino acid
  misc_feature (31)..(39): Xaa can be any naturally occurring amino acid
  misc_feature (42)..(42): Xaa can be any naturally occurring amino acid
  misc_feature (45)..(51): Xaa can be any naturally occurring amino acid
  misc_feature (60)..(62): Xaa can be any naturally occurring amino acid
  misc_feature (65)..(66): Xaa can be any naturally occurring amino acid
NYPXXXXXXXHYIKTITSHSPLPNLLSSITXXXXXXXXXYIXLFXXXXXXXTLTQRGYPXXXNLXXAFGG

SEQ ID NO: 35502 - protein, 203 aa, Diabrotica virgifera
  misc_feature: Coding regions on vcDNA: vcDNA=SeqID_15199; Strand=+; Position=145-755
  misc_feature: Homolog annotation: Hit_ID=AAB06239.1; Match level="QueryCoverage =99%, HitCoverage=30%, E-value=3e-46, Identity=52%"; Hit description =HSC70
  misc_feature: Gene Ontology Annotation: Molecular function=protein binding; Biological process=reproduction
  misc_feature (23)..(23): Xaa can be any naturally occurring amino acid
  misc_feature (60)..(64): Xaa can be any naturally occurring amino acid
  misc_feature (92)..(92): Xaa can be any naturally occurring amino acid
  misc_feature (111)..(111): Xaa can be any naturally occurring amino acid
  misc_feature (113)..(113): Xaa can be any naturally occurring amino acid
  misc_feature (130)..(131): Xaa can be any naturally occurring amino acid
  misc_feature (161)..(161): Xaa can be any naturally occurring amino acid
  misc_feature (167)..(167): Xaa can be any naturally occurring amino acid
  misc_feature (176)..(176): Xaa can be any naturally occurring amino acid
  misc_feature (195)..(195): Xaa can be any naturally occurring amino acid
EEIIANDLRIRTSPTYEYFTNSXILSYMQSISIYFMNPNNTIIDAKQRIEHHYDDSADQXXXXXWPFENTNDACTPENKEAYYVDYKSFYPXPTDSMDRTKMNDTAKAYLXKXVSIAVFTEPAYDNDSRXXATIDAGTIAGLQLLRIINKPTPDAIAYDLXLKGSRXRNVLIFNLXVGTIDVSILPIEYDIIEYXSSAADTHL

SEQ ID NO: 35503 - protein, 76 aa, Diabrotica virgifera
  misc_feature: Coding regions on vcDNA: vcDNA=SeqID_15200; Strand=+; Position=325-552
QDNWSYGFFELCHFSSERAIYVFLIIFDVHRRNQDNPKGWGGYNYWKGWGYNYWKVSEGYGVKRIELKVHPWGGGG

SEQ ID NO: 35504 - protein, 72 aa, Diabrotica virgifera
  misc_feature: Coding regions on vcDNA: vcDNA=SeqID_15201; Strand=+; Position=345-563
TTFKDEPKNKILFALYLSNKFMSHICHILESVIIYFYIPLLLFFINFLSEYKFKLFQFLNDDNISIALLDIQ

SEQ ID NO: 35505 - protein, 155 aa, Diabrotica virgifera
  misc_feature: Coding regions on vcDNA: vcDNA=SeqID_15202; Strand=-; Position=3-467
  misc_feature: Homolog annotation: Hit_ID=XP_314392.1; Match level="QueryCoverage =90%, HitCoverage=17%, E-value=7e-09, Identity=28%"; Hit description =ENSANGP00000000488 [Anopheles gambiae]
TKSYYFVLAYRLLHTTFVSRIQSHFSIVWSPSYFNHIYTLEKIQNKFLRICAYRLNLKNMSSVELRSRLNISSLEDYRTKCDLIFLYKLLDHTTDCFDLLSLVNFRCSTRILRDMPIFSIKHYHTNYGKFSPINRIQTLGNDFSQSYYLVDTRSV

SEQ ID NO: 35506 - protein, 130 aa, Diabrotica virgifera
  misc_feature: Coding regions on vcDNA: vcDNA=SeqID_15203; Strand=+; Position=1-393
  misc_feature (5)..(14): Xaa can be any naturally occurring amino acid
  misc_feature (16)..(52): Xaa can be any naturally occurring amino acid
  misc_feature (57)..(63): Xaa can be any naturally occurring amino acid
  misc_feature (69)..(75): Xaa can be any naturally occurring amino acid
  misc_feature (79)..(89): Xaa can be any naturally occurring amino acid
  misc_feature (94)..(102): Xaa can be any naturally occurring amino acid
ERLFXXXXXXXXXXEXXXXXXXXXXXXXXXXXXXXXXXXXXXXXXXXXXXXXNTHYXXXXXXXRTCYYXXXXXXXIILXXXXXXXXXXXLYIKXXXXXXXXXLEDLETIYRCICGIRQHYFLPHITNMSF

SEQ ID NO: 35507 - protein, 262 aa, Diabrotica virgifera
  misc_feature: Coding regions on vcDNA: vcDNA=SeqID_15204; Strand=+; Position=88-876
  misc_feature: Homolog annotation: Hit_ID=NP_477321.1; Match level="QueryCoverage =96%, HitCoverage=34%, E-value=8e-44, Identity=39%"; Hit description =CG2864-PA [Drosophila melanogaster] gb|AAF45886.1| CG2864-PA [Drosophila melanogaster]
  misc_feature: Gene Ontology Annotation: Molecular function=poly(ADP-ribose) glycohydrolase activity; Cellular component=cytoplasm
  misc_feature (11)..(17): Xaa can be any naturally occurring amino acid
  misc_feature (252)..(252): Xaa can be any naturally occurring amino acid
LLLISKTMAQXXXXXXXGSSLSQICNNKEVWSFNVCPVTVSKNHAVLFRLPVTLKDAPEPYKNSEPHYWDNDHVRMPYSEKSLFPVEEDGVEVVKLRWNLIEESLLRPIRSSLELEAAIRTYNSSLPEFTALHSYFEQLEEEESDGFFKELLPKMISLALNLPQILPGNLPLLTQNHNKSVSLSQLQIASLLANAFFCTFPWRKSTANTYPGVNFITLFRADRRPNRLFCIYEKFKCMFNYFRMVTSSVPVXVVTFERKVCP

SEQ ID NO: 35508 - protein, 180 aa, Diabrotica virgifera
  misc_feature: Coding regions on vcDNA: vcDNA=SeqID_15205; Strand=-; Position=78-617
  misc_feature: Homolog annotation: Hit_ID=AAR09836.1; Match level="QueryCoverage =82%, HitCoverage=55%, E-value=1e-13, Identity=33%"; Hit description =similar to Drosophila melanogaster sop [Drosophila yakuba]
  misc_feature: Gene Ontology Annotation: Molecular function=structural constituent of ribosome; Cellular component=cytosolic small ribosomal subunit (sensu Eukarya); Biological process=protein biosynthesis
  misc_feature (61)..(78): Xaa can be any naturally occurring amino acid
  misc_feature (88)..(94): Xaa can be any naturally occurring amino acid
  misc_feature (101)..(107): Xaa can be any naturally occurring amino acid
  misc_feature (109)..(127): Xaa can be any naturally occurring amino acid
  misc_feature (154)..(171): Xaa can be any naturally occurring amino acid
PPKFENLGPFLGSALKDGGLKIIPFPKQTRGGQGPRFKGFFSPGENKGPPGFGVKTPQGVXXXXXXXXXXXXXXXXXXRRGFWGSQIXXXXXXXSKGFGKXXXXXXXFXXXXXXXXXXXXXXXXXXXPRGGFEDFSPPPWGSPGSFGNFSQNPXXXXXXXXXXXXXXXXXXMLGGTVLIP

SEQ ID NO: 35509 - protein, 107 aa, Diabrotica virgifera
  misc_feature: Coding regions on vcDNA: vcDNA=SeqID_15206; Strand=+; Position=11-334
EYLSYPFHHIIPSSLLETYYGVMPIDAASTLSISCTLRSWIINSNNIFILFQRQKAIKAVVLFRNKYFNSLFCNDPLTVFKHVSGLSINPPNASIPYLYITHQVYMH

SEQ ID NO: 35510 - protein, 217 aa, Diabrotica virgifera
  misc_feature: Coding regions on vcDNA: vcDNA=SeqID_15207; Strand=+; Position=1-654
KLIEEVKRYPELYDSSQRNFKNKVLKAALWKDIAFKMRKQTDEYSIKTVRMRWKSLRDSYVKEIKYKMAVSSGHILKPRKNWRYSNCMTFLAPFLAISFPNTSKIKDESCEIKEEVSDQSEPTDPTYFLNVSSGPEENYGHFLSALLDYSNNHNSTVFKTDDGDIDSFFKGVADTVKKLSAVNQVFIQRSVVNMVLDIKLREAHEKANILRESGDND

SEQ ID NO: 35511 - protein, 56 aa, Diabrotica virgifera
  misc_feature: Coding regions on vcDNA: vcDNA=SeqID_15208; Strand=-; Position=258-428
IEMQFLSRYSFCSRWGRDGGSVRGFSVGYPYGVEVGYKAMATIGMVTLRGISHLLW

SEQ ID NO: 35512 - protein, 166 aa, Diabrotica virgifera
  misc_feature: Coding regions on vcDNA: vcDNA=SeqID_15209; Strand=+; Position=2-502
  misc_feature (105)..(115): Xaa can be any naturally occurring amino acid
NYWLETRGIQFTRFICLIAESQCSVTLNDEDLQLFSQCNIQFEAIKRSNLLKSICIGVGATAAVIIILSFLIFLYCRKNRKHKNKQTKTLESIGDDSPLRRKTVXXXXXXXXXXXGLVQTQRIPRYFELMFILIRADRVTRIPLGYPLEYPHGYKYSTRNHEHRIK

SEQ ID NO: 35513 - protein, 86 aa, Diabrotica virgifera
  misc_feature: Coding regions on vcDNA: vcDNA=SeqID_15210; Strand=-; Position=193-453
  misc_feature (27)..(38): Xaa can be any naturally occurring amino acid
NNCTLEKELFIIHTKFLLFNRTQYKKXXXXXXXXXXXXILKTKRISDSGNQTRASWVKARYPTTPYWMLGMDINTWHISYSATVLK

SEQ ID NO: 35514 - protein, 70 aa, Diabrotica virgifera
  misc_feature: Coding regions on vcDNA: vcDNA=SeqID_15211; Strand=+; Position=173-385
IEEHWRQYTTCLTPFLIEKSCFVESLKAYCCCLVLTQIGDHSYVLGIRSQFFLGTYFIISSCFSLSNAFL

SEQ ID NO: 35515 - protein, 172 aa, Diabrotica virgifera
  misc_feature: Coding regions on vcDNA: vcDNA=SeqID_15212; Strand=+; Position=11-526
  misc_feature: Homolog annotation: Hit_ID=AAF87760.1; Match level="QueryCoverage =100%, HitCoverage=39%, E-value=2e-56, Identity=68%"; Hit description= cytochrome oxidase subunit I [Diabrotica virgifera zeae]
  misc_feature (3)..(9): Xaa can be any naturally occurring amino acid
  misc_feature (36)..(42): Xaa can be any naturally occurring amino acid
  misc_feature (56)..(56): Xaa can be any naturally occurring amino acid
  misc_feature (64)..(80): Xaa can be any naturally occurring amino acid
  misc_feature (110)..(110): Xaa can be any naturally occurring amino acid
  misc_feature (126)..(133): Xaa can be any naturally occurring amino acid
  misc_feature (154)..(154): Xaa can be any naturally occurring amino acid
ALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 35516 - protein, 58 aa, Diabrotica virgifera
  misc_feature: Coding regions on vcDNA: vcDNA=SeqID_15213; Strand=+; Position=2-175
  misc_feature (2)..(25): Xaa can be any naturally occurring amino acid
  misc_feature (35)..(56): Xaa can be any naturally occurring amino acid
TXXXXXXXXXXXXXXXXXXXXXXXXSHLIYKLFSXXXXXXXXXXXXXXXXXXXXXXFF

SEQ ID NO: 35517 - protein, 191 aa, Diabrotica virgifera
  misc_feature: Coding regions on vcDNA: vcDNA=SeqID_15214; Strand=-; Position=390-965
  misc_feature: Homolog annotation: Hit_ID=XP_395580.1; Match level="QueryCoverage =93%, HitCoverage=24%, E-value=1e-29, Identity=38%"; Hit description =similar to CG8830-PA [Apis mellifera]
  misc_feature: Gene Ontology Annotation: Biological process=protein modification
  misc_feature: Pfam annotation: Pfam_ID=UCH; Match level="Score=-36.3, E-value =0.0033, Copies=1"; Pfam description=Ubiquitin carboxyl-terminal hydrolase
  misc_feature (36)..(36): Xaa can be any naturally occurring amino acid
  misc_feature (52)..(61): Xaa can be any naturally occurring amino acid
QYHCDICSRLTDVKNYTNCEAPPRLIFTLKHFRYDXTSHQRTKLLQTVVLDXXXXXXXXXXELYAAVVHCGSSVDSGHYYTLAKDKAQWYKFNDSFVSRATTDDLKRLKPPETAYILFYSREDIKEPENLPPTILPTSLQIVLTKDQSEFEAEKNQQTGKSFNFRHNRNDEPPPPNCGGGGFSTSGNMLVC

SEQ ID NO: 35518 - protein, 65 aa, Diabrotica virgifera
  misc_feature: Coding regions on vcDNA: vcDNA=SeqID_15215; Strand=-; Position=225-422
HLSMFIGENPVLSPCSNTCDSRYSWLSYHHNLLIRLAMARYTYCSEGFHAACCNLVAGNRTSLTA

SEQ ID NO: 35519 - protein, 153 aa, Diabrotica virgifera
  misc_feature: Coding regions on vcDNA: vcDNA=SeqID_15216; Strand=+; Position=417-878
  misc_feature: Homolog annotation: Hit_ID=NP_788564.1; Match level="QueryCoverage =80%, HitCoverage=15%, E-value=4e-18, Identity=43%"; Hit description =CG11489-PC, isoform C [Drosophila melanogaster] gb|AAF51818.3| CG11489-PC, isoform C [Drosophila
  misc_feature: Gene Ontology Annotation: Molecular function=ATP binding; Cellular component=cellular_component unknown; Biological process=protein amino acid phosphorylation
  misc_feature (130)..(130): Xaa can be any naturally occurring amino acid
MYTFKSPIENLASCHNEYDLKGRFKYRLNYKDRTDFLSLSLSPPGSRNNFTFREFPSLSPSKDTSLLDLDDIQKIRYIENRESQEDEKDYNTGGYMPINIGDILKGQYKVCRKLGWGHFSTVWLCQNLLXDGPTYVALKICKSAQMFTVVAQE

SEQ ID NO: 35520 - protein, 20 aa, Diabrotica virgifera
  misc_feature: Coding regions on vcDNA: vcDNA=SeqID_15217; Strand=-; Position=1-60
  misc_feature (4)..(20): Xaa can be any naturally occurring amino acid
NKLXXXXXXXXXXXXXXXXX

SEQ ID NO: 35521 - protein, 45 aa, Diabrotica virgifera
  misc_feature: Coding regions on vcDNA: vcDNA=SeqID_15218; Strand=-; Position=0-134
  misc_feature (2)..(43): Xaa can be any naturally occurring amino acid
KXXXXXXXXXXXXXXXXXXXXXXXXXXXXXXXXXXXXXXXXXXLS

SEQ ID NO: 35522 - protein, 96 aa, Diabrotica virgifera
  misc_feature: Coding regions on vcDNA: vcDNA=SeqID_15219; Strand=-; Position=1-288
  misc_feature (1)..(7): Xaa can be any naturally occurring amino acid
  misc_feature (10)..(96): Xaa can be any naturally occurring amino acid
XXXXXXXKLXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35523 - protein, 181 aa, Diabrotica virgifera
  misc_feature: Coding regions on vcDNA: vcDNA=SeqID_15220; Strand=+; Position=138-681
  misc_feature: Homolog annotation: Hit_ID=NP_499809.1; Match level="QueryCoverage =97%, HitCoverage=47%, E-value=2e-34, Identity=46%"; Hit description =actin (41.9 kD) (act-5) [Caenorhabditis elegans] emb|CAB05817.1| Hypothetical protein
  misc_feature: Gene Ontology Annotation: Biological process=embryogenesis and morphogenesis
  misc_feature (37)..(37): Xaa can be any naturally occurring amino acid
  misc_feature (44)..(44): Xaa can be any naturally occurring amino acid
  misc_feature (90)..(90): Xaa can be any naturally occurring amino acid
  misc_feature (100)..(100): Xaa can be any naturally occurring amino acid
  misc_feature (118)..(118): Xaa can be any naturally occurring amino acid
  misc_feature (132)..(132): Xaa can be any naturally occurring amino acid
  misc_feature (153)..(153): Xaa can be any naturally occurring amino acid
  misc_feature (158)..(158): Xaa can be any naturally occurring amino acid
HTPKYAFPSIPHHPKPTGDVHDMPKKESYVGEEDLTXKGSLSLXYPIDPLIFANCDDKYKICHHTFYPELHEAPKKQPHLHTEYPLNPNXPIYKITQIMXEPLCSTPMHAYYQNELSXYSSDLTTAIVLDTXNSATHSTPINKRNDLPPSIHXMVLVXRDYTNYHIRIRTETSYTITTTTY

SEQ ID NO: 35524 - protein, 95 aa, Diabrotica virgifera
  misc_feature: Coding regions on vcDNA: vcDNA=SeqID_15221; Strand=+; Position=658-942
SVLFHLILLLLLSVYSVLRWLPRPNRHFSLFNHRPGGISLSSSSFSIPSLQFLLGSPLFLLLCGVHAKNLFCILSSGILCTWPSNLTSIKTFDND

SEQ ID NO: 35525 - protein, 129 aa, Diabrotica virgifera
  misc_feature: Coding regions on vcDNA: vcDNA=SeqID_15222; Strand=+; Position=402-920
  misc_feature: Homolog annotation: Hit_ID=XP_393529.1; Match level="QueryCoverage =89%, HitCoverage=30%, E-value=1e-39, Identity=67%"; Hit description =similar to ENSANGP00000020224 [Apis mellifera]
  misc_feature: Gene Ontology Annotation: Molecular function=ornithine decarboxylase activity; Cellular component=cellular_component unknown; Biological process=pantothenate biosynthesis
  misc_feature (72)..(72): Xaa can be any naturally occurring amino acid
  misc_feature (86)..(86): Xaa can be any naturally occurring amino acid
  misc_feature (90)..(90): Xaa can be any naturally occurring amino acid
  misc_feature (107)..(107): Xaa can be any naturally occurring amino acid
  misc_feature (120)..(120): Xaa can be any naturally occurring amino acid
VTPTLINLCESEPSVEERIHVLDDQSNVWTVIREIVSNNNQEDAFYVLDVGDIVRKHQEWREKLPRVTPHYXAVKCNDSLTVLETXHALXTNFDCASKGEINKVLSXGVEPERIIFCNPXKPSSHIRHA

SEQ ID NO: 35526 - protein, 32 aa, Diabrotica virgifera
  misc_feature: Coding regions on vcDNA: vcDNA=SeqID_15223; Strand=-; Position=2-97
  misc_feature (8)..(15): Xaa can be any naturally occurring amino acid
  misc_feature (19)..(32): Xaa can be any naturally occurring amino acid
NFPFFPLXXXXXXXXKKWXXXXXXXXXXXXXX

SEQ ID NO: 35527 - protein, 44 aa, Diabrotica virgifera
  misc_feature: Coding regions on vcDNA: vcDNA=SeqID_15224; Strand=+; Position=3-137
  misc_feature (2)..(22): Xaa can be any naturally occurring amino acid
LXXXXXXXXXXXXXXXXXXXXXEIQTSLFLKSTNIFDITKYDGF

SEQ ID NO: 35528 - protein, 250 aa, Diabrotica virgifera
  misc_feature: Coding regions on vcDNA: vcDNA=SeqID_15225; Strand=-; Position=1-750
  misc_feature (14)..(26): Xaa can be any naturally occurring amino acid
  misc_feature (28)..(38): Xaa can be any naturally occurring amino acid
  misc_feature (48)..(56): Xaa can be any naturally occurring amino acid
  misc_feature (58)..(71): Xaa can be any naturally occurring amino acid
  misc_feature (78)..(90): Xaa can be any naturally occurring amino acid
  misc_feature (92)..(248): Xaa can be any naturally occurring amino acid
ISLERRIADRILNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEK

SEQ ID NO: 35529 - protein, 102 aa, Diabrotica virgifera
  misc_feature: Coding regions on vcDNA: vcDNA=SeqID_15226; Strand=+; Position=218-526
VNTRDYYIWIHCIACVAHLDLRRELQVPLDHPDLHLNLTELHSYLDPEDHVPLYLLWCTKPDRMVHVHHTDPLDLRDGKTLPNLVLRDPLPIIILLLLHFNL

SEQ ID NO: 35530 - protein, 247 aa, Diabrotica virgifera
  misc_feature: Coding regions on vcDNA: vcDNA=SeqID_15227; Strand=-; Position=2-742
  misc_feature (1)..(16): Xaa can be any naturally occurring amino acid
  misc_feature (31)..(43): Xaa can be any naturally occurring amino acid
  misc_feature (46)..(56): Xaa can be any naturally occurring amino acid
  misc_feature (66)..(73): Xaa can be any naturally occurring amino acid
  misc_feature (76)..(89): Xaa can be any naturally occurring amino acid
  misc_feature (95)..(108): Xaa can be any naturally occurring amino acid
  misc_feature (110)..(241): Xaa can be any naturally occurring amino acid
  misc_feature (243)..(243): Xaa can be any naturally occurring amino acid
XXXXXXXXXXXXXXXXRSCLFLSYFWSFFSXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXASGE

SEQ ID NO: 35531 - protein, 66 aa, Diabrotica virgifera; identical to SEQ ID NO: 26808
  misc_feature: Coding regions on vcDNA: vcDNA=SeqID_15228; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35532 - protein, 180 aa, Diabrotica virgifera
  misc_feature: Coding regions on vcDNA: vcDNA=SeqID_15229; Strand=+; Position=1-540
  misc_feature: Homolog annotation: Hit_ID=XP_312645.1; Match level="QueryCoverage =94%, HitCoverage=40%, E-value=5e-17, Identity=27%"; Hit description =ENSANGP00000001322 [Anopheles gambiae]
  misc_feature: Pfam annotation: Pfam_ID=ig; Match level="Score=36.9, E-value=5.9e -08, Copies=1"; Pfam description=Immunoglobulin domain
HKGNERLELHGETIQIPNVTPENGGIYRCLADNGLKEPSHKHIAINIEHAPKISISKYLVTSNKERDAELVCTVDAYPDAMVFWKKGDQIMKNDETRKVMTKRRQHTIESIFVITNLTDDDFGTYTCVGKNRNGKKEEKVSLVKTPAVRDFIKPVNVSKDVLLSWKVESKSPISAHEIQY

SEQ ID NO: 35533 - protein, 240 aa, Diabrotica virgifera
  misc_feature: Coding regions on vcDNA: vcDNA=SeqID_15230; Strand=-; Position=59-916
  misc_feature: Homolog annotation: Hit_ID=AAF87760.1; Match level="QueryCoverage =100%, HitCoverage=66%, E-value=1e-103, Identity=70%"; Hit description=cytochrome oxidase subunit I [Diabrotica virgifera zeae]
  misc_feature: Pfam annotation: Pfam_ID=COX1; Match level="Score=47.1, E-value=8e -13, Copies=1"; Pfam description=Cytochrome C and Quinol oxidase polyp
  misc_feature (6)..(6): Xaa can be any naturally occurring amino acid
  misc_feature (33)..(39): Xaa can be any naturally occurring amino acid
  misc_feature (88)..(88): Xaa can be any naturally occurring amino acid
  misc_feature (123)..(123): Xaa can be any naturally occurring amino acid
  misc_feature (181)..(181): Xaa can be any naturally occurring amino acid
  misc_feature (205)..(205): Xaa can be any naturally occurring amino acid
VLAGAXTILLTDRNLNTSFFDPAGGGDPILYQXXXXXXXHPEVYILILPGFGLISHIVRQERRKKEAFGTLGIIYAIIAIGLLGFIVXAHHIFTVGMDVDTRAYFTSATIIIAVPTGIKVFRXLATYHGTTITYIGGLTGVVLANSSIDIVLHDTYYVVAHFHYVLSIGAVFAIIAGFIQXFPLFTGLIGIPRRYSDYPDVFILXNIVSSIGSLISLIGVEAFSFQRKRLRPLRITSSIE

SEQ ID NO: 35534 - protein, 58 aa, Diabrotica virgifera
  misc_feature: Coding regions on vcDNA: vcDNA=SeqID_15231; Strand=-; Position=1-174
  misc_feature (4)..(55): Xaa can be any naturally occurring amino acid
  misc_feature (57)..(57): Xaa can be any naturally occurring amino acid
KKFXXXXXXXXXXXXXXXXXXXXXXXXXXXXXXXXXXXXXXXXXXXXXXXXXXXXKXI

SEQ ID NO: 35535 - protein, 115 aa, Diabrotica virgifera
  misc_feature: Coding regions on vcDNA: vcDNA=SeqID_15232; Strand=+; Position=146-493
RNEATEMDALRRASRTSKLDWVRNEEVKRRMSLQETVVECIEKKQLTWYGHVQRMREERLPKKIMKWIPTENRKRGRPRTIQGVRRSMSVRGLEDENCNDRRYWQQGIGQRRRTF

SEQ ID NO: 35536 - protein, 80 aa, Diabrotica virgifera
  misc_feature: Coding regions on vcDNA: vcDNA=SeqID_15233; Strand=+; Position=573-815
  misc_feature (10)..(22): Xaa can be any naturally occurring amino acid
AKTVEGRRGXXXXXXXXXXXXXFRANLRGSISQLLLAKFSPNFIRKDPNATSHIHLKTDPSWSKMIFHYFKLFLIYTYFI

SEQ ID NO: 35537 - protein, 67 aa, Diabrotica virgifera
  misc_feature: Coding regions on vcDNA: vcDNA=SeqID_15234; Strand=-; Position=632-835
SYMVFSFHNSSRLSEDHGLIFPFIKVLPFNIDLFKFLFPCWICRLFPLTPLRILFLLMTSTVLYLKI

SEQ ID NO: 35538 - protein, 249 aa, Diabrotica virgifera
  misc_feature: Coding regions on vcDNA: vcDNA=SeqID_15235; Strand=-; Position=1-747
  misc_feature (5)..(14): Xaa can be any naturally occurring amino acid
  misc_feature (19)..(85): Xaa can be any naturally occurring amino acid
  misc_feature (88)..(110): Xaa can be any naturally occurring amino acid
  misc_feature (113)..(249): Xaa can be any naturally occurring amino acid
SVFLXXXXXXXXXXQNIMXXXXXXXXXXXXXXXXXXXXXXXXXXXXXXXXXXXXXXXXXXXXXXXXXXXXXXXXXXXXXXXXXXXNNXXXXXXXXXXXXXXXXXXXXXXXYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35539 - protein, 143 aa, Diabrotica virgifera
  misc_feature: Coding regions on vcDNA: vcDNA=SeqID_15236; Strand=-; Position=3-431
  misc_feature (6)..(12): Xaa can be any naturally occurring amino acid
  misc_feature (21)..(27): Xaa can be any naturally occurring amino acid
  misc_feature (39)..(60): Xaa can be any naturally occurring amino acid
  misc_feature (64)..(142): Xaa can be any naturally occurring amino acid
ITTYKXXXXXXXTLFHTSFLXXXXXXXNNKRIISSSYLXXXXXXXXXXXXXXXXXXXXXXFISXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 35540 - protein, 212 aa, Diabrotica virgifera
  misc_feature: Coding regions on vcDNA: vcDNA=SeqID_15237; Strand=+; Position=1-636
  misc_feature: Homolog annotation: Hit_ID=AAH43903.1; Match level="QueryCoverage =83%, HitCoverage=49%, E-value=1e-20, Identity=36%"; Hit description =Nap1l1-prov protein [Xenopus laevis]
  misc_feature: Gene Ontology Annotation: Molecular function=chaperone activity; Cellular component=chromatin assembly complex; Biological process =nucleosome assembly
  misc_feature: Pfam annotation: Pfam_ID=NAP; Match level="Score=-126.8, E-value =0.0098, Copies=1"; Pfam description=Nucleosome assembly protein (NAP)
PSQAAGRSAGKEATLSAKQKSNTATENEQGDRPDETEAAQEEEDEGPKQRDTPNDQAAHHRQRKAARRAHPPTPAKRRRKARKRSQTETTKREAKSPKEGHNPERKNHKEDQPPDEKKKTKDSGQDEPTEEETQRAADEEAETPQATKEKKKQDEAKKETRTPDKKGRPDFWLPIFRNVGLLADKSQPPDVPILEHLNDISIICQKGYNEIH

SEQ ID NO: 35541 - protein, 63 aa, Diabrotica virgifera
  misc_feature: Coding regions on vcDNA: vcDNA=SeqID_15238; Strand=+; Position=3-191
  misc_feature: Homolog annotation: Hit_ID=YP_054532.1; Match level="QueryCoverage =98%, HitCoverage=12%, E-value=1e-09, Identity=53%"; Hit description =cytochrome c oxidase subunit I [Thermobia domestica] gb|AAT69281.1| cytochrome c oxidase subunit
  misc_feature (6)..(14): Xaa can be any naturally occurring amino acid
  misc_feature (35)..(42): Xaa can be any naturally occurring amino acid
  misc_feature (51)..(58): Xaa can be any naturally occurring amino acid
HKDIGXXXXXXXXXAGMVGTSLRILVRAELGRPGXXXXXXXXYNVIVTAHXXXXXXXXVIPIY

SEQ ID NO: 35542 - protein, 152 aa, Diabrotica virgifera
  misc_feature: Coding regions on vcDNA: vcDNA=SeqID_15239; Strand=+; Position=122-580
  misc_feature: Homolog annotation: Hit_ID=AAP33157.1; Match level="QueryCoverage =92%, HitCoverage=75%, E-value=4e-63, Identity=85%"; Hit description =beta-NAC-like protein [Reticulitermes flavipes]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=NAC; Match level="Score=104.6, E-value=2.5e -28, Copies=1"; Pfam description=NAC domain
MNSSQVRIGGKGTPRRKKKVVHSTQATDDKKLQSSLKKLSVNTIPGIEEVNMIKEDGTVIHFNNPKTQASLAANTFAITGHGENKQITDMLPGILSQLGPEGITQLKRLANTVANAGGVGKIVPEDEEDVPDLVENFDEASKGEVTKEEEEE

SEQ ID NO: 35543 - protein, 48 aa, Diabrotica virgifera
  misc_feature: Coding regions on vcDNA: vcDNA=SeqID_15240; Strand=+; Position=245-388
LKAHNMELLILMTNKPRDLHLIEFVFHHAVTIPIYPIYASKIFMIFLI

SEQ ID NO: 35544 - protein, 245 aa, Diabrotica virgifera
  misc_feature: Coding regions on vcDNA: vcDNA=SeqID_15241; Strand=+; Position=215-950
  misc_feature: Homolog annotation: Hit_ID=CAG30948.1; Match level="QueryCoverage =93%, HitCoverage=25%, E-value=2e-20, Identity=27%"; Hit description =hypothetical protein [Gallus gallus]
  misc_feature (15)..(15): Xaa can be any naturally occurring amino acid
QKNLSGASKKINKGXLLQKTHEERRKRQEQRLKLQSAELLQSHIRSYIVRKHKKDQERQLFDVIENTAGIQVVLSKLLFFYYPKEDRERLLRIAERLLNIQADMIQQINADKSFAWLIKRFLLLCLKNIQDNQDSMVLMKCLYIFTVDGHTFSYLVSKDYYGHLKRLLESSNNYLQETIVLIKPFKFMHESDYLSNLVLSEFCTNFLIPSLTHNVKHVLVPYIRNQPKEFPFGKIIRYLNTGFHF

SEQ ID NO: 35545 - protein, 62 aa, Diabrotica virgifera
  misc_feature: Coding regions on vcDNA: vcDNA=SeqID_15242; Strand=-; Position=1-186
  misc_feature (1)..(61): Xaa can be any naturally occurring amino acid
XXXXXXXXXXXXXXXXXXXXXXXXXXXXXXXXXXXXXXXXXXXXXXXXXXXXXXXXXXXXXF

SEQ ID NO: 35546 - protein, 91 aa, Diabrotica virgifera
  misc_feature: Coding regions on vcDNA: vcDNA=SeqID_15243; Strand=-; Position=451-726
KCEWHKGAWKDRFSGNKKKDKIRNQDPRKKTGITDVVELGRSRSETKIRRETNTTLNRVKGGEKWDLCPAVDGRGCMMLTNIGALYITVLV

SEQ ID NO: 35547 - protein, 57 aa, Diabrotica virgifera
  misc_feature: Coding regions on vcDNA: vcDNA=SeqID_15244; Strand=-; Position=0-170
  misc_feature (21)..(31): Xaa can be any naturally occurring amino acid
  misc_feature (39)..(51): Xaa can be any naturally occurring amino acid
IKMIMIMQHDHDQNATHIQQXXXXXXXXXXXHKDMIFIXXXXXXXXXXXXXIYINYT

SEQ ID NO: 35548 - protein, 66 aa, Diabrotica virgifera
  misc_feature: Coding regions on vcDNA: vcDNA=SeqID_15245; Strand=+; Position=155-355
  misc_feature (2)..(8): Xaa can be any naturally occurring amino acid
YXXXXXXXYLDLANHITIYICYLEHLNSFFSTDMLFHFRYLLFFMKMIILIYLQYLNHSIFLYYEY

SEQ ID NO: 35549 - protein, 218 aa, Diabrotica virgifera
  misc_feature: Coding regions on vcDNA: vcDNA=SeqID_15246; Strand=-; Position=1-654
  misc_feature (5)..(38): Xaa can be any naturally occurring amino acid
  misc_feature (40)..(218): Xaa can be any naturally occurring amino acid
FNQRXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35550 - protein, 80 aa, Diabrotica virgifera
  misc_feature: Coding regions on vcDNA: vcDNA=SeqID_15247; Strand=-; Position=542-784
SSPTVPLPPLSLMLVSRYNVLERALEHQTSSRDVVRKRGRYDRSEDRRDMRILSMQFDIFKTFQKPLQIKCFTNPLIIQN

SEQ ID NO: 35551 - protein, 70 aa, Diabrotica virgifera
  misc_feature: Coding regions on vcDNA: vcDNA=SeqID_15248; Strand=-; Position=564-776
GTAVRIVRIDQRFSTFLSDVPRVIFIIFGTTYIFKLYYQYLLSTTILIFSVFCVPPPIMICTTSGTCTTD

SEQ ID NO: 35552 - protein, 171 aa, Diabrotica virgifera
  misc_feature: Coding regions on vcDNA: vcDNA=SeqID_15249; Strand=+; Position=377-890
  misc_feature: Homolog annotation: Hit_ID=NP_732949.1; Match level="QueryCoverage =90%, HitCoverage=34%, E-value=2e-41, Identity=56%"; Hit description =CG5991-PC, isoform C [Drosophila melanogaster] ref|NP_732948.1| CG5991-PB, isoform B [Drosophila
  misc_feature: Gene Ontology Annotation: Molecular function=phosphatidylserine decarboxylase activity; Cellular component=mitochondrial inner membrane; Biological process=lipid metabolism
  misc_feature: Pfam annotation: Pfam_ID=PS_Dcarbxylase; Match level="Score=-64.8, E -value=0.0088, Copies=1"; Pfam description=Phosphatidylserine decarboxylase
  misc_feature (85)..(85): Xaa can be any naturally occurring amino acid
QWNTYWIIFDIIDVTLPEVLRPPVYKMYSNAFGVNIAEAENEDLTSYPSLADFFARSLKSGVRQVDESSCLVSPCDGTVLHFDCXTEQVEQVKGVTYSLKDFFGENTGKVQKYNGDFKTSLLHKPHEGNVLYQCVIYLAPGDYHRFHSPSEWKPTHRRHFSGQLLSVNPAL

SEQ ID NO: 35553 - protein, 88 aa, Diabrotica virgifera
  misc_feature: Coding regions on vcDNA: vcDNA=SeqID_15250; Strand=+; Position=501-767
  misc_feature (10)..(19): Xaa can be any naturally occurring amino acid
  misc_feature (59)..(65): Xaa can be any naturally occurring amino acid
INTCELLTKXXXXXXXXXXIVFKYFYVFCMWRLVMSKRLIFIKYLKDIENIFDYLLIRXXXXXXXQFTFHYYIVNIILYSDKHTTYTM

SEQ ID NO: 35554 - protein, 68 aa, Diabrotica virgifera
  misc_feature: Coding regions on vcDNA: vcDNA=SeqID_15251; Strand=-; Position=0-203
  misc_feature (3)..(8): Xaa can be any naturally occurring amino acid
  misc_feature (10)..(67): Xaa can be any naturally occurring amino acid
KRXXXXXXHXXXXXXXXXXXXXXXXXXXXXXXXXXXXXXXXXXXXXXXXXXXXXXXXXXXXXXXXXXS

SEQ ID NO: 35555 - protein, 234 aa, Diabrotica virgifera
  misc_feature: Coding regions on vcDNA: vcDNA=SeqID_15252; Strand=+; Position=236-940
  misc_feature: Homolog annotation: Hit_ID=EAA46011.1; Match level="QueryCoverage =70%, HitCoverage=48%, E-value=2e-16, Identity=27%"; Hit description =CG18140-PA [Drosophila melanogaster]
  misc_feature: Gene Ontology Annotation: Molecular function=chitinase activity; Cellular component=extracellular space; Biological process=response to bacteria
  misc_feature (180)..(189): Xaa can be any naturally occurring amino acid
  misc_feature (195)..(195): Xaa can be any naturally occurring amino acid
  misc_feature (198)..(198): Xaa can be any naturally occurring amino acid
  misc_feature (213)..(213): Xaa can be any naturally occurring amino acid
LFCSRISYTLLRTLFTDSERKESFLYSTVEMIQAYSFDGLDVSWMFPKPSDKDRYISLLDQIKRIFKHYGWLLSVTVYPKLEDTGYDPLKMDSIVDWVTIKTLDVYNTLFFKVKDIQLYTGYDWKKEDLNLNRETVIRNWLDAGLSKNKLIMGIELYPIKFTYMNANNTKEKPKVVIHGXXXXXXXXXXLLQINXAIXRDIIQKTIMYMDITXRIWGWLKRRRFIFFRKGAMQR

SEQ ID NO: 35556 - protein, 101 aa, Diabrotica virgifera
  misc_feature: Coding regions on vcDNA: vcDNA=SeqID_15253; Strand=+; Position=246-551
  misc_feature (12)..(19): Xaa can be any naturally occurring amino acid
YLLLKMWSIFNXXXXXXXXLGIPILPLYIFFSTTSRQTKQRSTTDTLEQRCKNHCWELDGGCPESRNMEKLEGCLCSTVDSNAYMMKMMIVSSTYYFLLFS

SEQ ID NO: 35557 - protein, 120 aa, Diabrotica virgifera
  misc_feature: Coding regions on vcDNA: vcDNA=SeqID_15254; Strand=+; Position=1-364
  misc_feature: Homolog annotation: Hit_ID=AAR84629.1; Match level="QueryCoverage =88%, HitCoverage=39%, E-value=8e-16, Identity=36%"; Hit description =putative alcohol dehydrogenase [Gryllotalpa orientalis]
  misc_feature (14)..(14): Xaa can be any naturally occurring amino acid
PIYVGTKHALVGIXRCWGHPWHFGRTKVRVVAVCPGLTNTPILDGFQTSCLSQAYLPLIEKINVDFGHTMQSPEHLAKEAIHVLEKAPNGTVWAIENSQSPIEYTVLDYADKLSNNILHE

SEQ ID NO: 35558 - protein, 25 aa, Diabrotica virgifera
  misc_feature: Coding regions on vcDNA: vcDNA=SeqID_15255; Strand=-; Position=2-76
  misc_feature (6)..(7): Xaa can be any naturally occurring amino acid
  misc_feature (11)..(25): Xaa can be any naturally occurring amino acid
ALFNHXXLNNXXXXXXXXXXXXXXX

SEQ ID NO: 35559 - protein, 163 aa, Diabrotica virgifera
  misc_feature: Coding regions on vcDNA: vcDNA=SeqID_15256; Strand=+; Position=328-819
  misc_feature (15)..(21): Xaa can be any naturally occurring amino acid
  misc_feature (150)..(150): Xaa can be any naturally occurring amino acid
  misc_feature (163)..(163): Xaa can be any naturally occurring amino acid
CINLNIFCDILKPYXXXXXXXRFSWSWEGFIWFLIFVLFSAAMIFKLETHRMYRGGFSSRRLWRSLPPYFQTRSGRLGGVLHIYLHQNVEMWVFGRRVDLGLTFYDFFSKSYRLRYLTPFYRQVIVSKQHVHQSDSIKFFMFGIERSSFXSLNKWMGGYFYNX

SEQ ID NO: 35560 - protein, 264 aa, Diabrotica virgifera
  misc_feature: Coding regions on vcDNA: vcDNA=SeqID_15257; Strand=-; Position=150-944
  misc_feature: Homolog annotation: Hit_ID=XP_394183.1; Match level="QueryCoverage =100%, HitCoverage=24%, E-value=1e-70, Identity=47%"; Hit description= similar to CG31319-PA [Apis mellifera]
  misc_feature: Gene Ontology Annotation: Molecular function=cytoskeletal regulator activity; Cellular component=nucleus; Biological process=regulation of cell adhesion
  misc_feature: Pfam annotation: Pfam_ID=START; Match level="Score=79.2, E-value=1.1e- 20, Copies=1"; Pfam description=START domain
AENKAAQECLMFCLQHFHKLFKIPYYFINQCNSSEMKEIKPKLFTDIGDDKGGWREYLRECHSNLIKESKEKSRGWKEIPSLCQNSKISIFYKKVSDGLPLRFWKVSAELDAPPSEVTLRILRERHIWDPDLISAKIIAQLDNQTEIFQYVRKSVIPIPNEEYCLIRTWRSDLPRDSCTIVETSVEYPGTVKIPNTFRSIVLASRYIIEPCGSGKSRIIHFSRVDIMGRSPDWYHKNYGYLCGFFIGNLQTSFYQNTNGPESQV

SEQ ID NO: 35561 - protein, 305 aa, Diabrotica virgifera
  misc_feature: Coding regions on vcDNA: vcDNA=SeqID_15258; Strand=+; Position=1-915
  misc_feature (23)..(297): Xaa can be any naturally occurring amino acid
QKVTITSSSYTTPNLQNIRLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTMEFPVL

SEQ ID NO: 35562 - protein, 95 aa, Diabrotica virgifera
  misc_feature: Coding regions on vcDNA: vcDNA=SeqID_15259; Strand=+; Position=499-786
  misc_feature (43)..(51): Xaa can be any naturally occurring amino acid
EVEEESVGNHMRLCSLLTLGCRSTLLPTYQNRRSCCTISLLPXXXXXXXXXIQRNPPGPKSMIEYKKLERHGIARRWILAINNRCLRRLHGQKWI

SEQ ID NO: 35563 - protein, 349 aa, Diabrotica virgifera
  misc_feature: Coding regions on vcDNA: vcDNA=SeqID_15260; Strand=-; Position=47-1096
  misc_feature (1)..(10): Xaa can be any naturally occurring amino acid
  misc_feature (13)..(25): Xaa can be any naturally occurring amino acid
  misc_feature (27)..(84): Xaa can be any naturally occurring amino acid
  misc_feature (88)..(112): Xaa can be any naturally occurring amino acid
  misc_feature (119)..(132): Xaa can be any naturally occurring amino acid
  misc_feature (136)..(162): Xaa can be any naturally occurring amino acid
  misc_feature (166)..(215): Xaa can be any naturally occurring amino acid
  misc_feature (230)..(237): Xaa can be any naturally occurring amino acid
  misc_feature (240)..(246): Xaa can be any naturally occurring amino acid
  misc_feature (250)..(259): Xaa can be any naturally occurring amino acid
XXXXXXXXXXGRXXXXXXXXXXXXXGXXXXXXXXXXXXXXXXXXXXXXXXXXXXXXXXXXXXXXXXXXXXXXXXXXXXXXXXXXHPPXXXXXXXXXXXXXXXXXXXXXXXXXEGNFSPXXXXXXXXXXXXXXRAAXXXXXXXXXXXXXXXXXXXXXXXXXXXRGEXXXXXXXXXXXXXXXXXXXXXXXXXXXXXXXXXXXXXXXXXXXXXXXXXXAAGGPRAGGVFSPLXXXXXXXXTQXXXXXXXYKEXXXXXXXXXXIPILPSTRYKGHFTFDPHSAVYSVASIFYPLASLTREWFPLSINPSDPSRLCQSSPMLRNKVLCPSRLDQKKDVSLIRHGDTPCCPHSDN

SEQ ID NO: 35564 - protein, 222 aa, Diabrotica virgifera
  misc_feature: Coding regions on vcDNA: vcDNA=SeqID_15261; Strand=-; Position=1-666
  misc_feature (12)..(19): Xaa can be any naturally occurring amino acid
  misc_feature (23)..(44): Xaa can be any naturally occurring amino acid
  misc_feature (47)..(62): Xaa can be any naturally occurring amino acid
  misc_feature (64)..(88): Xaa can be any naturally occurring amino acid
  misc_feature (91)..(128): Xaa can be any naturally occurring amino acid
  misc_feature (130)..(130): Xaa can be any naturally occurring amino acid
  misc_feature (136)..(159): Xaa can be any naturally occurring amino acid
  misc_feature (171)..(220): Xaa can be any naturally occurring amino acid
APARPRPPRAPXXXXXXXXFVVXXXXXXXXXXXXXXXXXXXXXXKHXXXXXXXXXXXXXXXXGXXXXXXXXXXXXXXXXXXXXXXXXXTTXXXXXXXXXXXXXXXXXXXXXXXXXXXXXXXXXXXXXXRXALCARXXXXXXXXXXXXXXXXXXXXXXXXVMRGGGGRFSSXXXXXXXXXXXXXXXXXXXXXXXXXXXXXXXXXXXXXXXXXXXXXXXXXXVW

SEQ ID NO: 35565 - protein, 289 aa, Diabrotica virgifera
  misc_feature: Coding regions on vcDNA: vcDNA=SeqID_15262; Strand=-; Position=5-874
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(271): Xaa can be any naturally occurring amino acid
  misc_feature (278)..(287): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDDNIRXXXXXXXXXXDA

SEQ ID NO: 35566 - protein, 112 aa, Diabrotica virgifera
  misc_feature: Coding regions on vcDNA: vcDNA=SeqID_15263; Strand=+; Position=1-339
VDRCAVYTLKARTDYKRWFDWKQDTILFTDTITLTGPIQDILEITDFLRQFPGPMTGVIDHEYGSRTTGQPVGYFNITWTTNLQQGLFDLNDYETTCISRLDSEKIVSEETR

SEQ ID NO: 35567 - protein, 70 aa, Diabrotica virgifera
  misc_feature: Coding regions on vcDNA: vcDNA=SeqID_15264; Strand=+; Position=51-263
  misc_feature (36)..(47): Xaa can be any naturally occurring amino acid
QETNRQMEDDHWDDRGKYSKTTSIETKNGSKTGMSXXXXXXXXXXXXVADLYMVAMSIVQGESNISQNEY

SEQ ID NO: 35568 - protein, 65 aa, Diabrotica virgifera
  misc_feature: Coding regions on vcDNA: vcDNA=SeqID_15265; Strand=+; Position=361-558
RIRYFNGVGNIQQIFCRSKYILYHNLKSLTQIFYDKLYVIYFQLFVNFTKHMYIYNIDGSLKFYA

SEQ ID NO: 35569 - protein, 235 aa, Diabrotica virgifera
  misc_feature: Coding regions on vcDNA: vcDNA=SeqID_15266; Strand=+; Position=217-924
  misc_feature: Homolog annotation: Hit_ID=NP_765980.2; Match level="QueryCoverage =68%, HitCoverage=95%, E-value=5e-20, Identity=32%"; Hit description =hypothetical protein LOC268670 [Mus musculus] gb|AAH28265.1| Hypothetical protein LOC268670 [Mus
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=92.1, E-value =1.4e-24, Copies=4"; Pfam description=Zinc finger, C2H2 type
MMMIYYQKNICKICISRLQEIKQFVDLCKANNTLFLTAVQSFGVKNVSGQVDTIVVTDNVEVEQIWIKEEPEFFQCCICNNTFKEKQLLIAHKIKEHRIVVEHSYTKEINKKIHRTKNVKTSDTVSVPPKKLLKSRKESVGPFKCTICDRSLSSYKVLHEHKKIHSGVRPYKCPHCQKDFLCSTSLKIHIRVHTGETPYICTICNKGFRRAGYLTVHKRNAHFVIERHTAPVSNL

SEQ ID NO: 35570 - protein, 20 aa, Diabrotica virgifera
  misc_feature: Coding regions on vcDNA: vcDNA=SeqID_15267; Strand=-; Position=1-60
  misc_feature (3)..(20): Xaa can be any naturally occurring amino acid
KKXXXXXXXXXXXXXXXXXX

SEQ ID NO: 35571 - protein, 292 aa, Diabrotica virgifera
  misc_feature: Coding regions on vcDNA: vcDNA=SeqID_15268; Strand=+; Position=59-934
  misc_feature: Homolog annotation: Hit_ID=XP_321004.1; Match level="QueryCoverage =97%, HitCoverage=53%, E-value=1e-117, Identity=70%"; Hit description= ENSANGP00000019861 [Anopheles gambiae]
  misc_feature: Gene Ontology Annotation: Molecular function=protein binding; Cellular component=cellular_component unknown; Biological process =biological_process unknown
  misc_feature: Pfam annotation: Pfam_ID=GBP; Match level="Score=427.2, E-value=2e -125, Copies=1"; Pfam description=Guanylate-binding protein, N -terminal
  misc_feature (225)..(230): Xaa can be any naturally occurring amino acid
MSRPHAVPIVVADEDHSFKLDEEALKKVLMKEELKDRFVVVVSVAGAFRHGKSFLLDFFLRYMNAKYVLKQNTSEWVGAEEAPLEGFSWKGGSERDTTGILMWSEVYTTELSTGEKIAVILLDTQGTWDSKSTVKECATIFALSTMLSSVQIYNLSSNIQEDDLQHLQLFTEYGRLALADSGTTPFQRLQFLVRDWRFPYEAPYGAVGGQQILQKRLEVNEHQHXXXXXXRRHISSCFTEIACFLMPHPGIKVATSPTFDGRLAEIDGEIKDNLKILVPMLLAPENLVLKKI

SEQ ID NO: 35572 - protein, 298 aa, Diabrotica virgifera
  misc_feature: Coding regions on vcDNA: vcDNA=SeqID_15269; Strand=+; Position=14-908
  misc_feature: Homolog annotation: Hit_ID=S31175; Match level="QueryCoverage=97%, HitCoverage=32%, E-value=2e-49, Identity=35%"; Hit description =hypothetical protein 2 - midge (Chironomus thummi) transposon NLR1Cth
  misc_feature: Gene Ontology Annotation: Molecular function=molecular_function unknown; Cellular component=cellular_component unknown; Biological process=biological_process unknown
  misc_feature (93)..(93): Xaa can be any naturally occurring amino acid
LIIPNEVKDLIRDRNNARRAYQRTRRQDYKDYSDELSAEIRTRLTSINENKWHNIIRKAEENQGNVWKMMKARKRGKQKIPPITDEEGTHYEXKEKHAIARKLEATHRQNQHMSDQQTIDEVNRAYNRISERNQFVIEEEDQLHPSEVHRIIKKLKGSRAPGQEDIHNIVLKELPKKMIVQLYYIFRYCLEKAHFPNNWKHAKTIPLLKPRKDGRRPESYRPISLLEPMGKILEKIIFKRLNKHAERRNIIQEDQFGFRKGRNCELQLAKSVSDTKIRFNRKQKTGMAILDIEKAYDT

SEQ ID NO: 35573 - protein, 156 aa, Diabrotica virgifera
  misc_feature: Coding regions on vcDNA: vcDNA=SeqID_15270; Strand=-; Position=399-869
  misc_feature (20)..(29): Xaa can be any naturally occurring amino acid
CSLVVLANILVCTLKGCLRXXXXXXXXXXIFLSFTQLVQYCYGNLGKQCFHCFHGVISSLAPNSTDCTVFNSGFSDHEAVLTTFWLKSKNSSENTQRKLFRVFGEQNFLTFKHLCQTTDWDFRSVDVDIEFSRFIKLLSGLAYESFPLRPIKTKTS

SEQ ID NO: 35574 - protein, 200 aa, Diabrotica virgifera
  misc_feature: Coding regions on vcDNA: vcDNA=SeqID_15271; Strand=+; Position=203-802
  misc_feature: Homolog annotation: Hit_ID=XP_312169.1; Match level="QueryCoverage =100%, HitCoverage=68%, E-value=3e-21, Identity=32%"; Hit description= ENSANGP00000022147 [Anopheles gambiae]
MARIKRGFVFGASVVSGIGVLFTIISLATEQWVYSDQAQLAVNASTDRYFSKIKYGLFQGTLRTGVTYNTVQISMTCIAKNNICAMLCAKNSTERFNILEDLYDNKGIHIQNDNECPMVASSTKLHNEFAVLRSTQASANKDRKFINFGVWISTIFFLSVSILFGLLAAGLSLYNTVSHPIQIYLSIYGIIIFNGIALGT

SEQ ID NO: 35575 - protein, 282 aa, Diabrotica virgifera
  misc_feature: Coding regions on vcDNA: vcDNA=SeqID_15272; Strand=-; Position=0-845
  misc_feature (2)..(15): Xaa can be any naturally occurring amino acid
  misc_feature (18)..(26): Xaa can be any naturally occurring amino acid
  misc_feature (38)..(46): Xaa can be any naturally occurring amino acid
  misc_feature (48)..(61): Xaa can be any naturally occurring amino acid
  misc_feature (68)..(80): Xaa can be any naturally occurring amino acid
  misc_feature (82)..(279): Xaa can be any naturally occurring amino acid
VXXXXXXXXXXXXXXSFXXXXXXXXXDRNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVR

SEQ ID NO: 35576 - protein, 123 aa, Diabrotica virgifera
  misc_feature: Coding regions on vcDNA: vcDNA=SeqID_15273; Strand=-; Position=104-475
  misc_feature (13)..(18): Xaa can be any naturally occurring amino acid
  misc_feature (98)..(108): Xaa can be any naturally occurring amino acid
STGFIKSTVVGKXXXXXXQRYWINPVDQKEMPTLNTNTPLRRTGGSFRLQRAVHVLYAYGYIKMLHNLKNGQKLLHLLGYLRNQNHFGNEELRLEFKXXXXXXXXXXXSYLRVRKLVKFCWPV

SEQ ID NO: 35577 - protein, 212 aa, Diabrotica virgifera
  misc_feature: Coding regions on vcDNA: vcDNA=SeqID_15274; Strand=-; Position=3-638
  misc_feature: Homolog annotation: Hit_ID=EAL31340.1; Match level="QueryCoverage =97%, HitCoverage=18%, E-value=5e-79, Identity=68%"; Hit description =GA11636-PA [Drosophila pseudoobscura]
  misc_feature: Gene Ontology Annotation: Biological process=regulation of protein activity, epigenetic
  misc_feature: Pfam annotation: Pfam_ID=zf-C2H2; Match level="Score=31.9, E-value =1.9e-06, Copies=2"; Pfam description=Zinc finger, C2H2 type
  misc_feature (25)..(29): Xaa can be any naturally occurring amino acid
  misc_feature (118)..(132): Xaa can be any naturally occurring amino acid
PSAAAAAPGSSGGAKPGDTSSKNSXXXXXICDGYIKDLEQLRNHMQWIHKIKIHPKMIYNRPPLNCQKCQFRFFTDQGLERHLLGSHGLVTSSMQDAANKSKDSGRCPVCGRVYQWKXXXXXXXXXXXXXXXAHLSYKCTVCTATFGMYKQFENHVYSAHSVVAKRVMDKKGGSTTSSTTSNSSPKPSAADQLKPLKINDEITIIPQPAKST

SEQ ID NO: 35578 - protein, 80 aa, Diabrotica virgifera
  misc_feature: Coding regions on vcDNA: vcDNA=SeqID_15275; Strand=+; Position=3-245
  misc_feature (24)..(30): Xaa can be any naturally occurring amino acid
  misc_feature (66)..(79): Xaa can be any naturally occurring amino acid
FWGVRPCIMSCKQLFFVTGIIQNXXXXXXXLQTGAGIFKIGAQMIKLWIVKLNQTFWVTQFCAGEXXXXXXXXXXXXXXV

SEQ ID NO: 35579 - protein, 89 aa, Diabrotica virgifera
  misc_feature: Coding regions on vcDNA: vcDNA=SeqID_15276; Strand=-; Position=211-480
  misc_feature (78)..(84): Xaa can be any naturally occurring amino acid
SKSLFVEVISIISSYCAVSFQRLAIQMATVALKTAARKISADERSNRFVRSFSHEFERLLTNLLSCTLPSNMINHYWXXXXXXXEYNNS

SEQ ID NO: 35580 - protein, 231 aa, Diabrotica virgifera
  misc_feature: Coding regions on vcDNA: vcDNA=SeqID_15277; Strand=+; Position=53-748
  misc_feature: Homolog annotation: Hit_ID=XP_396126.1; Match level="QueryCoverage =99%, HitCoverage=82%, E-value=1e-26, Identity=30%"; Hit description =similar to Phosphoserine aminotransferase 1 [Apis mellifera]
  misc_feature: Gene Ontology Annotation: Molecular function=phosphoserine transaminase activity; Biological process=serine biosynthesis
  misc_feature (2)..(2): Xaa can be any naturally occurring amino acid
  misc_feature (7)..(7): Xaa can be any naturally occurring amino acid
  misc_feature (10)..(11): Xaa can be any naturally occurring amino acid
  misc_feature (13)..(14): Xaa can be any naturally occurring amino acid
  misc_feature (19)..(20): Xaa can be any naturally occurring amino acid
  misc_feature (24)..(27): Xaa can be any naturally occurring amino acid
  misc_feature (29)..(29): Xaa can be any naturally occurring amino acid
  misc_feature (31)..(31): Xaa can be any naturally occurring amino acid
  misc_feature (35)..(39): Xaa can be any naturally occurring amino acid
  misc_feature (41)..(43): Xaa can be any naturally occurring amino acid
  misc_feature (46)..(46): Xaa can be any naturally occurring amino acid
  misc_feature (49)..(52): Xaa can be any naturally occurring amino acid
  misc_feature (54)..(55): Xaa can be any naturally occurring amino acid
  misc_feature (57)..(57): Xaa can be any naturally occurring amino acid
  misc_feature (59)..(59): Xaa can be any naturally occurring amino acid
  misc_feature (61)..(62): Xaa can be any naturally occurring amino acid
  misc_feature (67)..(68): Xaa can be any naturally occurring amino acid
  misc_feature (75)..(76): Xaa can be any naturally occurring amino acid
  misc_feature (79)..(80): Xaa can be any naturally occurring amino acid
  misc_feature (83)..(83): Xaa can be any naturally occurring amino acid
  misc_feature (88)..(89): Xaa can be any naturally occurring amino acid
  misc_feature (92)..(94): Xaa can be any naturally occurring amino acid
  misc_feature (97)..(97): Xaa can be any naturally occurring amino acid
  misc_feature (100)..(101): Xaa can be any naturally occurring amino acid
  misc_feature (103)..(111): Xaa can be any naturally occurring amino acid
  misc_feature (113)..(113): Xaa can be any naturally occurring amino acid
  misc_feature (118)..(119): Xaa can be any naturally occurring amino acid
  misc_feature (124)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (132)..(134): Xaa can be any naturally occurring amino acid
  misc_feature (138)..(138): Xaa can be any naturally occurring amino acid
  misc_feature (142)..(144): Xaa can be any naturally occurring amino acid
  misc_feature (148)..(148): Xaa can be any naturally occurring amino acid
  misc_feature (151)..(155): Xaa can be any naturally occurring amino acid
  misc_feature (160)..(160): Xaa can be any naturally occurring amino acid
  misc_feature (165)..(165): Xaa can be any naturally occurring amino acid
  misc_feature (167)..(168): Xaa can be any naturally occurring amino acid
  misc_feature (173)..(174): Xaa can be any naturally occurring amino acid
  misc_feature (177)..(177): Xaa can be any naturally occurring amino acid
  misc_feature (180)..(181): Xaa can be any naturally occurring amino acid
  misc_feature (185)..(185): Xaa can be any naturally occurring amino acid
  misc_feature (192)..(193): Xaa can be any naturally occurring amino acid
  misc_feature (196)..(196): Xaa can be any naturally occurring amino acid
  misc_feature (198)..(198): Xaa can be any naturally occurring amino acid
  misc_feature (202)..(202): Xaa can be any naturally occurring amino acid
  misc_feature (204)..(204): Xaa can be any naturally occurring amino acid
  misc_feature (207)..(207): Xaa can be any naturally occurring amino acid
  misc_feature (211)..(211): Xaa can be any naturally occurring amino acid
  misc_feature (225)..(227): Xaa can be any naturally occurring amino acid
  misc_feature (229)..(229): Xaa can be any naturally occurring amino acid
KXWKMNXNGXXVXXCDNEXXDGVXXXXIXEXNGVXXXXXMXXXIMXKKXXXXKXXWXIXGXXKNIGXXGVVVVIXXEDXXGNXMKWCXXVMXXXYIXKEXXVXXXXXXXXXYXMEKVXXWIKKXGGXEXMEXXXIEKXSLLXXXMVEXKGXXXXXIDEEXRSRMXVXXRVGGXXEKXEEXXLVEXEKVKMYXXKGXRXVGGXRXSLXNGVXLDDVKLLVKFMKEXXXKXGK

SEQ ID NO: 35581 - protein, 285 aa, Diabrotica virgifera
  misc_feature: Coding regions on vcDNA: vcDNA=SeqID_15278; Strand=-; Position=0-854
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(282): Xaa can be any naturally occurring amino acid
FXXXXXXXXXXXNHPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSS

SEQ ID NO: 35582 - protein, 149 aa, Diabrotica virgifera
  misc_feature: Coding regions on vcDNA: vcDNA=SeqID_15279; Strand=-; Position=1-447
PGTVILSTPTLVLSWVICSTINHLIQQQPIQQQPIQQQPIQQQQPIQQQPIQQQPQESPKSVPSPLEMEPNHPVSNSNAEPSLNQQTDTNLMPPVLIMETNCISKDQSTTNKRTISEINTTPSPTEELNKEFKVPTQTKKKQKKQTEST

SEQ ID NO: 35583 - protein, 252 aa, Diabrotica virgifera
  misc_feature: Coding regions on vcDNA: vcDNA=SeqID_15280; Strand=-; Position=2-757
  misc_feature (3)..(10): Xaa can be any naturally occurring amino acid
  misc_feature (15)..(15): Xaa can be any naturally occurring amino acid
  misc_feature (17)..(17): Xaa can be any naturally occurring amino acid
  misc_feature (21)..(22): Xaa can be any naturally occurring amino acid
  misc_feature (28)..(28): Xaa can be any naturally occurring amino acid
  misc_feature (30)..(40): Xaa can be any naturally occurring amino acid
  misc_feature (45)..(46): Xaa can be any naturally occurring amino acid
  misc_feature (49)..(203): Xaa can be any naturally occurring amino acid
  misc_feature (206)..(236): Xaa can be any naturally occurring amino acid
  misc_feature (239)..(248): Xaa can be any naturally occurring amino acid
HFXXXXXXXXIILPXHXQNTXXIQINQXPXXXXXXXXXXXFLINXXKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHXXXXXXXXXXXXXXXXXXXXXXXXXXXXXXXPKXXXXXXXXXXRAGG

SEQ ID NO: 35584 - protein, 70 aa, Diabrotica virgifera
  misc_feature: Coding regions on vcDNA: vcDNA=SeqID_15281; Strand=+; Position=268-480
TNVYIIKYVYDSGCISSVLGNDSKKEHTYGLNIWRWYHVTSRAMTRMTCSGKYIRRSIGTYLRKVKISLE

SEQ ID NO: 35585 - protein, 121 aa, Diabrotica virgifera
  misc_feature: Coding regions on vcDNA: vcDNA=SeqID_15282; Strand=+; Position=231-596
ISIMGRNMNCDMISMPKTLLNTCLAYLVLLLIQKELFLVNAAVVPNSSSALHCEYYNNTFKDKPADAAVTEEICPVDDQKHNCYVLWSISENGTVNVSLKLTFDNVKLNESETNFKLQELK

SEQ ID NO: 35586 - protein, 257 aa, Diabrotica virgifera
  misc_feature: Coding regions on vcDNA: vcDNA=SeqID_15283; Strand=+; Position=148-918
  misc_feature: Homolog annotation: Hit_ID=EAL30871.1; Match level="QueryCoverage =99%, HitCoverage=37%, E-value=1e-55, Identity=42%"; Hit description =GA10312-PA [Drosophila pseudoobscura]
  misc_feature: Gene Ontology Annotation: Molecular function=phosphatidylinositol -bisphosphatase activity; Cellular component=Golgi membrane
MNPKIKLGKKAGFASFVLPRKPSNKVGISVTRSHSAREQSMDHVIISEVTNDLAISRRPLSFDVKRKKMQDIKKLTTNNLDRHNSLSDSNVCGNCNDAIPAGKSREKSISHENLLEHKGLNPFHLIPISKARQRNFLQGKIGANSLLGPSELDRVCPNREITIFVGTWNMNGHSPPQELNDFVLPVSMEHVPDILSFGTQESTSERFEWEASLQETIGPSHLLLHSISLGTIHLATFIRRDLIWYVSVPEESSLSVR

SEQ ID NO: 35587 - protein, 45 aa, Diabrotica virgifera
  misc_feature: Coding regions on vcDNA: vcDNA=SeqID_15284; Strand=-; Position=1-135
  misc_feature (1)..(40): Xaa can be any naturally occurring amino acid
XXXXXXXXXXXXXXXXXXXXXXXXXXXXXXXXXXXXXXXXNNLIN

SEQ ID NO: 35588 - protein, 76 aa, Diabrotica virgifera
  misc_feature: Coding regions on vcDNA: vcDNA=SeqID_15285; Strand=-; Position=125-355
  misc_feature (14)..(20): Xaa can be any naturally occurring amino acid
YQISLWKYTTVIQXXXXXXXPILDCKVSHRKGQYCMEEPISTIKLSSLCYYDEKNSSSHQKESRKVKKYAFSSVCM

SEQ ID NO: 35589 - protein, 176 aa, Diabrotica virgifera
  misc_feature: Coding regions on vcDNA: vcDNA=SeqID_15286; Strand=+; Position=81-753
  misc_feature: Homolog annotation: Hit_ID=AAF87759.1; Match level="QueryCoverage =100%, HitCoverage=50%, E-value=6e-68, Identity=65%"; Hit description= cytochrome oxidase subunit I [Diabrotica virgifera virgifera]
  misc_feature: Pfam annotation: Pfam_ID=COX1; Match level="Score=-152.0, E-value =4.4e-06, Copies=1"; Pfam description=Cytochrome C and Quinol oxidase polyp
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
  misc_feature (124)..(124): Xaa can be any naturally occurring amino acid
  misc_feature (132)..(133): Xaa can be any naturally occurring amino acid
  misc_feature (160)..(160): Xaa can be any naturally occurring amino acid
LXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGIIYAIIAIGLLGFIVXAHHIFTVXXMDVDTRAYFTSATIIIAVPTGIKVFRXLATYHGTTITYSPVTL

SEQ ID NO: 35590 - protein, 35 aa, Diabrotica virgifera
  misc_feature: Coding regions on vcDNA: vcDNA=SeqID_15287; Strand=-; Position=1-105
  misc_feature (3)..(34): Xaa can be any naturally occurring amino acid
KIXXXXXXXXXXXXXXXXXXXXXXXXXXXXXXXXI

SEQ ID NO: 35591 - protein, 173 aa, Diabrotica virgifera
  misc_feature: Coding regions on vcDNA: vcDNA=SeqID_15288; Strand=+; Position=115-636
  misc_feature: Homolog annotation: Hit_ID=AAD30361.1; Match level="QueryCoverage =81%, HitCoverage=97%, E-value=1e-43, Identity=56%"; Hit description =Cu/Zn-superoxide dismutase [Fasciola hepatica]
  misc_feature: Gene Ontology Annotation: Molecular function=copper, zinc superoxide dismutase activity; Cellular component=cytoplasm; Biological process= neurogenesis
  misc_feature: Pfam annotation: Pfam_ID=Sod_Cu; Match level="Score=238.0, E-value =1.8e-68, Copies=1"; Pfam description=Copper/zinc superoxide dismutase (SOD
MFKIALCAAILAIAYAEDGIVYLMDPTGKSGVTGTVRFLKLPSGINVIGDIRGLTPGKHGFHIHQEGNIQPSCLAAGGHFNPFNKQHGGPDDCDRHVGDLGNIEADQNGVAHIDFRDTKISFEGATNIFGRSVVVHEKVDDLGKGGHPDSLKTGNAGGRLACGVVGVVTVLTL

SEQ ID NO: 35592 - protein, 278 aa, Diabrotica virgifera
  misc_feature: Coding regions on vcDNA: vcDNA=SeqID_15289; Strand=+; Position=49-931
  misc_feature: Homolog annotation: Hit_ID=XP_393382.1; Match level="QueryCoverage =91%, HitCoverage=23%, E-value=3e-85, Identity=58%"; Hit description =similar to cell division cycle and apoptosis regulator 1 [Apis mellifera]
  misc_feature (241)..(241): Xaa can be any naturally occurring amino acid
GRDRSRDRDRDDDEVDRKRRREDRVRDRERDDRKSPIRKRSKSRSRSPKGVRRRPRIIPRYMVQIPKINLDLDGGDVLELKRRYKNMYIPSDFFFTSIKWVDSFPADKPFAINKPCSFQIMHKDVAPVLENRSSDPPDADYLFSAKVMLMSTPGLDEIYHRCCSLADDKDNDEKDYNETMAIGGAWSPSLDGENPKEDPTVLIKTAIRTCKNLTGIDLSNCTQWYRFLELYYRRSESTYKXGKTIPARVETVVLFPTVGVGRSAELLQKAMRTNLDPA

SEQ ID NO: 35593 - protein, 75 aa, Diabrotica virgifera
  misc_feature: Coding regions on vcDNA: vcDNA=SeqID_15290; Strand=+; Position=585-812
KGKIFDTEKTKIWLYIYITFYVYWLLSYYQMKMKIMIILKILIFLNYTYLLFKNMHSKQVKIVEVITYANIKKFF

SEQ ID NO: 35594 - protein, 120 aa, Diabrotica virgifera
  misc_feature: Coding regions on vcDNA: vcDNA=SeqID_15291; Strand=-; Position=443-805
  misc_feature (34)..(40): Xaa can be any naturally occurring amino acid
  misc_feature (50)..(58): Xaa can be any naturally occurring amino acid
  misc_feature (108)..(115): Xaa can be any naturally occurring amino acid
QKTSSNVIIFKITKFENTKIEFIYLNFLHLLQMXXXXXXXNSLEAFAVPXXXXXXXXXGIKNYSFNACRRRLGCVKLFNNINDVSVMILIFLWLFCHSIGVTFEVTLXXXXXXXXATLFA

SEQ ID NO: 35595 - protein, 248 aa, Diabrotica virgifera; identical to SEQ ID NO: 31614
  misc_feature: Coding regions on vcDNA: vcDNA=SeqID_15292; Strand=-; Position=1-744
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(248): Xaa can be any naturally occurring amino acid

SEQ ID NO: 35596 - protein, 95 aa, Diabrotica virgifera
  misc_feature: Coding regions on vcDNA: vcDNA=SeqID_15293; Strand=+; Position=152-439
EVSTSSSGEYFRFLDEITMSRTWGLPTTLWAEKDLSEPPISSRWPAFLKVYFLNILMYDLTQGIITRKSVNAMWDMGLVVDYNEGKTLDPQILYY

SEQ ID NO: 35597 - protein, 304 aa, Diabrotica virgifera
  misc_feature: Coding regions on vcDNA: vcDNA=SeqID_15294; Strand=+; Position=1-912
  misc_feature: Homolog annotation: Hit_ID=EAL31647.1; Match level="QueryCoverage =100%, HitCoverage=38%, E-value=1e-121, Identity=69%"; Hit description=GA22140-PA [Drosophila pseudoobscura]
  misc_feature: Gene Ontology Annotation: Molecular function=NAD+ synthase (glutamine- hydrolyzing) activity; Cellular component=cellular_component unknown; Biological process=nucleobase, nucleoside, nucleotide and nucleic acid
  misc_feature: Pfam annotation: Pfam_ID=NAD_synthase; Match level="Score=201.7, E -value=1.5e-57, Copies=1"; Pfam description=NAD synthase
  misc_feature (287)..(287): Xaa can be any naturally occurring amino acid
VDSSSTAIIVFSMCNLIMDAIHQEADQKVLSDLRRILASPDYTPNSAQDICNRLFVTCYMGSENSSKETRMRAETLADFIGSYHMNIVIDTAVSACVEIFTKMTNMLPKFSSNGGCARQNLALQNIQARIRMVLSYLFAQLMLWTRGRPGGLLVLGSANVDESLRGYMTKYDCSSADINPIGGISKSDLRRFMNYAKTKFNIPILNEIIEAPPTAELEPLKEGGIVQTDEEDMGMTYEELTQYGRLRKIESCGPYSMYCKLVQTWSSKYTPKQVAEKVKHFFRCYAXHRHKMTVITPSYHAESY

SEQ ID NO: 35598 - protein, 180 aa, Diabrotica virgifera
  misc_feature: Coding regions on vcDNA: vcDNA=SeqID_15295; Strand=-; Position=1-540
  misc_feature (3)..(10): Xaa can be any naturally occurring amino acid
  misc_feature (14)..(114): Xaa can be any naturally occurring amino acid
  misc_feature (118)..(126): Xaa can be any naturally occurring amino acid
  misc_feature (129)..(177): Xaa can be any naturally occurring amino acid
TFXXXXXXXXSTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNWKXXXXXXXXXDPXXXXXXXXXXXXXXXXXXXXXXXXXXXXXXXXXXXXXXXXXXXXXXXXXREE

SEQ ID NO: 35599 - protein, 328 aa, Diabrotica virgifera
  misc_feature: Coding regions on vcDNA: vcDNA=SeqID_15296; Strand=-; Position=0-983
  misc_feature (1)..(21): Xaa can be any naturally occurring amino acid
  misc_feature (24)..(322): Xaa can be any naturally occurring amino acid
XXXXXXXXXXXXXXXXXXXXXITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTPEEG

SEQ ID NO: 35600 - protein, 267 aa, Diabrotica virgifera
  misc_feature: Coding regions on vcDNA: vcDNA=SeqID_15297; Strand=+; Position=67-866
  misc_feature: Homolog annotation: Hit_ID=XP_150216.2; Match level="QueryCoverage =65%, HitCoverage=63%, E-value=1e-41, Identity=36%"; Hit description =RIKEN cDNA 4930422I07 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=129.9, E-value =6e-36, Copies=5"; Pfam description=Zinc finger, C2H2 type
  misc_feature (84)..(92): Xaa can be any naturally occurring amino acid
  misc_feature (217)..(217): Xaa can be any naturally occurring amino acid
MAAVGMLAMAGALRMRSLPLTYATCIFAGFFFNCYMPIGFELAVELTFPSEESTTTGLMNAVTQSMGVIVTLALGKLNHQIATXXXXXXXXXKEFVLRAQLDVHSYKHKSAKPYSCTICKKSFSVRSKLTRHSAVHSQIKSHICSICGNAYRSKESLKIHAIIHKGDRPYECQTCNAKFNNQSNLNKHAVVHTKEKTHMCDLCGKRFKFKWALSVHXKKHTQSRPFECDVCFKKFNFKKDLQRHNLIHQEGKQYKCSVCSTTFRRQD

SEQ ID NO: 35601 - protein, 46 aa, Diabrotica virgifera
  misc_feature: Coding regions on vcDNA: vcDNA=SeqID_15298; Strand=-; Position=6-146
  misc_feature (32)..(32): Xaa can be any naturally occurring amino acid
TIYPPLTINPSCGTHFRKLKRVHPGHQSPEAXEGGEFQPATCRRSL

SEQ ID NO: 35602 - protein, 299 aa, Diabrotica virgifera
  misc_feature: Coding regions on vcDNA: vcDNA=SeqID_15299; Strand=-; Position=0-896
  misc_feature (1)..(11): Xaa can be any naturally occurring amino acid
  misc_feature (14)..(248): Xaa can be any naturally occurring amino acid
  misc_feature (251)..(279): Xaa can be any naturally occurring amino acid
  misc_feature (281)..(294): Xaa can be any naturally occurring amino acid
XXXXXXXXXXXYRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTXXXXXXXXXXXXXXXXXXXXXXXXXXXXXLXXXXXXXXXXXXXXTPRGG

SEQ ID NO: 35603 - protein, 27 aa, Diabrotica virgifera
  misc_feature: Coding regions on vcDNA: vcDNA=SeqID_15300; Strand=-; Position=1-81
  misc_feature (7)..(26): Xaa can be any naturally occurring amino acid
RIPLLTXXXXXXXXXXXXXXXXXXXXY

SEQ ID NO: 35604 - protein, 60 aa, Diabrotica virgifera
  misc_feature: Coding regions on vcDNA: vcDNA=SeqID_15301; Strand=+; Position=130-312
SAPCYFYIILKPITTYRYYHSKFTKSNVYFIYLLFFIRVTVLKHFRIFVKKYLLVIKMNF

SEQ ID NO: 35605 - protein, 83 aa, Diabrotica virgifera
  misc_feature: Coding regions on vcDNA: vcDNA=SeqID_15302; Strand=+; Position=214-465
  misc_feature (26)..(34): Xaa can be any naturally occurring amino acid
  misc_feature (36)..(43): Xaa can be any naturally occurring amino acid
PGISYDITWHVSALHVIVPYICESVXXXXXXXXXLXXXXXXXXRNKESTYPSFTTVFIIRSKSHYHFYYSKYNGSQKFLTFAW

SEQ ID NO: 35606 - protein, 286 aa, Diabrotica virgifera
  misc_feature: Coding regions on vcDNA: vcDNA=SeqID_15303; Strand=-; Position=3-860
  misc_feature (1)..(35): Xaa can be any naturally occurring amino acid
  misc_feature (37)..(47): Xaa can be any naturally occurring amino acid
  misc_feature (57)..(65): Xaa can be any naturally occurring amino acid
  misc_feature (67)..(80): Xaa can be any naturally occurring amino acid
  misc_feature (87)..(99): Xaa can be any naturally occurring amino acid
  misc_feature (101)..(259): Xaa can be any naturally occurring amino acid
  misc_feature (261)..(286): Xaa can be any naturally occurring amino acid
XXXXXXXXXXXXXXXXXXXXXXXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXX

SEQ ID NO: 35607 - protein, 181 aa, Diabrotica virgifera
  misc_feature: Coding regions on vcDNA: vcDNA=SeqID_15304; Strand=+; Position=99-643
  misc_feature: Homolog annotation: Hit_ID=XP_394757.1; Match level="QueryCoverage =100%, HitCoverage=53%, E-value=3e-30, Identity=42%"; Hit description= similar to ENSANGP00000020045 [Apis mellifera]
  misc_feature: Gene Ontology Annotation: Molecular function=molecular_function unknown; Cellular component=nucleus; Biological process=myogenesis
  misc_feature (2)..(3): Xaa can be any naturally occurring amino acid
  misc_feature (5)..(6): Xaa can be any naturally occurring amino acid
  misc_feature (12)..(12): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(21): Xaa can be any naturally occurring amino acid
  misc_feature (26)..(26): Xaa can be any naturally occurring amino acid
  misc_feature (31)..(32): Xaa can be any naturally occurring amino acid
  misc_feature (34)..(34): Xaa can be any naturally occurring amino acid
  misc_feature (36)..(36): Xaa can be any naturally occurring amino acid
  misc_feature (41)..(41): Xaa can be any naturally occurring amino acid
  misc_feature (45)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (55)..(55): Xaa can be any naturally occurring amino acid
  misc_feature (58)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(67): Xaa can be any naturally occurring amino acid
  misc_feature (69)..(69): Xaa can be any naturally occurring amino acid
  misc_feature (71)..(72): Xaa can be any naturally occurring amino acid
  misc_feature (74)..(74): Xaa can be any naturally occurring amino acid
  misc_feature (78)..(78): Xaa can be any naturally occurring amino acid
  misc_feature (84)..(84): Xaa can be any naturally occurring amino acid
  misc_feature (87)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (98)..(99): Xaa can be any naturally occurring amino acid
  misc_feature (101)..(101): Xaa can be any naturally occurring amino acid
  misc_feature (103)..(104): Xaa can be any naturally occurring amino acid
  misc_feature (106)..(108): Xaa can be any naturally occurring amino acid
  misc_feature (111)..(113): Xaa can be any naturally occurring amino acid
  misc_feature (117)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (125)..(126): Xaa can be any naturally occurring amino acid
  misc_feature (128)..(128): Xaa can be any naturally occurring amino acid
  misc_feature (131)..(132): Xaa can be any naturally occurring amino acid
  misc_feature (135)..(137): Xaa can be any naturally occurring amino acid
  misc_feature (139)..(141): Xaa can be any naturally occurring amino acid
  misc_feature (144)..(145): Xaa can be any naturally occurring amino acid
  misc_feature (147)..(147): Xaa can be any naturally occurring amino acid
  misc_feature (152)..(152): Xaa can be any naturally occurring amino acid
  misc_feature (156)..(156): Xaa can be any naturally occurring amino acid
  misc_feature (159)..(160): Xaa can be any naturally occurring amino acid
  misc_feature (164)..(164): Xaa can be any naturally occurring amino acid
  misc_feature (169)..(169): Xaa can be any naturally occurring amino acid
  misc_feature (172)..(172): Xaa can be any naturally occurring amino acid
  misc_feature (175)..(175): Xaa can be any naturally occurring amino acid
  misc_feature (178)..(178): Xaa can be any naturally occurring amino acid
MXXKXXDKKKWXKWXKXVXXXEEKVXGGYKXXKXWXKWGMXNKMXXXXXVXEXEXELXXKNXXGXKXGXKXXGXGGGXGCLSMXDGXXFKXDEEFXKXXGXLXXRXXXKDXXXEGCXXXGXYXYXXEXMVXXGRXXXKXXXKCXXCXKGLEXVNVXEGXXKDIXCKVCXGKXFGXKGXGYG

SEQ ID NO: 35608 - protein, 66 aa, Diabrotica virgifera; identical to SEQ ID NO: 26808
  misc_feature: Coding regions on vcDNA: vcDNA=SeqID_15305; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35609 - protein, 70 aa, Diabrotica virgifera
  misc_feature: Coding regions on vcDNA: vcDNA=SeqID_15306; Strand=+; Position=333-545
  misc_feature (19)..(40): Xaa can be any naturally occurring amino acid
WMSCILQIHNKVLFNPIKXXXXXXXXXXXXXXXXXXXXXXILINVLIFVIQNRRVHQIYPCASRYCFEVL

SEQ ID NO: 35610 - protein, 74 aa, Diabrotica virgifera
  misc_feature: Coding regions on vcDNA: vcDNA=SeqID_15307; Strand=-; Position=281-505
QRSQMSSSRGVFFCMLALQSILFFYDNNRHLFSYVRVRFSLFGCHVCKTWRFVVVYIFLVFHRTFHVKGYLCFA

SEQ ID NO: 35611 - protein, 98 aa, Diabrotica virgifera
  misc_feature: Coding regions on vcDNA: vcDNA=SeqID_15308; Strand=+; Position=468-764
  misc_feature: Homolog annotation: Hit_ID=XP_394780.1; Match level="QueryCoverage =94%, HitCoverage=30%, E-value=1e-18, Identity=51%"; Hit description =similar to CG10082-PA [Apis mellifera]
MVYLLANWGMGENDTGKSNCAEPTNAAFRRQEQLSCNNDEVDLFPLNNQVGGHTRLMVLNSSTIVKPLNYRELDFYQNIQEQDIKNFVPKYKGKLSNL

SEQ ID NO: 35612 - protein, 174 aa, Diabrotica virgifera
  misc_feature: Coding regions on vcDNA: vcDNA=SeqID_15309; Strand=+; Position=3-524
  misc_feature: Homolog annotation: Hit_ID=NP_524032.2; Match level="QueryCoverage =72%, HitCoverage=52%, E-value=3e-09, Identity=31%"; Hit description =CG18593-PA [Drosophila melanogaster] gb|AAF49974.2| CG18593-PA [Drosophila melanogaster]
  misc_feature (3)..(3): Xaa can be any naturally occurring amino acid
  misc_feature (7)..(7): Xaa can be any naturally occurring amino acid
  misc_feature (12)..(12): Xaa can be any naturally occurring amino acid
  misc_feature (14)..(15): Xaa can be any naturally occurring amino acid
  misc_feature (21)..(28): Xaa can be any naturally occurring amino acid
  misc_feature (32)..(32): Xaa can be any naturally occurring amino acid
  misc_feature (34)..(35): Xaa can be any naturally occurring amino acid
  misc_feature (37)..(38): Xaa can be any naturally occurring amino acid
  misc_feature (41)..(42): Xaa can be any naturally occurring amino acid
  misc_feature (44)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (52)..(52): Xaa can be any naturally occurring amino acid
  misc_feature (54)..(55): Xaa can be any naturally occurring amino acid
  misc_feature (57)..(59): Xaa can be any naturally occurring amino acid
  misc_feature (61)..(63): Xaa can be any naturally occurring amino acid
  misc_feature (65)..(66): Xaa can be any naturally occurring amino acid
  misc_feature (70)..(71): Xaa can be any naturally occurring amino acid
  misc_feature (73)..(78): Xaa can be any naturally occurring amino acid
  misc_feature (80)..(80): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(98): Xaa can be any naturally occurring amino acid
  misc_feature (102)..(102): Xaa can be any naturally occurring amino acid
  misc_feature (104)..(106): Xaa can be any naturally occurring amino acid
  misc_feature (110)..(110): Xaa can be any naturally occurring amino acid
  misc_feature (112)..(112): Xaa can be any naturally occurring amino acid
  misc_feature (115)..(116): Xaa can be any naturally occurring amino acid
  misc_feature (120)..(120): Xaa can be any naturally occurring amino acid
  misc_feature (124)..(124): Xaa can be any naturally occurring amino acid
  misc_feature (129)..(130): Xaa can be any naturally occurring amino acid
  misc_feature (132)..(132): Xaa can be any naturally occurring amino acid
SCXEICXHFNSXEXXKAGEGXXXXXXXXKQGXPXXAXXKEXXKXXAXKXPTXKXXKXXXTXXXPXXPDKXXPXXXXXXEXDXKKQXAGPXEXRGPXXXQEEXEXXXGKTXAXETXXKEDXRPKXKDKTXXEXAETNKTKNTHQGRQEKTNTKERPRSEDKTKKTKKRLFNRNTA

SEQ ID NO: 35613 - protein, 66 aa, Diabrotica virgifera; identical to SEQ ID NO: 26808
  misc_feature: Coding regions on vcDNA: vcDNA=SeqID_15310; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35614 - protein, 34 aa, Diabrotica virgifera
  misc_feature: Coding regions on vcDNA: vcDNA=SeqID_15311; Strand=+; Position=2-106
  misc_feature: Homolog annotation: Hit_ID=NP_524938.1; Match level="QueryCoverage =100%, HitCoverage=13%, E-value=3e-09, Identity=76%"; Hit description= CG4180-PA [Drosophila melanogaster] gb|AAF53433.1| CG4180-PA [Drosophila melanogaster]
GDAFRCASCPYLGMPAFKPGEKIQLVGNQLSDDI

SEQ ID NO: 35615 - protein, 94 aa, Diabrotica virgifera
  misc_feature: Coding regions on vcDNA: vcDNA=SeqID_15312; Strand=+; Position=302-585
  misc_feature: Homolog annotation: Hit_ID=CAA75108.1; Match level="QueryCoverage =67%, HitCoverage=39%, E-value=1e-09, Identity=57%"; Hit description =beta-galactosidase [Phagemid cloning vector pTZ19U]
  misc_feature (75)..(75): Xaa can be any naturally occurring amino acid
TGVSQVGERGSKGSRFTNGGWGGKSFFMGPPNFISGAAVLQGGEGENPGVTHLNRLAALPLFPSGGNSKKARPDXPFPHLRTLKGKGDAPGSGL

SEQ ID NO: 35616 - protein, 307 aa, Diabrotica virgifera
  misc_feature: Coding regions on vcDNA: vcDNA=SeqID_15313; Strand=-; Position=1-921
  misc_feature: Homolog annotation: Hit_ID=XP_393471.1; Match level="QueryCoverage =70%, HitCoverage=23%, E-value=5e-12, Identity=30%"; Hit description =similar to CG1451-PA [Apis mellifera]
MATAFNQEAEMSTSITSAASLELDHVQPPSNMHNSAVGLPRSKLKRKLMVRRALSNSLNNGSSLESLSNLDHINPPSDLLFDMEGSMTSVASLPNDHRADFLINGLINNPQSTQHPIFDLKQPFSELENINPPSLFNEITDFCNSLADVPTEGIGSETEIFEDCFTHVVDEDGTAADVTIAEDMVDGTDSIMETALDNDEDEVTLFSDARSSIESTPKKIRSLSKSMTTKQRRNQARDRYKTYTVAAEMLMREDIEKQREISEHSTLTCTEQFKSATEGYRTATSDSRLADAESNSNSYINSPTYSS

SEQ ID NO: 35617 - protein, 255 aa, Diabrotica virgifera
  misc_feature: Coding regions on vcDNA: vcDNA=SeqID_15314; Strand=+; Position=146-910
  misc_feature: Homolog annotation: Hit_ID=XP_321461.1; Match level="QueryCoverage =100%, HitCoverage=39%, E-value=7e-96, Identity=67%"; Hit description= ENSANGP00000017388 [Anopheles gambiae]
  misc_feature: Gene Ontology Annotation: Molecular function=sodium dependent multivitamin transporter activity; Cellular component=integral to plasma membrane; Biological process=transport
MSKDAKSMVWDYLVFFIFVVASTFVAVYSKCFGPKEKTKADYVFAAGKVSMAAMMLSIARGTLGVRSFLGYPSELFYRGATMWETLYGMVLAYPIVCFIFVPVYFSLGITSVYQYLDMRFKSRLVKQLASGTYIVRALLNQGVTVFTPCVALNTVIGIPYWLSITGISLVSIIFNILGGLKAAIWADVMQGVTMIVVSMAIIFQGCFEAGGPLKVIEVNKEDGRLNFFNFNMDLTARVTTTSAIIGQLFMSLSIF

SEQ ID NO: 35618 - protein, 306 aa, Diabrotica virgifera
  misc_feature: Coding regions on vcDNA: vcDNA=SeqID_15315; Strand=+; Position=3-920
  misc_feature: Homolog annotation: Hit_ID=S42886; Match level="QueryCoverage=92%, HitCoverage=71%, E-value=3e-34, Identity=39%"; Hit description =collagen - silkworm emb|CAA83002.1| Collagen [Bombyx mori]
  misc_feature: Gene Ontology Annotation: Molecular function=extracellular matrix structural constituent conferring tensile strength activity; Cellular component=collagen type III; Biological process =histogenesis and organogenesis
YGQPGQLRYPEISSTPPTGRPGQAGTGTRPDQASGPGQTGGWPGQTGGWPGQTGGWPGQTGGWPGQTGGWPGPIGSPGQIGSPGQTGGWQGQVGSPGQSGGWPGQGLGPGVTGGTNGPISSWPSPVGSPGQGGNWPSPGIPGNVDGRPNTGWPGNLLTPGQVPGPVQSGGWPGQNGGSLPGPGQIGTTGQTGGWAQTPPSGTAGGGIQTGNLPDQGGNVGPGGGSPTGGLPSPVGVPGQNIGWPGQTGTQVSGYPGQMDKVVLGLDKKVEQITLGWSGQPSGNSQIRWVAWTVGTPRGVVKVAALE

SEQ ID NO: 35619 - protein, 184 aa, Diabrotica virgifera
  misc_feature: Coding regions on vcDNA: vcDNA=SeqID_15316; Strand=+; Position=33-587
MTLTIKLVAIFAFAAAATGSPLTTFGKRTPALPTPSKEPDSYQLFQTQLPMELELPKEEANPVPFYAPEPSTDLKAPQESQEPDYYQVPIPNQELAAPIDTEWNPNNDPIYYYEVPAIINNQESPTREFPKKYNEDIHDKKKPFASQPKVEIIFEPISKQQYEEKQIELTKKFDKLIIQAQQTI

SEQ ID NO: 35620 - protein, 192 aa, Diabrotica virgifera
  misc_feature: Coding regions on vcDNA: vcDNA=SeqID_15317; Strand=-; Position=1-576
  misc_feature (4)..(192): Xaa can be any naturally occurring amino acid
QKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35621 - protein, 103 aa, Diabrotica virgifera
  misc_feature: Coding regions on vcDNA: vcDNA=SeqID_15318; Strand=-; Position=67-378
  misc_feature (7)..(13): Xaa can be any naturally occurring amino acid
  misc_feature (84)..(92): Xaa can be any naturally occurring amino acid
KRITYYXXXXXXXGYRYDFGNLFFDCLSTSVEESNVVIVSLLDHCSKQQTKFNIFSKLCILLNKSLIVNIQFLISSRLQYNFHXXXXXXXXXLICIFCHLKSL

SEQ ID NO: 35622 - protein, 114 aa, Diabrotica virgifera
  misc_feature: Coding regions on vcDNA: vcDNA=SeqID_15319; Strand=-; Position=1-342
  misc_feature (16)..(23): Xaa can be any naturally occurring amino acid
MYHSFIFLPRVHISLXXXXXXXXYRVTLPRRRGRFPSPVVLILPCPPWCPILYRSPECGVYSIILAAIPGVTTCGFYLVLSFRFQFSQALQRAVLIFCIMWSQKSYIIRAREKR

SEQ ID NO: 35623 - protein, 85 aa, Diabrotica virgifera
  misc_feature: Coding regions on vcDNA: vcDNA=SeqID_15320; Strand=-; Position=218-475
VHLVIPNTNQSYTKGHIQKILFTCLHTINMPVSISSVPAAALSSPLSSCAVRLIMILDDISVSWGITHGSIEYTVIAFVSPEYPY

SEQ ID NO: 35624 - protein, 203 aa, Diabrotica virgifera
  misc_feature: Coding regions on vcDNA: vcDNA=SeqID_15321; Strand=+; Position=24-635
  misc_feature: Homolog annotation: Hit_ID=EAL32649.1; Match level="QueryCoverage =86%, HitCoverage=77%, E-value=2e-70, Identity=69%"; Hit description =GA18397-PA [Drosophila pseudoobscura]
  misc_feature: Pfam annotation: Pfam_ID=Ribosomal_L22; Match level="Score=-13.5, E -value=0.00013, Copies=1"; Pfam description=Ribosomal protein L22p/L17e
DAWGKILCNSVPVIIQCNHIHSSSTNHAWKNQERNTKKWLKYNDKVYPPQQPDEEPRKAFVCHQRTNIKYSPWKMWYIACLIRGMPVDEAIKQLKFVVKKGAKDVREVLEEAKELAVKEHNVEFASNLWVAESFVGKGAVIKGMRRHARQRFGIVEYVHCHYFVRLEEGQPPEHYYLSHPKEPHEQLEDWLAQMRRRKITNSL

SEQ ID NO: 35625 - protein, 100 aa, Diabrotica virgifera
  misc_feature: Coding regions on vcDNA: vcDNA=SeqID_15322; Strand=-; Position=313-615
  misc_feature (31)..(31): Xaa can be any naturally occurring amino acid
YSLFSIFNHKQKISLKYLIFFKNFTLYNFIXLFNNHIPLINSYNTIYLYIQKYFNLIITTISTNTKHTSHFTHDSYHSKFINLNNLKTTPFTITSIIFSS

SEQ ID NO: 35626 - protein, 91 aa, Diabrotica virgifera
  misc_feature: Coding regions on vcDNA: vcDNA=SeqID_15323; Strand=-; Position=1-273
  misc_feature (31)..(48): Xaa can be any naturally occurring amino acid
CIQHTRLLIRPSLSPFILLIMARPPFVSLVXXXXXXXXXXXXXXXXXXPDVHGFNIPLYIVYPSFKGPSSCSISLGIPSLDYFHSRTRGKK

SEQ ID NO: 35627 - protein, 93 aa, Diabrotica virgifera
  misc_feature: Coding regions on vcDNA: vcDNA=SeqID_15324; Strand=+; Position=92-373
  misc_feature (17)..(24): Xaa can be any naturally occurring amino acid
  misc_feature (33)..(40): Xaa can be any naturally occurring amino acid
QFSPALLVAVLCIEFEXXXXXXXXPFLFSCNAXXXXXXXXLRTGSADQHSKSTIFDSIWSHHQRGVGLLLSARSDKITKAYPRIATDVYGVGD

SEQ ID NO: 35628 - protein, 111 aa, Diabrotica virgifera
  misc_feature: Coding regions on vcDNA: vcDNA=SeqID_15325; Strand=-; Position=282-617
MWGSPQNQAFVRVKELLQKSPCLSCYGPSRQIAVSADPSSFGLGARVMQCIEGKKVIVPYSSLFHFFSEKRYSQIEREDLALTWAADKSLEYIIWDVSIVLETSPHTVRSK

SEQ ID NO: 35629 - protein, 307 aa, Diabrotica virgifera
  misc_feature: Coding regions on vcDNA: vcDNA=SeqID_15326; Strand=-; Position=3-923
  misc_feature: Homolog annotation: Hit_ID=XP_314392.1; Match level="QueryCoverage =99%, HitCoverage=36%, E-value=4e-60, Identity=40%"; Hit description =ENSANGP00000000488 [Anopheles gambiae]
  misc_feature: Pfam annotation: Pfam_ID=RVT_1; Match level="Score=-16.7, E-value =0.0016, Copies=1"; Pfam description=Reverse transcriptase (RNA -dependent
  misc_feature (6)..(6): Xaa can be any naturally occurring amino acid
  misc_feature (19)..(19): Xaa can be any naturally occurring amino acid
  misc_feature (28)..(28): Xaa can be any naturally occurring amino acid
  misc_feature (30)..(30): Xaa can be any naturally occurring amino acid
EAWERXCRVHALYTDFSKXLIGVNHNIXIXKLKQMGVNGPLLEWLRTYLIDRVQMVRIRDFVSSEIKVHSGVPQGSHLGPLLFNIFINDIHHCFRHSSPLLFADDLKFYTIINNTEDCINLQHDLDRLSEWCMLNAMALNESKCHAISFGRSRDPIEYNYNIQNIPVDWVTEIRDLGINLDCKLLFESHYTSKISKSLQMLGFIKRCTRDFQNIDAIKLLYCSLVRPHLEYCSCVWSPSYNIYITKIETVQHKFLRYIAYKLGIPFELNQLNYYQIETQLGILSLRDRRVIKDARMLYGIINSTVLC

SEQ ID NO: 35630 - protein, 227 aa, Diabrotica virgifera
  misc_feature: Coding regions on vcDNA: vcDNA=SeqID_15327; Strand=+; Position=8-691
  misc_feature (1)..(7): Xaa can be any naturally occurring amino acid
  misc_feature (9)..(9): Xaa can be any naturally occurring amino acid
  misc_feature (14)..(34): Xaa can be any naturally occurring amino acid
  misc_feature (37)..(47): Xaa can be any naturally occurring amino acid
  misc_feature (51)..(216): Xaa can be any naturally occurring amino acid
XXXXXXXRXFHKEXXXXXXXXXXXXXXXXXXXXXSRXXXXXXXXXXXACVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVLNINGSPAH

SEQ ID NO: 35631 - protein, 300 aa, Diabrotica virgifera
  misc_feature: Coding regions on vcDNA: vcDNA=SeqID_15328; Strand=+; Position=40-940
  misc_feature: Homolog annotation: Hit_ID=EAA12069.2; Match level="QueryCoverage =97%, HitCoverage=60%, E-value=1e-114, Identity=66%"; Hit description= ENSANGP00000017843 [Anopheles gambiae str. PEST] ref|XP_555900.1| ENSANGP00000017843 [Anopheles gambiae s
  misc_feature: Gene Ontology Annotation: Molecular function=transaminase activity; Cellular component=cellular_component unknown; Biological process =nitrogen metabolism
  misc_feature (233)..(233): Xaa can be any naturally occurring amino acid
  misc_feature (257)..(257): Xaa can be any naturally occurring amino acid
  misc_feature (263)..(263): Xaa can be any naturally occurring amino acid
  misc_feature (278)..(278): Xaa can be any naturally occurring amino acid
  misc_feature (281)..(281): Xaa can be any naturally occurring amino acid
  misc_feature (283)..(283): Xaa can be any naturally occurring amino acid
MATYKPTLTIENLNPCIKVMEYAVRGPLVTRAGEIEKELEKGASKPFKEVIKANIGDCHAMGQVPITFIRQVLALVGYPKLLDDPHFPEDAKERARTILKGCRGSSLGSYTDSPGIEVIRRHVAQYIENRDGIPSDWQNIVISGGASDAIKNVLKLFICRVNGKKPGVMIPIPQYPLYSATLSEFDIDQVGYYLDESKNWGLSLQELERSINEAKKQCNVRAIVVINPGNPTXQVLTKENIQEIVKFAQKEKLFILXDEVYSXNIYDPNSQFHSFKKXMYXMXRTYRSMELASFMSCSQG

SEQ ID NO: 35632 - protein, 85 aa, Diabrotica virgifera
  misc_feature: Coding regions on vcDNA: vcDNA=SeqID_15329; Strand=+; Position=443-700
  misc_feature (78)..(84): Xaa can be any naturally occurring amino acid
CCGQRIQVNLKPVVTYMDISLISLGFQISVSHTGAFRKYPDKRRPEIPQTILRQFNSIHPVRKCFLRELEVFKDGVLXXXXXXXL

SEQ ID NO: 35633 - protein, 157 aa, Diabrotica virgifera
  misc_feature: Coding regions on vcDNA: vcDNA=SeqID_15330; Strand=-; Position=305-778
  misc_feature (74)..(74): Xaa can be any naturally occurring amino acid
  misc_feature (91)..(114): Xaa can be any naturally occurring amino acid
  misc_feature (116)..(116): Xaa can be any naturally occurring amino acid
KKIFYTIPPISFYPPFNHPLLFYSITIFNFKFHPTPSIYFLFSQYITNTSINKLYPIPIYPFILPLLPTLSYTXKFLLKITPLFFKKPNSXXXXXXXXXXXXXXXXXXXXXXXXSXKFSHFLKTSNPKLQFILHLIILFHIYTPQKFINNLLYINLF

SEQ ID NO: 35634 - protein, 129 aa, Diabrotica virgifera
  misc_feature: Coding regions on vcDNA: vcDNA=SeqID_15331; Strand=-; Position=582-971
  misc_feature (1)..(26): Xaa can be any naturally occurring amino acid
  misc_feature (29)..(42): Xaa can be any naturally occurring amino acid
  misc_feature (45)..(99): Xaa can be any naturally occurring amino acid
XXXXXXXXXXXXXXXXXXXXXXXXXXDEXXXXXXXXXXXXXXIRXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 35635 - protein, 76 aa, Diabrotica virgifera
  misc_feature: Coding regions on vcDNA: vcDNA=SeqID_15332; Strand=+; Position=381-611
  misc_feature (6)..(6): Xaa can be any naturally occurring amino acid
  misc_feature (36)..(36): Xaa can be any naturally occurring amino acid
  misc_feature (43)..(43): Xaa can be any naturally occurring amino acid
  misc_feature (52)..(52): Xaa can be any naturally occurring amino acid
  misc_feature (67)..(67): Xaa can be any naturally occurring amino acid
VSVNKXLNVNKYNIDIKEDIFVSLEGGKIFCVLDMXENKNKFXVDLDCKKYXKINIEMGMFRYSRIXYGIVCIDLY

SEQ ID NO: 35636 - protein, 97 aa, Diabrotica virgifera
  misc_feature: Coding regions on vcDNA: vcDNA=SeqID_15333; Strand=+; Position=3-296
  misc_feature: Homolog annotation: Hit_ID=AAF13316.1; Match level="QueryCoverage =100%, HitCoverage=60%, E-value=1e-23, Identity=53%"; Hit description= translation initiation factor 5A [Spodoptera frugiperda] gb|AAF13315.1| translation initiation factor 5A
  misc_feature: Gene Ontology Annotation: Molecular function=translation initiation factor activity; Cellular component=ribosome; Biological process =protein biosynthesis
  misc_feature: Pfam annotation: Pfam_ID=eIF-5a; Match level="Score=12.7, E-value =0.00086, Copies=1"; Pfam description=Eukaryotic initiation factor 5A hypusi
  misc_feature (16)..(16): Xaa can be any naturally occurring amino acid
  misc_feature (30)..(30): Xaa can be any naturally occurring amino acid
  misc_feature (37)..(37): Xaa can be any naturally occurring amino acid
  misc_feature (40)..(40): Xaa can be any naturally occurring amino acid
  misc_feature (91)..(91): Xaa can be any naturally occurring amino acid
  misc_feature (95)..(95): Xaa can be any naturally occurring amino acid
DMFRGKKYEDICNCRXNMDVYNVKCEDYEXKDIYDDXVVXIMYDNGELSEDLKVRDGEVGGRVWVEDGEGKDILCIVMKCCGEEVVIVVKXNNGXDK

SEQ ID NO: 35637 - protein, 208 aa, Diabrotica virgifera
  misc_feature: Coding regions on vcDNA: vcDNA=SeqID_15334; Strand=+; Position=140-763
  misc_feature: Homolog annotation: Hit_ID=AAC47442.1; Match level="QueryCoverage =88%, HitCoverage=59%, E-value=7e-17, Identity=32%"; Hit description =caspase-1 [Spodoptera frugiperda] sp|P89116|ICE1_SPOFR Caspase-1 precursor
  misc_feature: Gene Ontology Annotation: Molecular function=effector caspase activity; Biological process=apoptosis
  misc_feature: Pfam annotation: Pfam_ID=Peptidase_C14; Match level="Score=-83.4, E -value=0.081, Copies=1"; Pfam description=Caspase domain
  misc_feature (117)..(117): Xaa can be any naturally occurring amino acid
  misc_feature (147)..(147): Xaa can be any naturally occurring amino acid
MLQEKLDETQIVVHVAQLATNRSEIPSSPYYLIYPPIRRLCLTIDHEFIHNEYLLTITRTNENCKNHTDYLMALGFYVLDLSDIHLRNSELHIEDSAINQCIKYEWLVLPVLSHVDXQIELATDVPDKPVTLWTSFTAYPCPSLTRXPNIFFLQCCRGKQYDTAIILKTSEPDGEHTSYIMPSETDSLIIYSTLNCVPGTSSHCVNKL

SEQ ID NO: 35638 - protein, 74 aa, Diabrotica virgifera
  misc_feature: Coding regions on vcDNA: vcDNA=SeqID_15335; Strand=+; Position=393-614
  misc_feature (29)..(38): Xaa can be any naturally occurring amino acid
  misc_feature (43)..(43): Xaa can be any naturally occurring amino acid
  misc_feature (55)..(64): Xaa can be any naturally occurring amino acid
FIVCIEIIRNVIRYGILVVSLIGNIIGGXXXXXXXXXXGVILXIYILDILFIVKXXXXXXXXXXCIIEYYVFVV

SEQ ID NO: 35639 - protein, 135 aa, Diabrotica virgifera
  misc_feature: Coding regions on vcDNA: vcDNA=SeqID_15336; Strand=+; Position=2-406
  misc_feature: Homolog annotation: Hit_ID=XP_312843.1; Match level="QueryCoverage =100%, HitCoverage=21%, E-value=1e-26, Identity=51%"; Hit description= ENSANGP00000024697 [Anopheles gambiae] ref|XP_312842.1| ENSANGP00000016630 [Anopheles gambiae]
  misc_feature: Gene Ontology Annotation: Molecular function=hydrogen-transporting ATPase activity, rotational mechanism; Cellular component=integral to plasma membrane; Biological process=transport
  misc_feature (5)..(5): Xaa can be any naturally occurring amino acid
  misc_feature (10)..(10): Xaa can be any naturally occurring amino acid
  misc_feature (18)..(18): Xaa can be any naturally occurring amino acid
  misc_feature (21)..(22): Xaa can be any naturally occurring amino acid
  misc_feature (25)..(27): Xaa can be any naturally occurring amino acid
  misc_feature (32)..(32): Xaa can be any naturally occurring amino acid
  misc_feature (39)..(39): Xaa can be any naturally occurring amino acid
  misc_feature (44)..(44): Xaa can be any naturally occurring amino acid
  misc_feature (46)..(46): Xaa can be any naturally occurring amino acid
  misc_feature (50)..(50): Xaa can be any naturally occurring amino acid
  misc_feature (58)..(59): Xaa can be any naturally occurring amino acid
  misc_feature (63)..(63): Xaa can be any naturally occurring amino acid
  misc_feature (71)..(71): Xaa can be any naturally occurring amino acid
  misc_feature (77)..(77): Xaa can be any naturally occurring amino acid
  misc_feature (80)..(80): Xaa can be any naturally occurring amino acid
  misc_feature (82)..(83): Xaa can be any naturally occurring amino acid
  misc_feature (89)..(89): Xaa can be any naturally occurring amino acid
  misc_feature (95)..(95): Xaa can be any naturally occurring amino acid
  misc_feature (111)..(112): Xaa can be any naturally occurring amino acid
  misc_feature (126)..(126): Xaa can be any naturally occurring amino acid
  misc_feature (131)..(132): Xaa can be any naturally occurring amino acid
EILGXLVEMXVDWGYKVXLGXXLDXXXESGGXVKCLGNXEREGXVXIVGXVLFCGGDXXRCVXSDIVGIVXVLWGLXKKXLXXVSSCFXVDWVGXLLKYLRELEEFYDKNXXEFIFVRNKVKEIFXEEDDXXEIV

SEQ ID NO: 35640 - protein, 68 aa, Diabrotica virgifera
  misc_feature: Coding regions on vcDNA: vcDNA=SeqID_15337; Strand=-; Position=196-402
AKKAFLIGISSRRPRLPDILKTKLLPYNLSVRIMLVTILSVEIERSGDPLNVCTGIEKYCFRRLTVVH

SEQ ID NO: 35641 - protein, 309 aa, Diabrotica virgifera
  misc_feature: Coding regions on vcDNA: vcDNA=SeqID_15338; Strand=-; Position=1-927
  misc_feature (1)..(102): Xaa can be any naturally occurring amino acid
  misc_feature (106)..(260): Xaa can be any naturally occurring amino acid
  misc_feature (263)..(293): Xaa can be any naturally occurring amino acid
  misc_feature (295)..(305): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTXXXXXXXXXXXXXXXXXXXXXXXXXXXXXXXLXXXXXXXXXXXASGR

SEQ ID NO: 35642 - protein, 70 aa, Diabrotica virgifera
  misc_feature: Coding regions on vcDNA: vcDNA=SeqID_15339; Strand=+; Position=45-254
  misc_feature: Homolog annotation: Hit_ID=EAL34103.1; Match level="QueryCoverage =98%, HitCoverage=8%, E-value=2e-12, Identity=52%"; Hit description =GA20295-PA [Drosophila pseudoobscura]
  misc_feature: Gene Ontology Annotation: Molecular function=ubiquinol-cytochrome c reductase activity; Cellular component=respiratory chain complex III (sensu Eukarya); Biological process=electron transport
  misc_feature (29)..(29): Xaa can be any naturally occurring amino acid
  misc_feature (33)..(33): Xaa can be any naturally occurring amino acid
FNDSEDGRKNFSYLMGGGVGVGGEYGEKXWCKXFISCMREYGDVLDLGKIEIKIYDMIEGKCVRFKWRGK

SEQ ID NO: 35643 - protein, 171 aa, Diabrotica virgifera
  misc_feature: Coding regions on vcDNA: vcDNA=SeqID_15340; Strand=+; Position=62-577
  misc_feature (104)..(111): Xaa can be any naturally occurring amino acid
MCDCPIAGVIASHEAYRSWIIFKECKTESGTASSIQAGVESSSTENLHDNQDTSNIKVLLDSLDPHLRPVTPDYSDPQSVALLNEHIQLAEEYWKVQTELVLLXXXXXXXXAAKEEDERRKINLEHLQEEKESLMLARDLLRQQRSSSPAGDSSEGSAENWVIVPRREQQS

SEQ ID NO: 35644 - protein, 105 aa, Diabrotica virgifera
  misc_feature: Coding regions on vcDNA: vcDNA=SeqID_15341; Strand=-; Position=3-317
  misc_feature (5)..(13): Xaa can be any naturally occurring amino acid
  misc_feature (17)..(49): Xaa can be any naturally occurring amino acid
  misc_feature (51)..(105): Xaa can be any naturally occurring amino acid
ERTSXXXXXXXXXLKIXXXXXXXXXXXXXXXXXXXXXXXXXXXXXXXXXTXXXXXXXXXXXXXXXXXXXXXXXXXXXXXXXXXXXXXXXXXXXXXXXXXXXXXXX

SEQ ID NO: 35645 - protein, 320 aa, Diabrotica virgifera
  misc_feature: Coding regions on vcDNA: vcDNA=SeqID_15342; Strand=-; Position=3-962
  misc_feature (3)..(27): Xaa can be any naturally occurring amino acid
  misc_feature (33)..(72): Xaa can be any naturally occurring amino acid
  misc_feature (83)..(84): Xaa can be any naturally occurring amino acid
  misc_feature (90)..(90): Xaa can be any naturally occurring amino acid
  misc_feature (93)..(102): Xaa can be any naturally occurring amino acid
  misc_feature (112)..(265): Xaa can be any naturally occurring amino acid
  misc_feature (268)..(306): Xaa can be any naturally occurring amino acid
  misc_feature (312)..(313): Xaa can be any naturally occurring amino acid
  misc_feature (316)..(317): Xaa can be any naturally occurring amino acid
PPXXXXXXXXXXXXXXXXXXXXXXXXXSISSFXXXXXXXXXXXXXXXXXXXXXXXXXXXXXXXXXXXXXXXXIILPYHYQNTXXIQINHXPTXXXXXXXXXXFLINTSKKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHXXXXXXXXXXXXXXXXXXXXXXXXXXXXXXXXXXXXXXXKKIPIXXNSXXAFK

SEQ ID NO: 35646 - protein, 147 aa, Diabrotica virgifera
  misc_feature: Coding regions on vcDNA: vcDNA=SeqID_15343; Strand=+; Position=49-489
  misc_feature: Homolog annotation: Hit_ID=CAE46725.1; Match level="QueryCoverage =93%, HitCoverage=36%, E-value=9e-34, Identity=62%"; Hit description =beta actin [Homarus gammarus] gb|AAG16253.1| beta-actin [Litopenaeus vannamei] dbj|BAB41102.1| actin [Mars
  misc_feature: Gene Ontology Annotation: Biological process=reproduction
  misc_feature (9)..(10): Xaa can be any naturally occurring amino acid
  misc_feature (16)..(16): Xaa can be any naturally occurring amino acid
  misc_feature (19)..(19): Xaa can be any naturally occurring amino acid
  misc_feature (30)..(30): Xaa can be any naturally occurring amino acid
  misc_feature (90)..(90): Xaa can be any naturally occurring amino acid
KERTTKDNXXDDEGAXQDXDNVSGRRKAGXAGEDAPRADSPANGGRPRHQGDRAGTGQKDPDEGEEAQSKRGSHTPKDPKEHGSSTNRDXTEKSRQHTPNKEHREAPEEHPDHHTEAPLNPKANREKTTQSKEETNNTPARDEAIQA

SEQ ID NO: 35647 - protein, 153 aa, Diabrotica virgifera
  misc_feature: Coding regions on vcDNA: vcDNA=SeqID_15344; Strand=+; Position=127-586
  misc_feature: Homolog annotation: Hit_ID=AAP57194.1; Match level="QueryCoverage =100%, HitCoverage=72%, E-value=3e-28, Identity=42%"; Hit description= ferritin [Leptinotarsa decemlineata]
  misc_feature: Gene Ontology Annotation: Molecular function=ferrous iron binding; Cellular component=ferritin complex; Biological process=iron ion homeostasis
  misc_feature (27)..(27): Xaa can be any naturally occurring amino acid
  misc_feature (44)..(44): Xaa can be any naturally occurring amino acid
  misc_feature (79)..(79): Xaa can be any naturally occurring amino acid
  misc_feature (85)..(85): Xaa can be any naturally occurring amino acid
  misc_feature (109)..(109): Xaa can be any naturally occurring amino acid
GIQADTMKCDHQQLNIPKDGDRDEQSXVKNMIGQEEEELIAAMXHMIVGAYFTRHTANRPGRADLFFKTPRAQREPAIXRGSLIXMGGQVTTSVNDILERNHAPALITXQNDESALTNILNLEATFTTKNKNVIEGYEDGSYFEDYHHVDYLN

SEQ ID NO: 35648 - protein, 172 aa, Diabrotica virgifera
  misc_feature: Coding regions on vcDNA: vcDNA=SeqID_15345; Strand=+; Position=275-790
  misc_feature: Homolog annotation: Hit_ID=EAL28175.1; Match level="QueryCoverage =87%, HitCoverage=30%, E-value=4e-27, Identity=48%"; Hit description =GA15276-PA [Drosophila pseudoobscura]
MANLNFTRNIGGNNLGRTSVSFGSNSMSGHVTPVLGQRIPSERRALPTMGNANQMGHMSTLGGYSSFNSVFGSGDTNTPSLLDFNEFPSLTNRNSGDNLPQPSPMPGGKPYVGMVKQPTSESSEFTMSSEDFPALPGTQNREGASPGSNASGDKGVSGGAGDGVNSRRKETR

SEQ ID NO: 35649 - protein, 73 aa, Diabrotica virgifera
  misc_feature: Coding regions on vcDNA: vcDNA=SeqID_15346; Strand=+; Position=3-224
  misc_feature (6)..(6): Xaa can be any naturally occurring amino acid
  misc_feature (8)..(10): Xaa can be any naturally occurring amino acid
  misc_feature (12)..(14): Xaa can be any naturally occurring amino acid
VRGIIXYXXXRXXXIFIFICIFHRNCLFCFIVIEIVQQNFPRHWIRRRSIIKWPPQSPDLTLLDFLWELLVKQ

SEQ ID NO: 35650 - protein, 234 aa, Diabrotica virgifera
  misc_feature: Coding regions on vcDNA: vcDNA=SeqID_15347; Strand=+; Position=106-807
  misc_feature: Homolog annotation: Hit_ID=XP_308390.1; Match level="QueryCoverage =90%, HitCoverage=48%, E-value=2e-38, Identity=38%"; Hit description =ENSANGP00000009437 [Anopheles gambiae]
  misc_feature: Gene Ontology Annotation: Molecular function=permease activity; Cellular component=cellular_component unknown; Biological process =biological_process unknown
MTVLAYENLFKGTLFQLLAVLSGTLNAISDGMQYGWTAPVLPILLGPDSPVPITEWEGEMLETFLWVGSLSCLPLTMYLVDKIGRKNSILLAAVLTLTVWVITALAPSVEYLYVARFLAGTASNTAYVSTPMYIAEIAEQKIRGFLSSLIYLMMLLGIFLIYAVAPYIPYYAHCTLGAILACLELGIFPFMPESPYFLVFKGKHEEAKKSLEWLRPEGADVGTELNEINAAIER

SEQ ID NO: 35651 - protein, 130 aa, Diabrotica virgifera
  misc_feature: Coding regions on vcDNA: vcDNA=SeqID_15348; Strand=+; Position=116-506
  misc_feature: Homolog annotation: Hit_ID=XP_311433.1; Match level="QueryCoverage =86%, HitCoverage=21%, E-value=7e-23, Identity=52%"; Hit description =ENSANGP00000018445 [Anopheles gambiae]
  misc_feature: Gene Ontology Annotation: Cellular component=Golgi vesicle; Biological process=intracellular protein transport
  misc_feature (36)..(36): Xaa can be any naturally occurring amino acid
  misc_feature (74)..(74): Xaa can be any naturally occurring amino acid
  misc_feature (76)..(76): Xaa can be any naturally occurring amino acid
MQHSTAQCKIIAIGTLLFVDMTQVIIECKLPAFPTXFTTGTQDTFVETYSPLYGYQPLEKLDMYRITTTSNCIXRXLDALRLSTKVIPEYWQSLYDDEIAQNEFSLIYAFDDITVSSDKYSANLSRIRTF

SEQ ID NO: 35652 - protein, 306 aa, Diabrotica virgifera
  misc_feature: Coding regions on vcDNA: vcDNA=SeqID_15349; Strand=+; Position=48-964
  misc_feature: Homolog annotation: Hit_ID=NP_957400.1; Match level="QueryCoverage =93%, HitCoverage=68%, E-value=3e-90, Identity=61%"; Hit description =similar to bystin-like [Danio rerio] gb|AAH53134.1| Similar to bystin-like [Danio rerio]
  misc_feature: Gene Ontology Annotation: Molecular function=snoRNA binding; Cellular component=cytoplasm; Biological process=cell adhesion
  misc_feature: Pfam annotation: Pfam_ID=Bystin; Match level="Score=331.8, E-value =9.8e-97, Copies=1"; Pfam description=Bystin
  misc_feature (97)..(102): Xaa can be any naturally occurring amino acid
  misc_feature (283)..(283): Xaa can be any naturally occurring amino acid
  misc_feature (296)..(296): Xaa can be any naturally occurring amino acid
SKRKNVPLEQDIQNTLFIRLRVDANLSRKILSAARSQQRELEENTPQQSKNKFVSLDAMDSDESDEAEDDTVDDAYYENIEINEDDEKAIDMFMSKXXXXXXTLADIIMEKITEKQTELDTHFSDAGSMQVQDLDVKVKQMYEGVRDVLRKYRSGKLPKAFKIIPKLKNWEQILYITDPPTWSAAAMYQATRIFASNLKENMAQRFYNLVLLPRIRDDLMEYKRLNFHLYQALRKSLFTPGAFMKGILLPLLESGNCTLRETIIIGSVGAKNSIPILHPSAAXLKIAEMDYTGANXSIFFRKFLNK

SEQ ID NO: 35653 - protein, 270 aa, Diabrotica virgifera
  misc_feature: Coding regions on vcDNA: vcDNA=SeqID_15350; Strand=-; Position=1-810
  misc_feature (4)..(269): Xaa can be any naturally occurring amino acid
SKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 35654 - protein, 121 aa, Diabrotica virgifera
  misc_feature: Coding regions on vcDNA: vcDNA=SeqID_15351; Strand=-; Position=279-644
DCPHFFSVNIMKGVICRVIFSSSIIYPFYCTGHISSLKCSTFYISVLNISSMNFVSDGTEIVTKPIYKIIGSRFQYLITEFSKFIISQRWQYTLSLYCNFARYIYCLLSTLKVYCFSNYYP

SEQ ID NO: 35655 - protein, 162 aa, Diabrotica virgifera
  misc_feature: Coding regions on vcDNA: vcDNA=SeqID_15352; Strand=+; Position=2-490
  misc_feature: Homolog annotation: Hit_ID=XP_391961.1; Match level="QueryCoverage =100%, HitCoverage=11%, E-value=3e-64, Identity=80%"; Hit description= similar to putative tropomyosin [Apis mellifera]
  misc_feature: Gene Ontology Annotation: Molecular function=molecular_function unknown; Cellular component=muscle thin filament tropomyosin; Biological process=pole plasm oskar mRNA localization
  misc_feature: Pfam annotation: Pfam_ID=Tropomyosin; Match level="Score=142.0, E -value=1.4e-39, Copies=1"; Pfam description=Tropomyosin
  misc_feature (50)..(59): Xaa can be any naturally occurring amino acid
  misc_feature (70)..(75): Xaa can be any naturally occurring amino acid
  misc_feature (107)..(115): Xaa can be any naturally occurring amino acid
SSRMCKVLENRSQQDEERMDQLTNQLKEARLLAEDADNKSDEVSRKLAFXXXXXXXXXXRVKGGDAKIMXXXXXXKVVGNSLKSLEVSEEKANQRVEEFKKQLKSLXXXXXXXXXRAEFAEKTVKKLQKEVDRLEDELGINKDRYKSLADEMDSTFAELAGY

SEQ ID NO: 35656 - protein, 163 aa, Diabrotica virgifera
  misc_feature: Coding regions on vcDNA: vcDNA=SeqID_15353; Strand=-; Position=348-839
KKKYERGGDGRKEGGGRMEDVSRGGRWGFGGGGVLGRSGEKGEEDRGGEKRGGGGSSRDNLHTEIIAQQKNYQGAPVRGVPNKRLFVSNPDFARFSFKKHGAEVTVFCEGGNSVVDDHLRSILAANPYIRCQHNQKLKVRPELAIYHTVLSISRNKPFLEECH

SEQ ID NO: 35657 - protein, 198 aa, Diabrotica virgifera
  misc_feature: Coding regions on vcDNA: vcDNA=SeqID_15354; Strand=+; Position=220-813
  misc_feature: Homolog annotation: Hit_ID=XP_393121.1; Match level="QueryCoverage =79%, HitCoverage=25%, E-value=8e-74, Identity=75%"; Hit description =similar to calpain-C [Apis mellifera]
  misc_feature: Gene Ontology Annotation: Molecular function=signal transducer activity; Cellular component=intracellular; Biological process =muscle development
  misc_feature: Pfam annotation: Pfam_ID=Peptidase_C2; Match level="Score=26.7, E -value=1.3e-15, Copies=1"; Pfam description=Calpain family cysteine protease
  misc_feature (56)..(56): Xaa can be any naturally occurring amino acid
MSEYDRIRRACLKRGELWEDPDFPASQSSVFYHQTPPFQFTWKRPKELCNRPNFIXDAPTSFDISPGKMGDRWLVSCLGILYLNKGLFYRVVPADQSFFGEQYCGVFRFRLWWCGEWTEVLVDDRLPTVHGKLAFLQSHTDNFWPGLLEKAYAKLHGSLIGRSSRPHGGNNRKHSSSTRHQFVREVTIQIYWTWTSIR

SEQ ID NO: 35658 - protein, 40 aa, Diabrotica virgifera
  misc_feature: Coding regions on vcDNA: vcDNA=SeqID_15355; Strand=+; Position=93-212
FRCYEDQFSPFKCFEEAKSNMRYISKTLLDVYRPDENDST

SEQ ID NO: 35659 - protein, 227 aa, Diabrotica virgifera
  misc_feature: Coding regions on vcDNA: vcDNA=SeqID_15356; Strand=+; Position=2-685
  misc_feature (3)..(200): Xaa can be any naturally occurring amino acid
  misc_feature (214)..(222): Xaa can be any naturally occurring amino acid
PLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGHIFFSCLFKTCXXXXXXXXXPCPLN

SEQ ID NO: 35660 - protein, 185 aa, Diabrotica virgifera
  misc_feature: Coding regions on vcDNA: vcDNA=SeqID_15357; Strand=+; Position=2-559
  misc_feature: Homolog annotation: Hit_ID=NP_491240.1; Match level="QueryCoverage =94%, HitCoverage=13%, E-value=8e-29, Identity=35%"; Hit description =zn-finger, CCHC type and RNA-directed DNA polymerase  and Integrase, catalytic domain
KQQHDKCLYQVLERARINNVKFNYEKCSFGVKNVKFLGFNYNKDGQSVDSDKIKAIQDMKKPENKKDIQRLLGMITYLSKHIKNLSDLTAPLRELIKENVEWHWSHKHDECFSKIKEIISKSPVLRHFDINEKCLISVDCSKDSIGAVLLQKGQPVAYISKALTLTQQNYAQFEKEPSCSSADMC

SEQ ID NO: 35661 - protein, 299 aa, Diabrotica virgifera
  misc_feature: Coding regions on vcDNA: vcDNA=SeqID_15358; Strand=+; Position=1-897
  misc_feature: Homolog annotation: Hit_ID=XP_313621.1; Match level="QueryCoverage =99%, HitCoverage=67%, E-value=2e-60, Identity=41%"; Hit description =ENSANGP00000024261 [Anopheles gambiae]
  misc_feature: Pfam annotation: Pfam_ID=RVT_1; Match level="Score=51.8, E-value=1.9e- 12, Copies=1"; Pfam description=Reverse transcriptase (RNA-dependent
NIIGEYQCGFRRGRSTTDQIFVIRELQAESYEHNLPTIALFIDFQQAYDRIKRKNLKQALEELGVSRKLRNMIHITLENTENRVKINNQSSDTFIVNEGVRQGDPLSSLLFNLCLEKIMREAKINREALLYQKRHQVLAFADDVVLLARGTKELQEIVQRIVKAAKKMGLYINETKTKCMEWTDGQFRNGQKLKVEVEEGTSYEFEMVERFTYLGAIISRKPNIKEEIQARIMAGNKSVHALNGMLKSKFLSRKAKIQLYKTTIQPIVTYCSETWTMTKNEQSLLEIWERKILRKIYGG

SEQ ID NO: 35662 - protein, 58 aa, Diabrotica virgifera
  misc_feature: Coding regions on vcDNA: vcDNA=SeqID_15359; Strand=+; Position=544-717
RPLPTTKKTITCTNITVHLIYSPLYIIIYVRDLGRHCCPITKTPCIHFTSNSITHFLR

SEQ ID NO: 35663 - protein, 82 aa, Diabrotica virgifera
  misc_feature: Coding regions on vcDNA: vcDNA=SeqID_15360; Strand=-; Position=223-471
FAASRIELVFSSQTNKYVSTSVELFLKRCQKFIRFHHLLYIYLFIYFMDIPFLQKYNINLYNALVALKRSKPKLKLNKIQLN

SEQ ID NO: 35664 - protein, 202 aa, Diabrotica virgifera
  misc_feature: Coding regions on vcDNA: vcDNA=SeqID_15361; Strand=+; Position=3-611
  misc_feature (9)..(10): Xaa can be any naturally occurring amino acid
  misc_feature (123)..(132): Xaa can be any naturally occurring amino acid
SVETTSKNXXHLELFSTFFGASNASVRINFGRCGAGGFTCSTYPKTNTLAVYYNCVGDDVSLYINQFSSPSNIETLLIQNCVNLTISFRCTGENKNILGLVVRNVKRLKIEPQQYTSHVPTSXXXXXXXXXXEIPKDTFAQIQKTTHSYGCIIPKKDFYALSVKNVTIDTVGSRAFQMPENFGNFTFPDGKINRVQTFKFFG

SEQ ID NO: 35665 - protein, 215 aa, Diabrotica virgifera
  misc_feature: Coding regions on vcDNA: vcDNA=SeqID_15362; Strand=+; Position=120-766
  misc_feature: Homolog annotation: Hit_ID=XP_317022.1; Match level="QueryCoverage =97%, HitCoverage=51%, E-value=4e-65, Identity=58%"; Hit description =ENSANGP00000019266 [Anopheles gambiae]
  misc_feature: Gene Ontology Annotation: Molecular function=electron transporter activity; Cellular component=nucleus; Biological process=induction of apoptosis
  misc_feature: Pfam annotation: Pfam_ID=WW; Match level="Score=80.3, E-value=5.1e -21, Copies=2"; Pfam description=WW domain
  misc_feature (129)..(135): Xaa can be any naturally occurring amino acid
  misc_feature (156)..(156): Xaa can be any naturally occurring amino acid
  misc_feature (197)..(197): Xaa can be any naturally occurring amino acid
MNLPESDSEDELPPGWEERVTVDGSVFYANHLTKNTQWTHPRTGKKKKVSGDLPFGWQRCVDKNTGKVIYVDHENRRTTYTDPRLAFAVEEKEHVNDYRQRFDASSTALQVLHGRDLNGKTALVTGANXXXXXXXARSLAKHGCSVIMACRNLAAXKKAINQIREDKPAAGENCIAIYLDLTSLSSVVQFANTVYKXFDKIHMLILKRKCFWFFL

SEQ ID NO: 35666 - protein, 110 aa, Diabrotica virgifera
  misc_feature: Coding regions on vcDNA: vcDNA=SeqID_15363; Strand=+; Position=3-335
  misc_feature: Homolog annotation: Hit_ID=XP_393098.1; Match level="QueryCoverage =97%, HitCoverage=32%, E-value=5e-13, Identity=39%"; Hit description =similar to ENSANGP00000022305 [Apis mellifera]
VSVKSLLSRDQKGDLIAGIYFKLLQNGDEFTIFYQNMGKQRIKLRFSDFMKPEIDKGLLEKISICNEQLNLPENKLLNIIRTSGTILRDTSFLLQLLDVDRCISILSANN

SEQ ID NO: 35667 - protein, 19 aa, Diabrotica virgifera
  misc_feature: Coding regions on vcDNA: vcDNA=SeqID_15364; Strand=+; Position=1-57
  misc_feature (11)..(18): Xaa can be any naturally occurring amino acid
QQAGKNPLKSXXXXXXXXP

SEQ ID NO: 35668 - protein, 68 aa, Diabrotica virgifera
  misc_feature: Coding regions on vcDNA: vcDNA=SeqID_15365; Strand=-; Position=559-765
  misc_feature (27)..(27): Xaa can be any naturally occurring amino acid
MKIDRGVQQGDTLSPKLFITVMEYAFXGLGCDSKVINIDGKKLNHLRYSNDIVLTTDDLGEAIIMLQQ

SEQ ID NO: 35669 - protein, 70 aa, Diabrotica virgifera
  misc_feature: Coding regions on vcDNA: vcDNA=SeqID_15366; Strand=-; Position=23-235
LYNMPPLSSVLSNPHSILHAHSFQVSCYIFSLPESRASVCSSSSWDFLPYHPYCSLVRMSFEVSSPIVFI

SEQ ID NO: 35670 - protein, 63 aa, Diabrotica virgifera
  misc_feature: Coding regions on vcDNA: vcDNA=SeqID_15367; Strand=+; Position=100-291
  misc_feature (3)..(5): Xaa can be any naturally occurring amino acid
  misc_feature (11)..(11): Xaa can be any naturally occurring amino acid
  misc_feature (13)..(14): Xaa can be any naturally occurring amino acid
  misc_feature (19)..(19): Xaa can be any naturally occurring amino acid
  misc_feature (25)..(25): Xaa can be any naturally occurring amino acid
  misc_feature (30)..(30): Xaa can be any naturally occurring amino acid
  misc_feature (36)..(38): Xaa can be any naturally occurring amino acid
  misc_feature (42)..(42): Xaa can be any naturally occurring amino acid
RDXXXDYLIEXSXXKGNGXSDKEIXEEVNXIMFEGXXXIDVXFSFVIRLLGMNEEVEERGNLN

SEQ ID NO: 35671 - protein, 73 aa, Diabrotica virgifera
  misc_feature: Coding regions on vcDNA: vcDNA=SeqID_15368; Strand=+; Position=9-230
AKQEYDEYLENYLLAVRKYCVKEDPSTIASARKTLNRLYFLDLLKDILLYGLLLWLFYGFVTRLLVAVGNPLV

SEQ ID NO: 35672 - protein, 51 aa, Diabrotica virgifera
  misc_feature: Coding regions on vcDNA: vcDNA=SeqID_15369; Strand=+; Position=15-170
LNFFLILGPNLQNPTGPDNALVTASLASLPPLLESFMVVYHNIWLYYLINC

SEQ ID NO: 35673 - protein, 112 aa, Diabrotica virgifera
  misc_feature: Coding regions on vcDNA: vcDNA=SeqID_15370; Strand=-; Position=1-336
  misc_feature (5)..(112): Xaa can be any naturally occurring amino acid
RVILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35674 - protein, 166 aa, Diabrotica virgifera
  misc_feature: Coding regions on vcDNA: vcDNA=SeqID_15371; Strand=+; Position=20-517
  misc_feature (3)..(5): Xaa can be any naturally occurring amino acid
  misc_feature (8)..(8): Xaa can be any naturally occurring amino acid
  misc_feature (15)..(16): Xaa can be any naturally occurring amino acid
  misc_feature (22)..(23): Xaa can be any naturally occurring amino acid
  misc_feature (25)..(25): Xaa can be any naturally occurring amino acid
  misc_feature (27)..(28): Xaa can be any naturally occurring amino acid
  misc_feature (31)..(32): Xaa can be any naturally occurring amino acid
  misc_feature (34)..(34): Xaa can be any naturally occurring amino acid
  misc_feature (40)..(40): Xaa can be any naturally occurring amino acid
  misc_feature (42)..(43): Xaa can be any naturally occurring amino acid
  misc_feature (45)..(46): Xaa can be any naturally occurring amino acid
  misc_feature (51)..(53): Xaa can be any naturally occurring amino acid
  misc_feature (60)..(66): Xaa can be any naturally occurring amino acid
  misc_feature (69)..(69): Xaa can be any naturally occurring amino acid
  misc_feature (71)..(71): Xaa can be any naturally occurring amino acid
  misc_feature (76)..(76): Xaa can be any naturally occurring amino acid
  misc_feature (78)..(78): Xaa can be any naturally occurring amino acid
  misc_feature (84)..(84): Xaa can be any naturally occurring amino acid
  misc_feature (90)..(90): Xaa can be any naturally occurring amino acid
  misc_feature (93)..(93): Xaa can be any naturally occurring amino acid
  misc_feature (96)..(96): Xaa can be any naturally occurring amino acid
  misc_feature (110)..(110): Xaa can be any naturally occurring amino acid
  misc_feature (133)..(133): Xaa can be any naturally occurring amino acid
RWXXXEEXPLRGPKXXQGRRRXXKXTXXKPXXRXRRQRNXNXXGXXRERRXXXGRRAEEXXXXXXXTAXPXTEKRXEXRRKHTXTTKRTXHNXKRXSQTKPQRKRGRTGXNKARRKRATTDTTRRERSRQKGXPRQTTRKTTPKNDQTQTKQKGKEAGGKSPRQAQ

SEQ ID NO: 35675 - protein, 151 aa, Diabrotica virgifera
  misc_feature: Coding regions on vcDNA: vcDNA=SeqID_15372; Strand=+; Position=31-485
  misc_feature: Homolog annotation: Hit_ID=S50068; Match level="QueryCoverage=82%, HitCoverage=31%, E-value=4e-28, Identity=53%"; Hit description =nonhistone chromosomal protein HMG1-like protein - fruit fly (Drosophila melanogaster)
  misc_feature: Gene Ontology Annotation: Molecular function=DNA bending activity; Biological process=development
  misc_feature: Pfam annotation: Pfam_ID=HMG_box; Match level="Score=-9.8, E-value =0.084, Copies=1"; Pfam description=HMG (high mobility group) box
  misc_feature (42)..(42): Xaa can be any naturally occurring amino acid
  misc_feature (47)..(47): Xaa can be any naturally occurring amino acid
  misc_feature (57)..(57): Xaa can be any naturally occurring amino acid
  misc_feature (72)..(72): Xaa can be any naturally occurring amino acid
SLHLLILSLAPIPHEGKTPRANVDARPILRLTAYAFFVLTCXNSPKXKHPDYHVFLXSEFSKKCAKRRKTVXDKEKKCVLYMYAYNKKRYDAEMQSYCPPMGEKQRDKNRKQLSDPNAPKRTLSAFFWIIYDEYDISSAPTHEYVGAHIDS

SEQ ID NO: 35676 - protein, 77 aa, Diabrotica virgifera
  misc_feature: Coding regions on vcDNA: vcDNA=SeqID_15373; Strand=+; Position=7-240
  misc_feature (24)..(30): Xaa can be any naturally occurring amino acid
KHEDYLCFGHFSLRRSYRQRPKEXXXXXXXVKELCQVLPGDLKKLCEDKLIPAIDQMYNQVEDTPPRDLCVELEFCN

SEQ ID NO: 35677 - protein, 109 aa, Diabrotica virgifera
  misc_feature: Coding regions on vcDNA: vcDNA=SeqID_15374; Strand=+; Position=1-327
  misc_feature (20)..(20): Xaa can be any naturally occurring amino acid
  misc_feature (34)..(35): Xaa can be any naturally occurring amino acid
  misc_feature (57)..(57): Xaa can be any naturally occurring amino acid
PHQHAPTRQKKRSSERTANXETKQQTTTNKKKEXXQKTTRNSKAEKTTRRKTKPTTXAQNHKKRRRKGTRKNPASNTALRTRTTRKEHLMGGQQRRGNSNNRTRKKRRQ

SEQ ID NO: 35678 - protein, 197 aa, Diabrotica virgifera
  misc_feature: Coding regions on vcDNA: vcDNA=SeqID_15375; Strand=-; Position=141-734
  misc_feature: Pfam annotation: Pfam_ID=PHD; Match level="Score=0.2, E-value=0.036, Copies=1"; Pfam description=PHD-finger
KIAAEKEERKRQRLEKKAVTVSKISKKVKSLKTAKKEKTQSKKPEKSITREIKDDDKPKMLNKLTEQPILPEKDSFNTCEDNWLLDKFLSDIPSSSSFQDNKKCDLKNIAIEKVKKSLFTDEVMETYKNNSLFKNPKLTEGLCFSCTYNFKEQNLGIKCNFCRRAYHISCINRLNMHKSNSQTFSCNICLKNQHKIN

SEQ ID NO: 35679 - protein, 162 aa, Diabrotica virgifera
  misc_feature: Coding regions on vcDNA: vcDNA=SeqID_15376; Strand=+; Position=104-592
  misc_feature: Pfam annotation: Pfam_ID=F-box; Match level="Score=35.2, E-value=2e -07, Copies=1"; Pfam description=F-box domain
QKSYLETPQKLKTSMTVVLERANNVRIPLNKLRKSLSIVLKRKNLVKEQRVAKVYISKMDLESAGTSNGVPPKKKFKYSIGKNSNKSLASLPKVVLQRIFTYLDVRSIQNCAILCSTFYNLSKDSSLYKNIEFKFIEMSPPSYKILYFKSYKPKNHRNIVRK

SEQ ID NO: 35680 - protein, 164 aa, Diabrotica virgifera
  misc_feature: Coding regions on vcDNA: vcDNA=SeqID_15377; Strand=+; Position=11-506
  misc_feature: Homolog annotation: Hit_ID=XP_396195.1; Match level="QueryCoverage =88%, HitCoverage=16%, E-value=4e-50, Identity=65%"; Hit description =similar to ENSANGP00000016886 [Apis mellifera]
  misc_feature: Gene Ontology Annotation: Molecular function=helicase activity; Cellular component=nucleus; Biological process=chromatin modeling
  misc_feature: Pfam annotation: Pfam_ID=SNF2_N; Match level="Score=-48.0, E-value =6.7e-06, Copies=1"; Pfam description=SNF2 family N-terminal domain
  misc_feature (23)..(25): Xaa can be any naturally occurring amino acid
  misc_feature (27)..(27): Xaa can be any naturally occurring amino acid
  misc_feature (33)..(33): Xaa can be any naturally occurring amino acid
  misc_feature (35)..(35): Xaa can be any naturally occurring amino acid
  misc_feature (100)..(100): Xaa can be any naturally occurring amino acid
  misc_feature (130)..(130): Xaa can be any naturally occurring amino acid
PVKRKEREGKGAPLKERGRDEGXXXKXEKAKGXEXNREFQTTNRLLLTGTPLQNNLHELWALLNFLLPDVFNSSDDFDAWFNTSQCLGDNALVERLHAVXEPFLLRRLKAEVEKRLKPENELNAYVRIEXMPLEWFSPAMMKDRDSLNGAGKVQKTRPPNNLLE

SEQ ID NO: 35681 - protein, 197 aa, Diabrotica virgifera
  misc_feature: Coding regions on vcDNA: vcDNA=SeqID_15378; Strand=+; Position=102-692
  misc_feature: Homolog annotation: Hit_ID=XP_396981.1; Match level="QueryCoverage =80%, HitCoverage=41%, E-value=1e-56, Identity=64%"; Hit description =similar to Insulin-degrading enzyme (Insulysin) (Insulinase) (Insulin protease) [Apis
  misc_feature: Gene Ontology Annotation: Molecular function=signal transducer activity; Cellular component=mitochondrion; Biological process=cell -cell signaling
  misc_feature: Pfam annotation: Pfam_ID=Peptidase_M16; Match level="Score=167.5, E -value=3e-47, Copies=1"; Pfam description=Insulinase (Peptidase family M16)
MTKIVLPFTSKVGDVSMRYTKYNYTAELLKDSKPKMGTSNFVLKRYDNITKSEEDHRLYRGLELSNHMKVLLVSDPKTDKSAAAMDVNVGFLSDPKEVYGLAHFCEHMLFLGTKKYPNENDYNKFLSEHGGSTNAATYLDHTVYFFDIVPNQLPQALDRFSQFFIAPLFTESATERENNAVNSEHEKNLPNDLWRLD

SEQ ID NO: 35682 - protein, 215 aa, Diabrotica virgifera
  misc_feature: Coding regions on vcDNA: vcDNA=SeqID_15379; Strand=+; Position=70-720
  misc_feature: Homolog annotation: Hit_ID=A32713; Match level="QueryCoverage=98%, HitCoverage=24%, E-value=3e-50, Identity=46%"; Hit description =reverse transcriptase homolog - fruit fly (Drosophila melanogaster)
  misc_feature (23)..(23): Xaa can be any naturally occurring amino acid
  misc_feature (140)..(140): Xaa can be any naturally occurring amino acid
  misc_feature (159)..(159): Xaa can be any naturally occurring amino acid
MFTVLKSYLEGRYYRIRYDTDTXIYRIQSGVSQGSVLGPPLYLIFTHDIPTNGNVTITTFADDTALLVTNKNTSTATESLQRHLTDIEKWTKKWRVKISESKSQHIIFTKCRKMSPNIEINNKAIPQTESVQYLGTHLDXWRTHIWKKRQQLNLKFGEXYWILSRTSKLSIRNKLLVYNTILEPVWTYGIQLWGTAAKSISKAKINRFTRAASKN

SEQ ID NO: 35683 - protein, 70 aa, Diabrotica virgifera
  misc_feature: Coding regions on vcDNA: vcDNA=SeqID_15380; Strand=+; Position=1-213
SFVRPLVLRKREGIDLQSVAHHGAYLLITRRLITGRGILLRIFDRTSPISTASTTRIHAEMIAAEATAAF

SEQ ID NO: 35684 - protein, 119 aa, Diabrotica virgifera
  misc_feature: Coding regions on vcDNA: vcDNA=SeqID_15381; Strand=-; Position=0-356
  misc_feature (24)..(24): Xaa can be any naturally occurring amino acid
  misc_feature (47)..(47): Xaa can be any naturally occurring amino acid
  misc_feature (87)..(87): Xaa can be any naturally occurring amino acid
  misc_feature (95)..(101): Xaa can be any naturally occurring amino acid
  misc_feature (103)..(103): Xaa can be any naturally occurring amino acid
  misc_feature (106)..(112): Xaa can be any naturally occurring amino acid
  misc_feature (114)..(114): Xaa can be any naturally occurring amino acid
GSFAAWVGCSRLRGGSGARSLSFXAAVWCGVLLPVFPLFCARRCLLXWGGCPSLRFARLSALGLRGPVLSAVLCPRLQRGSARLRGXVRALRSRXXXXXXXPXEGXXXXXXXKXKGPRG

SEQ ID NO: 35685 - protein, 169 aa, Diabrotica virgifera
  misc_feature: Coding regions on vcDNA: vcDNA=SeqID_15382; Strand=+; Position=1-511
  misc_feature: Homolog annotation: Hit_ID=AAH46858.1; Match level="QueryCoverage =80%, HitCoverage=20%, E-value=2e-26, Identity=44%"; Hit description =Loc89944-prov protein [Xenopus laevis]
  misc_feature: Gene Ontology Annotation: Molecular function=beta-galactosidase activity; Cellular component=lysosome
  misc_feature (134)..(134): Xaa can be any naturally occurring amino acid
GDSHTTNKTVENFRYNYEEILKYPSSVNIYMFHGGTNFAFLNGAENLKFDEWETDYHSIVSSYEYVSPLDESGDYTEKYWAAKQLLEQYNRIKTALPDVPAAPKKTAYATVKMEQEMFLYDMLQTITPLFEKCXPMEKLDINNGNGQSYGYIVYRKTNLNIPGNRHTLN

SEQ ID NO: 35686 - protein, 188 aa, Diabrotica virgifera
  misc_feature: Coding regions on vcDNA: vcDNA=SeqID_15383; Strand=-; Position=1-564
  misc_feature (24)..(55): Xaa can be any naturally occurring amino acid
  misc_feature (57)..(184): Xaa can be any naturally occurring amino acid
LLSNIRGRNVYYRFELSNKISLVXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRKR

SEQ ID NO: 35687 - protein, 93 aa, Diabrotica virgifera
  misc_feature: Coding regions on vcDNA: vcDNA=SeqID_15384; Strand=-; Position=1-279
  misc_feature (57)..(57): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (75)..(75): Xaa can be any naturally occurring amino acid
  misc_feature (83)..(83): Xaa can be any naturally occurring amino acid
  misc_feature (85)..(85): Xaa can be any naturally occurring amino acid
  misc_feature (89)..(89): Xaa can be any naturally occurring amino acid
PFSVSGPLLSVLFLCLFCLFFLRCLVPLGGSFFWSLLVVFRGLLVSLVGASLSLRRXGSPLXPWXPXFLLXSFLXLSKGVFPXLXFFEXLPLT

SEQ ID NO: 35688 - protein, 80 aa, Diabrotica virgifera
  misc_feature: Coding regions on vcDNA: vcDNA=SeqID_15385; Strand=-; Position=0-239
  misc_feature (52)..(59): Xaa can be any naturally occurring amino acid
TYYIIEYNLLGNPGRIILNYTRAAFRSIDALGNSLVAALQACTIFAKKNCKXXXXXXXXIKIVIPVRSHQISFLIFLWKT

SEQ ID NO: 35689 - protein, 224 aa, Diabrotica virgifera
  misc_feature: Coding regions on vcDNA: vcDNA=SeqID_15386; Strand=+; Position=100-774
  misc_feature: Homolog annotation: Hit_ID=XP_320943.1; Match level="QueryCoverage =80%, HitCoverage=56%, E-value=7e-48, Identity=50%"; Hit description =ENSANGP00000007774 [Anopheles gambiae]
  misc_feature: Gene Ontology Annotation: Molecular function =acetylglucosaminyltransferase activity; Cellular component=Golgi membrane; Biological process=gurken receptor signaling pathway
  misc_feature: Pfam annotation: Pfam_ID=Galactosyl_T; Match level="Score=11.8, E -value=4.1e-07, Copies=1"; Pfam description=Galactosyltransferase
MLQRMIGPRRIQRIVLATFIFSVLHIFGVFHHIFETDFYTNFHYPYDGDIEHLIQQLKDGKPPDVLPINSYHFEYNKKCVSKCSSMKQLRLVYIIKSAPEHFDRRIGIRNSWGYERRFSDAEIRTVFLVGERNSHALKESLKEEYSKFHDIVHANFTDSYYNNTYKTMMGLQWAVRYCPNSQYYMFVDDDYYVSTKNVLKDLKIPQVFRICKEPLNGVSPFIMI

SEQ ID NO: 35690 - protein, 21 aa, Diabrotica virgifera
  misc_feature: Coding regions on vcDNA: vcDNA=SeqID_15387; Strand=-; Position=1-63
LLTSARNQHYSVTTIRDTHNC

SEQ ID NO: 35691 - protein, 349 aa, Diabrotica virgifera
  misc_feature: Coding regions on vcDNA: vcDNA=SeqID_15388; Strand=+; Position=1-1047
  misc_feature (1)..(268): Xaa can be any naturally occurring amino acid
  misc_feature (272)..(293): Xaa can be any naturally occurring amino acid
  misc_feature (295)..(322): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKPXXXXXXXXXXXXXXXXXXXXXXGXXXXXXXXXXXXXXXXXXXXXXXXXXXXGARRVFFLAEPKKLRPQRRSDPICEVA

SEQ ID NO: 35692 - protein, 60 aa, Diabrotica virgifera
  misc_feature: Coding regions on vcDNA: vcDNA=SeqID_15389; Strand=-; Position=1-180
  misc_feature: Homolog annotation: Hit_ID=ZP_00263832.1; Match level="QueryCoverage =100%, HitCoverage=8%, E-value=2e-16, Identity=76%"; Hit description =COG0840: Methyl-accepting chemotaxis protein [Pseudomonas fluorescens PfO-1]
SSTQLAATSMGVAKSCEQASGSAQKTRQIAEDSSRDSQRTAASIQQLNQPLTDTFKALER

SEQ ID NO: 35693 - protein, 66 aa, Diabrotica virgifera
  misc_feature: Coding regions on vcDNA: vcDNA=SeqID_15390; Strand=-; Position=2-199
  misc_feature (3)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXETNLAHTGLNXXXXXXXXSNXXXXXXXXXXXXXXPTSRSXXXXXXXXXXXXXXV

SEQ ID NO: 35694 - protein, 231 aa, Diabrotica virgifera
  misc_feature: Coding regions on vcDNA: vcDNA=SeqID_15391; Strand=+; Position=10-703
  misc_feature: Homolog annotation: Hit_ID=AAV34812.1; Match level="QueryCoverage =100%, HitCoverage=55%, E-value=2e-54, Identity=52%"; Hit description= ribosomal protein L3 [Bombyx mori]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=-77.1, E -value=0.00073, Copies=1"; Pfam description=Ribosomal protein L3
  misc_feature (55)..(55): Xaa can be any naturally occurring amino acid
  misc_feature (68)..(68): Xaa can be any naturally occurring amino acid
  misc_feature (107)..(107): Xaa can be any naturally occurring amino acid
  misc_feature (153)..(153): Xaa can be any naturally occurring amino acid
  misc_feature (197)..(197): Xaa can be any naturally occurring amino acid
MPLRRFSAPSSASMGFCLSKRAQRHRGKVKDCPMDDPSKAVCLTAFTRLRAGMTXVEEERHRPDSHIXKMEIVKVETILETPPMKLVDDVSYIQTPHGLRALHHRLXAEHLSEHCHMCFYKICYWNKNKGFTIASNTWSDGLRNRTIEKDLKXTATYWKVDIVIAHTQMKLYMLRMKKDHIMEISIDAATVADTVAXIHNTLSRLFLLPTISAHYDMIDCIEVTNDLGYKG

SEQ ID NO: 35695 - protein, 52 aa, Diabrotica virgifera
  misc_feature: Coding regions on vcDNA: vcDNA=SeqID_15392; Strand=+; Position=334-492
IDQVLDVVLTKSTHSSMSANRRYSRFNGAGILFLTLRLSWSQTCSIGFKSGL

SEQ ID NO: 35696 - protein, 252 aa, Diabrotica virgifera
  misc_feature: Coding regions on vcDNA: vcDNA=SeqID_15393; Strand=+; Position=2-757
  misc_feature: Homolog annotation: Hit_ID=NP_722724.1; Match level="QueryCoverage =69%, HitCoverage=35%, E-value=1e-25, Identity=43%"; Hit description =CG17654-PE, isoform E [Drosophila melanogaster] ref|NP_722723.1| CG17654-PD, isoform D [Drosophila
  misc_feature: Gene Ontology Annotation: Molecular function=phosphopyruvate hydratase activity; Cellular component=soluble fraction; Biological process=gluconeogenesis
  misc_feature: Pfam annotation: Pfam_ID=Enolase_N; Match level="Score=91.4, E-value =2.4e-24, Copies=1"; Pfam description=Enolase, N-terminal domain
  misc_feature (27)..(27): Xaa can be any naturally occurring amino acid
IKRAERGEGGGRGPFKGTKRRSAKRAXKSTRARQNSDTRPNPTGEAEHGTEAGRTRAAEPAGASTGSDEAHERRDKAGGEHHAKGGKTATHNTKTTNAPEQTKPRREGSAQTDDDDHMTDGDGTQNKGGAGGHAILSVSLDRATDGRCKTGVPLCTPTTDRAGNRDAISANPACTRIEGGSQSGKKLGMHEPMNLPPEGAKPLPRQAGGALRATPRHKKATPGAQSRTEPSRLPLAATEGDCPHPAPRPPQE

SEQ ID NO: 35697 - protein, 266 aa, Diabrotica virgifera
  misc_feature: Coding regions on vcDNA: vcDNA=SeqID_15394; Strand=+; Position=98-895
  misc_feature: Homolog annotation: Hit_ID=CAG12883.1; Match level="QueryCoverage =88%, HitCoverage=14%, E-value=6e-39, Identity=37%"; Hit description =unnamed protein product [Tetraodon nigroviridis]
MTTNGKINAETQLQVTIGRLLQSVTDKSYLVLESVKCSLKKLAEKHPNQVLNSCCQFITKSPKPPPEHVSSILYIMELVCSDHILKINGDTIIQTINVSLSIMTENISWDSQLQRPASGILVALGREHYVQVMDALREKLQPSVIPHHMVPYTLGALASANAIGVVPYLKDIYSIILPLLPSLRTEILKQSVSFALGNFCEALTEYISNSEKVPDPTISLETFSEEISIAYNILFSNWDHSRDAKTNECVLEAITLIYPVLSENIA

SEQ ID NO: 35698 - protein, 35 aa, Diabrotica virgifera
  misc_feature: Coding regions on vcDNA: vcDNA=SeqID_15395; Strand=-; Position=0-104
  misc_feature (27)..(27): Xaa can be any naturally occurring amino acid
  misc_feature (29)..(34): Xaa can be any naturally occurring amino acid
AGSPASFSSSVARCRCLPLKGRPPLPXPXXXXXXG

SEQ ID NO: 35699 - protein, 54 aa, Diabrotica virgifera
  misc_feature: Coding regions on vcDNA: vcDNA=SeqID_15396; Strand=+; Position=3-167
YSRNYLNFWCAEHPGQKNGSLVISPAAPFIKKERVLSMSVYTSIAAYTLQSSLP

SEQ ID NO: 35700 - protein, 166 aa, Diabrotica virgifera
  misc_feature: Coding regions on vcDNA: vcDNA=SeqID_15397; Strand=+; Position=126-626
  misc_feature: Homolog annotation: Hit_ID=AAL93203.1; Match level="QueryCoverage =75%, HitCoverage=19%, E-value=2e-12, Identity=34%"; Hit description =transposase [Bactrocera dorsalis]
  misc_feature (137)..(145): Xaa can be any naturally occurring amino acid
MTINYLKKNKKSKQDIQIASSSYQCDQPGSSKDMDNLQIPSSSTISSEIKEVSSSTTIERTYGQTKLTSYIERKTVCKNKEETDNALMLLFIYDLQPFRMVESEAFRELTFGLNPNYTLPDRKTISKIMIPHLYEQXXXXXXXXXKQGSTFCITTDCWTSRIYETK

SEQ ID NO: 35701 - protein, 126 aa, Diabrotica virgifera
  misc_feature: Coding regions on vcDNA: vcDNA=SeqID_15398; Strand=-; Position=0-377
  misc_feature (11)..(70): Xaa can be any naturally occurring amino acid
  misc_feature (73)..(117): Xaa can be any naturally occurring amino acid
KKNARWLSLRXXXXXXXXXXXXXXXXXXXXXXXXXXXXXXXXXXXXXXXXXXXXXXXXXXXXXXXXXXXXYGXXXXXXXXXXXXXXXXXXXXXXXXXXXXXXXXXXXXXXXXXXXXXLKLGQNSAL

SEQ ID NO: 35702 - protein, 209 aa, Diabrotica virgifera
  misc_feature: Coding regions on vcDNA: vcDNA=SeqID_15399; Strand=+; Position=1-627
  misc_feature: Homolog annotation: Hit_ID=S18644; Match level="QueryCoverage=99%, HitCoverage=25%, E-value=3e-40, Identity=43%"; Hit description =multifunctional amino acid-tRNA ligase (EC 6.1.1.-) - fruit fly (Drosophila melanogaster)
  misc_feature: Gene Ontology Annotation: Cellular component=soluble fraction; Biological process=protein complex assembly
  misc_feature: Pfam annotation: Pfam_ID=WHEP-TRS; Match level="Score=192.3, E-value =9.6e-55, Copies=3"; Pfam description=WHEP-TRS domain
  misc_feature (174)..(179): Xaa can be any naturally occurring amino acid
KSKTNVAPKADSKVTSKSATYLNNEIIKQGDAVRKLKEQKAAKADIDTAVKVLLTLKAEYKAVANTDWKPGCVPPTASVSKNDSAIGDEINAKIAAQGEKLKSQKADKAAVEAEVRQLLSLKAEYKSATGKDWTPSQASSTNKITNQTSSTTKPKQENVSLDENSILQQIALQXXXXXXFKSQKADKSTVDNEVKELLSLKDDYKTLTG

SEQ ID NO: 35703 - protein, 199 aa, Diabrotica virgifera
  misc_feature: Coding regions on vcDNA: vcDNA=SeqID_15400; Strand=+; Position=685 -1281
  misc_feature (15)..(22): Xaa can be any naturally occurring amino acid
  misc_feature (52)..(58): Xaa can be any naturally occurring amino acid
  misc_feature (77)..(84): Xaa can be any naturally occurring amino acid
  misc_feature (162)..(171): Xaa can be any naturally occurring amino acid
FERPPEFSPRSKDPXXXXXXXXSRQERGGEKKKLAFLLFFLEILFSRSQNLXXXXXXXRKTPQKIFSQSPPTLFTNXXXXXXXXLSSLRAGQNKQNYLLFSPSYTKPPQHSAPPHLPPTPPKNTSPSRTTPRQILFSRGDISPSHTPLLPPSPLLCNFLSPXXXXXXXXXXLLLPPPLSHPPLFSSLPLSSSPPPSPSS

SEQ ID NO: 35704 - protein, 23 aa, Diabrotica virgifera
  misc_feature: Coding regions on vcDNA: vcDNA=SeqID_15401; Strand=+; Position=2-70
FSFRFRASVIFYLNCDLPLPGFN

SEQ ID NO: 35705 - protein, 121 aa, Diabrotica virgifera
  misc_feature: Coding regions on vcDNA: vcDNA=SeqID_15402; Strand=-; Position=720 -1085
  misc_feature (23)..(37): Xaa can be any naturally occurring amino acid
  misc_feature (64)..(73): Xaa can be any naturally occurring amino acid
FFMIYLFLWENIRQKKEVSPGPXXXXXXXXXXXXXXXRLGFAPNFLPPPNFLCGNFIPNPVPCXXXXXXXXXXRRVFSFQGVFPNFQSQFSKFSLFWEFLKNLGSDFGIPLKPFLAGCHFP

SEQ ID NO: 35706 - protein, 261 aa, Diabrotica virgifera
  misc_feature: Coding regions on vcDNA: vcDNA=SeqID_15403; Strand=+; Position=79-864
  misc_feature: Homolog annotation: Hit_ID=XP_312603.1; Match level="QueryCoverage =95%, HitCoverage=63%, E-value=5e-63, Identity=47%"; Hit description =ENSANGP00000014914 [Anopheles gambiae]
  misc_feature: Gene Ontology Annotation: Molecular function=glutamate-ammonia ligase activity; Cellular component=cytoplasm; Biological process=nitrogen metabolism
  misc_feature: Pfam annotation: Pfam_ID=Gln-synt_C; Match level="Score=-87.2, E -value=0.00023, Copies=1"; Pfam description=Glutamine synthetase, catalytic domai
  misc_feature (26)..(26): Xaa can be any naturally occurring amino acid
  misc_feature (37)..(37): Xaa can be any naturally occurring amino acid
  misc_feature (56)..(56): Xaa can be any naturally occurring amino acid
  misc_feature (67)..(67): Xaa can be any naturally occurring amino acid
  misc_feature (124)..(124): Xaa can be any naturally occurring amino acid
  misc_feature (159)..(159): Xaa can be any naturally occurring amino acid
  misc_feature (236)..(236): Xaa can be any naturally occurring amino acid
HRSPYATLYQSLLPYYLTLPIPDAKXHSTYIWIDSSXEYAKCKTKTLYLVPTCPSXLPSRNSLRNSXSLATGHYSYVFLCPVSMYKDPFLKGLYQTPLCDTYKYNSTPTQTNHRVTSLERMKSXQQEKPGLVIKQEYTLLNMSLHPLDWSKHGIPAPQXPYYCAAGANKEYVRDIVYAHYMRCLDADATISASDADVMPAQCEYHVSTRVSISIGDEVRISMHILQRVARDYGVIXTFDPTPMEGDWNLVGVRPIFSNFAK

SEQ ID NO: 35707 - protein, 54 aa, Diabrotica virgifera
  misc_feature: Coding regions on vcDNA: vcDNA=SeqID_15404; Strand=+; Position=102-266
  misc_feature: Homolog annotation: Hit_ID=XP_392839.1; Match level="QueryCoverage =96%, HitCoverage=3%, E-value=2e-11, Identity=63%"; Hit description =similar to ENSANGP00000009824 [Apis mellifera]
  misc_feature (54)..(54): Xaa can be any naturally occurring amino acid
MSSSEEIKAEYMSSLADLTFNSRPLINVLTMLAEENSPNAPVIVEAIEEHLSKX

SEQ ID NO: 35708 - protein, 127 aa, Diabrotica virgifera
  misc_feature: Coding regions on vcDNA: vcDNA=SeqID_15405; Strand=+; Position=314-696
  misc_feature: Homolog annotation: Hit_ID=EAL26584.1; Match level="QueryCoverage =100%, HitCoverage=25%, E-value=2e-24, Identity=47%"; Hit description= GA21068-PA [Drosophila pseudoobscura]
  misc_feature: Gene Ontology Annotation: Molecular function=carboxylesterase activity; Cellular component=synaptic junction; Biological process =cholesterol catabolism
  misc_feature (19)..(19): Xaa can be any naturally occurring amino acid
  misc_feature (35)..(35): Xaa can be any naturally occurring amino acid
  misc_feature (46)..(46): Xaa can be any naturally occurring amino acid
  misc_feature (93)..(93): Xaa can be any naturally occurring amino acid
LYVNVYTPTYPSPDLQIPXMVYFYGGGFINGSANXTVYGPHSTVCXQDVIIVTDSYLLRILGYLSTVYTVIPMNYCLKDQQLALKRAQQHIQXFDENPHRATTFGRCAGGTSVTLHLINQNSTGLFR

SEQ ID NO: 35709 - protein, 65 aa, Diabrotica virgifera
  misc_feature: Coding regions on vcDNA: vcDNA=SeqID_15406; Strand=+; Position=42-239
  misc_feature: Homolog annotation: Hit_ID=EAL24895.1; Match level="QueryCoverage =96%, HitCoverage=16%, E-value=5e-28, Identity=88%"; Hit description =GA13759-PA [Drosophila pseudoobscura]
  misc_feature: Gene Ontology Annotation: Molecular function=aspartic-type endopeptidase activity; Cellular component=lysosome; Biological process=induction of non-apoptotic programmed cell death
SFPSKGKDYILRVSQMGKTICLSGFMGIDIPPPNGPLWILGDVFIGKYYTEFDMGNNRVGFAETV

SEQ ID NO: 35710 - protein, 226 aa, Diabrotica virgifera
  misc_feature: Coding regions on vcDNA: vcDNA=SeqID_15407; Strand=+; Position=167-846
  misc_feature: Homolog annotation: Hit_ID=NP_502159.1; Match level="QueryCoverage =90%, HitCoverage=39%, E-value=4e-30, Identity=35%"; Hit description =predicted CDS, reverse transcriptase family member (4M184) [Caenorhabditis elegans]
  misc_feature (61)..(61): Xaa can be any naturally occurring amino acid
  misc_feature (105)..(105): Xaa can be any naturally occurring amino acid
  misc_feature (117)..(117): Xaa can be any naturally occurring amino acid
  misc_feature (128)..(128): Xaa can be any naturally occurring amino acid
  misc_feature (198)..(198): Xaa can be any naturally occurring amino acid
VYKIIIQNISISNNQCQIRIKIERGVRQGDPTSPKLFNTVLEHACKNLDWLTKGIKIDGEXMEVENSLRFTDDIVIIAEDVEVPRGVVQELVVATENVGLNINIXKTKIMTNLVSDXTSVFVRKKYNXVDRHIYRGHEIMIARDNQTHELKRKIGLGWAAYGKVRETFKSELLTCLRRKVFDHCVLPVLTYGAEILTXTKASATKLTVIQRRMERSRLGITMRHKI

SEQ ID NO: 35711 - protein, 276 aa, Diabrotica virgifera
  misc_feature: Coding regions on vcDNA: vcDNA=SeqID_15408; Strand=+; Position=14-841
  misc_feature: Homolog annotation: Hit_ID=AAH44265.1; Match level="QueryCoverage =98%, HitCoverage=76%, E-value=4e-38, Identity=35%"; Hit description =B52-prov protein [Xenopus laevis]
  misc_feature: Gene Ontology Annotation: Molecular function=pre-mRNA splicing factor activity; Cellular component=nucleus; Biological process=mRNA splicing
  misc_feature (88)..(98): Xaa can be any naturally occurring amino acid
  misc_feature (127)..(134): Xaa can be any naturally occurring amino acid
MLTKDKRSLRRSRSRSRSRRKRSRSRSRRRSRSRRRRSSSRSRRSRSRDRRKRSRSRGRRHSRSRDRRSRSRRSRSPRRSRSRSRRRXXXXXXXXXXXKSRDRDRKSRDRSRDRKRSNEREDKDKDXXXXXXXXDIESPEKEKTPKEAKERKSDKEGSAEEKRKSRSRSKSKRRSRSRDRRRDRRRSRSRGSRRRTPSPRGPRRRSRSRSRDRDKRRDKKSDKRDKDRRVRDKRSRSRDKEKERKSRSRSRDSRSTRSHSKGPREYDEEGKGFDTE

SEQ ID NO: 35712 - protein, 200 aa, Diabrotica virgifera
  misc_feature: Coding regions on vcDNA: vcDNA=SeqID_15409; Strand=+; Position=2-604
  misc_feature: Homolog annotation: Hit_ID=EAA00085.2; Match level="QueryCoverage =96%, HitCoverage=56%, E-value=9e-41, Identity=44%"; Hit description =ENSANGP00000017945 [Anopheles gambiae str. PEST] ref|XP_552574.1| ENSANGP00000017945 [Anopheles gambiae st
  misc_feature: Gene Ontology Annotation: Molecular function=triacylglycerol lipase activity; Cellular component=extracellular; Biological process =triacylglycerol metabolism
  misc_feature: Pfam annotation: Pfam_ID=Lipase; Match level="Score=26.7, E-value =4.8e-14, Copies=1"; Pfam description=Lipase
SNLADDLYVNAASAVGGVGEIVGDYIQSLMKNNNLDLDRTAVIGHSLGAHVAGIVGLALRGKLDYIVGLDPALPLFLIVHDDFRLDATDAKFVQVIHTCAGFLGIDFNIGHSDYFPNGGRDQPGCWMDVVGTCAHGRSFRYFAESIKSGGFIARKCNNYNDFQYNNCSKESSNMGEYHIDKRASGAYYLDTNDDPPYAKN

SEQ ID NO: 35713 - protein, 116 aa, Diabrotica virgifera
  misc_feature: Coding regions on vcDNA: vcDNA=SeqID_15410; Strand=-; Position=457-807
GALFPRPIPAVPLPRPGLPQRGPGYGDGPMKRPLRGPRSAGVFQRNAGIPPPGSPYPDTPPRGRWSPPGSGSNPPPRESLGRQAKSTPLHIRVNCLRLVKASLKLAIPRRVSDSGC

SEQ ID NO: 35714 - protein, 230 aa, Diabrotica virgifera
  misc_feature: Coding regions on vcDNA: vcDNA=SeqID_15411; Strand=+; Position=3-695
  misc_feature: Homolog annotation: Hit_ID=EAA14659.3; Match level="QueryCoverage =98%, HitCoverage=35%, E-value=1e-43, Identity=38%"; Hit description =ENSANGP00000002042 [Anopheles gambiae str. PEST] ref|XP_553278.1| ENSANGP00000002042 [Anopheles gambiae st
  misc_feature: Gene Ontology Annotation: Molecular function=molecular_function unknown; Cellular component=cellular_component unknown; Biological process=biological_process unknown
  misc_feature (118)..(129): Xaa can be any naturally occurring amino acid
  misc_feature (192)..(199): Xaa can be any naturally occurring amino acid
LVRANKIYTECDGMVYESSAIKMDLRFVPENMEFDDEPKEYCDKLPEVNKYQPRFFTTTALQQAKVDLTWDETDPNRIEVTEKLSSGKLDDLSQKDLQNYLASSSGEEDSDVQEKEEXXXXXXXXXXXXDKYKALLLDIENKDTSKNNKDLEMEISWGINLKEKTDKLAKDKSSEDKTPFQQYLDKKKEKRXXXXXXXXEQKQDDEDSDMPSDIDVNDPYFAEEFNNPEF

SEQ ID NO: 35715 - protein, 98 aa, Diabrotica virgifera
  misc_feature: Coding regions on vcDNA: vcDNA=SeqID_15412; Strand=-; Position=457-753
  misc_feature (65)..(71): Xaa can be any naturally occurring amino acid
KVQYIYIQGKVLFGNPLPNNIHRIFKYIIFEVQYFLYLKVDQYFSVRANNTRESRLKCCFVYMIXXXXXXXNIYFKESKLSHLNQNPSLPVLLSFHDY

SEQ ID NO: 35716 - protein, 42 aa, Diabrotica virgifera
  misc_feature: Coding regions on vcDNA: vcDNA=SeqID_15413; Strand=-; Position=1-126
  misc_feature (3)..(39): Xaa can be any naturally occurring amino acid
KNXXXXXXXXXXXXXXXXXXXXXXXXXXXXXXXXXXXXXLIN

SEQ ID NO: 35717 - protein, 109 aa, Diabrotica virgifera
  misc_feature: Coding regions on vcDNA: vcDNA=SeqID_15414; Strand=+; Position=99-428
IESCTEVSQRYGLSQNNKKTKCLLISKNTQRKRYVISIKMLIQTTNAILKICPILGFIGTTKRYSSIHYFRSLSQCITFIEWMNIHYVYDNITLLVLRTLFTESTNTIY

SEQ ID NO: 35718 - protein, 202 aa, Diabrotica virgifera
  misc_feature: Coding regions on vcDNA: vcDNA=SeqID_15415; Strand=+; Position=84-687
  misc_feature: Homolog annotation: Hit_ID=XP_397101.1; Match level="QueryCoverage =90%, HitCoverage=64%, E-value=4e-62, Identity=68%"; Hit description =similar to CG32344-PA [Apis mellifera]
  misc_feature: Gene Ontology Annotation: Molecular function=ATP dependent RNA helicase activity; Cellular component=nucleolus; Biological process =nucleobase, nucleoside, nucleotide and nucleic acid metabolism
  misc_feature: Pfam annotation: Pfam_ID=DEAD; Match level="Score=96.3, E-value=7.8e -26, Copies=1"; Pfam description=DEAD/DEAH box helicase
  misc_feature (23)..(30): Xaa can be any naturally occurring amino acid
  misc_feature (129)..(129): Xaa can be any naturally occurring amino acid
  misc_feature (153)..(153): Xaa can be any naturally occurring amino acid
  misc_feature (162)..(162): Xaa can be any naturally occurring amino acid
  misc_feature (176)..(176): Xaa can be any naturally occurring amino acid
MADIPGFSDPNNIKETNIQDDTXXXXXXXXGGGFQSMHLNYNVLKGITKRGYKQPTPIQRKTIPVIMEGKDVVAMARTGSGKTAAFLIPLFEKLKIRSAKTGARALVMSPTRELALQTLKFIKELGRFXTDLKAAVILGGDSMDDQFSLIHGXNPDIIVATXPGRFLHVWIKMDLXLNNGEYVVFRRRQDKINFEMGFGRGV

SEQ ID NO: 35719 - protein, 100 aa, Diabrotica virgifera
  misc_feature: Coding regions on vcDNA: vcDNA=SeqID_15416; Strand=-; Position=288-590
QMISILSTPAHMVYPKVSAARDWVSGDFIYNEKRFPESDYSLFENESVVDIFGMFTDEEIIFSWYRKPICYFQEPTRPTSLARGNEMIGWNTSKKKKSKS

SEQ ID NO: 35720 - protein, 168 aa, Diabrotica virgifera
  misc_feature: Coding regions on vcDNA: vcDNA=SeqID_15417; Strand=-; Position=1-504
  misc_feature (85)..(113): Xaa can be any naturally occurring amino acid
  misc_feature (119)..(127): Xaa can be any naturally occurring amino acid
  misc_feature (129)..(136): Xaa can be any naturally occurring amino acid
  misc_feature (142)..(154): Xaa can be any naturally occurring amino acid
  misc_feature (159)..(165): Xaa can be any naturally occurring amino acid
LNNRPVFFSHTPSFHLAERDLFIMLAGEGGGAPSIQINQRAAEPLFLMQKERVFHGQVIKRVGGLVYLPYIFIVDMQVFNSDNRXXXXXXXXXXXXXXXXXXXXXXXXXXXXXLIFYNXXXXXXXXXGXXXXXXXXIFRDEXXXXXXXXXXXXXELIPXXXXXXXADE

SEQ ID NO: 35721 - protein, 54 aa, Diabrotica virgifera
  misc_feature: Coding regions on vcDNA: vcDNA=SeqID_15418; Strand=-; Position=0-161
  misc_feature (19)..(30): Xaa can be any naturally occurring amino acid
ENSPPPKSHNFKNFLSMGXXXXXXXXXXXXNVFPLGKIPLGEYTPPGPPHLIFS

SEQ ID NO: 35722 - protein, 142 aa, Diabrotica virgifera
  misc_feature: Coding regions on vcDNA: vcDNA=SeqID_15419; Strand=+; Position=402-830
WKMKQWNLHCIYAANFSVINLQLEFCPKNVKYLQDLHDLSVLDLTHRYWRTKKIYTFGRKLFQVRKSTGKLSIKSQISPFTNSAMTKTLFSNKVKTCYLNSHPPPNMFEFLIRKKWAKFFRTFFPEGLKKPNGKGWAQFPPK

SEQ ID NO: 35723 - protein, 55 aa, Diabrotica virgifera
  misc_feature: Coding regions on vcDNA: vcDNA=SeqID_15420; Strand=+; Position=1-165
  misc_feature (30)..(41): Xaa can be any naturally occurring amino acid
SLLAVFFCLVSSDQPQKTTCVTTMLRLLSXXXXXXXXXXXXPEMTHPVPSSPQSS

SEQ ID NO: 35724 - protein, 197 aa, Diabrotica virgifera
  misc_feature: Coding regions on vcDNA: vcDNA=SeqID_15421; Strand=+; Position=1-593
  misc_feature: Homolog annotation: Hit_ID=NP_610023.1; Match level="QueryCoverage =98%, HitCoverage=43%, E-value=1e-38, Identity=43%"; Hit description =CG10721-PA [Drosophila melanogaster] gb|AAF53874.1| CG10721-PA [Drosophila melanogaster]
  misc_feature (185)..(185): Xaa can be any naturally occurring amino acid
AEFFLPSLSQDDVKQEPVSKRMRYQEEDFHKSGAALGPDWYKNLIIQGAGGLSMPSTVKVHYETEITLVERSKDAKHALEVTLSNGEKLDCDLIISATGVTPRMSFKSLNSLELSENDEIKVNQYMQTNLPNIYAAGDVCSANWDLAKHWFQMKLWTQARQMGSYADKSIDGHLNKEEVLQDFCXEMFAHSTKLFWI

SEQ ID NO: 35725 - protein, 71 aa, Diabrotica virgifera
  misc_feature: Coding regions on vcDNA: vcDNA=SeqID_15422; Strand=-; Position=1-213
  misc_feature (11)..(23): Xaa can be any naturally occurring amino acid
  misc_feature (27)..(41): Xaa can be any naturally occurring amino acid
  misc_feature (57)..(69): Xaa can be any naturally occurring amino acid
VPGRAKLEGNXXXXXXXXXXXXXFPLXXXXXXXXXXXXXXXFPRWGNPLEDTPPGPXXXXXXXXXXXXXFL

SEQ ID NO: 35726 - protein, 62 aa, Diabrotica virgifera
  misc_feature: Coding regions on vcDNA: vcDNA=SeqID_15423; Strand=+; Position=90-278
  misc_feature (44)..(50): Xaa can be any naturally occurring amino acid
LYSACLFLIQIYFPVYVNFAVYVNLTRKVRLCRDVGGGHIQHLXXXXXXXLLIILLILFIFD

SEQ ID NO: 35727 - protein, 158 aa, Diabrotica virgifera
  misc_feature: Coding regions on vcDNA: vcDNA=SeqID_15424; Strand=-; Position=3-476
  misc_feature (26)..(32): Xaa can be any naturally occurring amino acid
  misc_feature (44)..(92): Xaa can be any naturally occurring amino acid
  misc_feature (95)..(103): Xaa can be any naturally occurring amino acid
  misc_feature (115)..(123): Xaa can be any naturally occurring amino acid
  misc_feature (125)..(138): Xaa can be any naturally occurring amino acid
  misc_feature (145)..(157): Xaa can be any naturally occurring amino acid
FGVPRGFSHPGGFKKRGPGNLILGAXXXXXXXSQPPVVKFGPLXXXXXXXXXXXXXXXXXXXXXXXXXXXXXXXXXXXXXXXXXXXXXXXXXFRXXXXXXXXXIETNLAHTGFKXXXXXXXXXEXXXXXXXXXXXXXXSNIEVAXXXXXXXXXXXXXC

SEQ ID NO: 35728 - protein, 79 aa, Diabrotica virgifera
  misc_feature: Coding regions on vcDNA: vcDNA=SeqID_15425; Strand=+; Position=322-558
  misc_feature (65)..(74): Xaa can be any naturally occurring amino acid
RHIYDKIIILTPVKSLNNIHQIVLKRFAFPIYLLNFCYCDHGLIGKGVLGNWYHCVFGLGPISAXXXXXXXXXXSSFSL

SEQ ID NO: 35729 - protein, 249 aa, Diabrotica virgifera
  misc_feature: Coding regions on vcDNA: vcDNA=SeqID_15426; Strand=-; Position=3-749
  misc_feature (1)..(29): Xaa can be any naturally occurring amino acid
  misc_feature (34)..(49): Xaa can be any naturally occurring amino acid
  misc_feature (68)..(74): Xaa can be any naturally occurring amino acid
  misc_feature (78)..(84): Xaa can be any naturally occurring amino acid
  misc_feature (103)..(109): Xaa can be any naturally occurring amino acid
  misc_feature (113)..(119): Xaa can be any naturally occurring amino acid
  misc_feature (127)..(163): Xaa can be any naturally occurring amino acid
  misc_feature (165)..(178): Xaa can be any naturally occurring amino acid
  misc_feature (181)..(249): Xaa can be any naturally occurring amino acid
XXXXXXXXXXXXXXXXXXXXXXXXXXXXXGPLFXXXXXXXXXXXXXXXXKPQPWGPPPAVLKPPESHXXXXXXXEDQXXXXXXXACLPPNYINLLIPTIEGWXXXXXXXLGPXXXXXXXRLFIPLRXXXXXXXXXXXXXXXXXXXXXXXXXXXXXXXXXXXXXPXXXXXXXXXXXXXXKNXXXXXXXXXXXXXXXXXXXXXXXXXXXXXXXXXXXXXXXXXXXXXXXXXXXXXXXXXXXXXXXXXXXXX

SEQ ID NO: 35730 - protein, 191 aa, Diabrotica virgifera
  misc_feature: Coding regions on vcDNA: vcDNA=SeqID_15427; Strand=+; Position=1-576
  misc_feature (4)..(10): Xaa can be any naturally occurring amino acid
  misc_feature (19)..(24): Xaa can be any naturally occurring amino acid
NKQXXXXXXXTSDLIRIQXXXXXXIKNTGEFTKVNYRGGNEDVILTVMLEIQSFLKSRNYIIEKDIPNTIHDMQLQDIVLFLALNTSYKHSLIMEEYSHLINITPPLSKCLFANVVYGLDLCKYYCSVIEKLPIQNSVELLDEVSQCLKKSTPDIHLKYANMFLTATANKISSTTYSSEVEDDVINLCESS

SEQ ID NO: 35731 - protein, 65 aa, Diabrotica virgifera
  misc_feature: Coding regions on vcDNA: vcDNA=SeqID_15428; Strand=-; Position=2-196
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXX

SEQ ID NO: 35732 - protein, 95 aa, Diabrotica virgifera
  misc_feature: Coding regions on vcDNA: vcDNA=SeqID_15429; Strand=+; Position=2-289
  misc_feature (1)..(60): Xaa can be any naturally occurring amino acid
  misc_feature (74)..(80): Xaa can be any naturally occurring amino acid
XXXXXXXXXXXXXXXXXXXXXXXXXXXXXXXXXXXXXXXXXXXXXXXXXXXXXXXXXXXXLRDKRGNFIGKFKXXXXXXXPPMLGYKFLNGGDTL

SEQ ID NO: 35733 - protein, 85 aa, Diabrotica virgifera
  misc_feature: Coding regions on vcDNA: vcDNA=SeqID_15430; Strand=+; Position=3-260
  misc_feature: Homolog annotation: Hit_ID=NP_651876.1; Match level="QueryCoverage =76%, HitCoverage=24%, E-value=1e-18, Identity=67%"; Hit description =CG11522-PB, isoform B [Drosophila melanogaster] gb|AAF57167.1| CG11522-PB, isoform B [Drosophila
  misc_feature: Gene Ontology Annotation: Molecular function=structural constituent of ribosome; Cellular component=cytosolic large ribosomal subunit (sensu Eukarya); Biological process=ribosomal large subunit assembly and maintenance
GKYHPSSFFDLFCLFLAKYSSFSQHTRSIRNTITPGTVLILLAGSHKGKRVVFLKRLDSGLLLVTGPFGISVCPLRHINQRYVIV

SEQ ID NO: 35734 - protein, 75 aa, Diabrotica virgifera
  misc_feature: Coding regions on vcDNA: vcDNA=SeqID_15431; Strand=-; Position=95-322
SCIFFHICIVSVTHMVFCESLCVVGGFSTCYGWHRVISRLVCDSQGILCMYVDSISLMSTEGRSYSINIQACSSD

SEQ ID NO: 35735 - protein, 72 aa, Diabrotica virgifera
  misc_feature: Coding regions on vcDNA: vcDNA=SeqID_15432; Strand=-; Position=2-217
  misc_feature (48)..(55): Xaa can be any naturally occurring amino acid
KILLIILDKVRVYNLKPKVVVVVVVVVVVVVVVVVVVEEPMPTIFLHXXXXXXXXFIRDAAPSRLNICLTVI

SEQ ID NO: 35736 - protein, 110 aa, Diabrotica virgifera
  misc_feature: Coding regions on vcDNA: vcDNA=SeqID_15433; Strand=-; Position=142-474
VSSVIKNNCVRAIMDGRKRFSGRQCRKKRAEKEIETKRLKISLGKFLKSLHTDADNIAQPREHTAATAPFESANIHPDLALSSASTSAAAPYQSIDSHLGQSSASISSTY

SEQ ID NO: 35737 - protein, 171 aa, Diabrotica virgifera
  misc_feature: Coding regions on vcDNA: vcDNA=SeqID_15434; Strand=+; Position=215-727
  misc_feature: Homolog annotation: Hit_ID=NP_725256.1; Match level="QueryCoverage =94%, HitCoverage=37%, E-value=8e-22, Identity=37%"; Hit description =CG4016-PC, isoform C [Drosophila melanogaster] ref|NP_725255.1| CG4016-PB, isoform B [Drosophila
  misc_feature: Gene Ontology Annotation: Molecular function=serine C -palmitoyltransferase activity; Cellular component=mitochondrion; Biological process=sphingolipid metabolism
MMDAKLLEDRLPQFIPEPLPDLTHDIPHESIESYTIHEADHDVDLDIAMFLNFLENEEVNESAENMIRKYGVGTCGPRCVYGATDGPLDVHHRLADFLDMSQSMAYSYGYADISGSIAGYCARCGTGFLDEETDFPILLGVLACVRTIVYFDQNDAHSVTREVKREMKNEN

SEQ ID NO: 35738 - protein, 40 aa, Diabrotica virgifera
  misc_feature: Coding regions on vcDNA: vcDNA=SeqID_15435; Strand=-; Position=100-222
  misc_feature (4)..(17): Xaa can be any naturally occurring amino acid
GPFXXXXXXXXXXXXXXQTVAPPRVLNSSSCKNFKNRNRI

SEQ ID NO: 35739 - protein, 187 aa, Diabrotica virgifera
  misc_feature: Coding regions on vcDNA: vcDNA=SeqID_15436; Strand=+; Position=3-563
HASAKTNASQGNPSSFFQVPSSVSDNSSNTSKTFSSANTSNIQQSCIVSSPSTTVAKEYRVPQAPARTTFLTSPNASRTTIEKAFASPPSKQQASSVQQQIQTKAQTKIYSELGNQQERQRPSNEETQSQSSPISFSIMDAPGRLNYTGSNSSGKRPPQFPHNYRHYQQQQQPQGSSNSGEFQRAKR

SEQ ID NO: 35740 - protein, 94 aa, Diabrotica virgifera
  misc_feature: Coding regions on vcDNA: vcDNA=SeqID_15437; Strand=-; Position=180-464
  misc_feature (70)..(76): Xaa can be any naturally occurring amino acid
PSCNFSIFIFEKEILNIVTSSLAFAYYLSMVSDANHRKHIIGTGLQTTSNCSAIQPFIFIFSSSFTAVFXXXXXXXVKNLMNSKMYFTKNVFSF

SEQ ID NO: 35741 - protein, 179 aa, Diabrotica virgifera
  misc_feature: Coding regions on vcDNA: vcDNA=SeqID_15438; Strand=+; Position=250-786
  misc_feature: Homolog annotation: Hit_ID=XP_392381.1; Match level="QueryCoverage =70%, HitCoverage=15%, E-value=3e-10, Identity=29%"; Hit description =similar to CG12163-PA [Apis mellifera]
  misc_feature: Pfam annotation: Pfam_ID=Cystatin; Match level="Score=74.7, E-value =2.5e-19, Copies=1"; Pfam description=Cystatin domain
  misc_feature (125)..(125): Xaa can be any naturally occurring amino acid
MLDVIFEKNRVYAECLVYMKLNDVDTAQSTVDKVKCVNQDGTPLSRHVRQVPGGISPISKDDPKVKRYLKDGLLHLDKESSHEFKFKVVEILEVSRQVVSGSLHRIKAKIALSDCKKESNIDASXCGVQANGQSTICDFKVWDQPWIEHGRETNITCHDDSLEKNNIIRSDYEDHLTIT

SEQ ID NO: 35742 - protein, 78 aa, Diabrotica virgifera
  misc_feature: Coding regions on vcDNA: vcDNA=SeqID_15439; Strand=+; Position=202-438
AKPDFLVLNSFSTAALYKDLFFSKFVQKNQIGIFYRTGSTIQPGLNVEKSGGRSSAIYNSYSRYLPTKLKCSRSIPHH

SEQ ID NO: 35743 - protein, 80 aa, Diabrotica virgifera
  misc_feature: Coding regions on vcDNA: vcDNA=SeqID_15440; Strand=-; Position=126-368
LQGNSYDGFPIGWMKLERKNQHFDLKMHTYRRLNEQINSPNDKTICWLKCKVSLFTGSFESISFKFTHKCSRVHTLTNTT

SEQ ID NO: 35744 - protein, 187 aa, Diabrotica virgifera
  misc_feature: Coding regions on vcDNA: vcDNA=SeqID_15441; Strand=+; Position=1-564
  misc_feature: Homolog annotation: Hit_ID=XP_318056.1; Match level="QueryCoverage =95%, HitCoverage=57%, E-value=2e-43, Identity=44%"; Hit description =ENSANGP00000010690 [Anopheles gambiae]
  misc_feature: Pfam annotation: Pfam_ID=Endonuclease_NS; Match level="Score=106.6, E- value=6.4e-29, Copies=1"; Pfam description=DNA/RNA non-specific endonuclease
SSREAEQYINTKSYLSRGHLSPDADFLFASSQLTSYFYINTCPQWQSINGGNWVRVESAVRRVADKYHTTFLIITGTHDVLDLPDVHDNPIEMYLVSKRKLPVPKFVWKIMLDENSGKAIAFVSLNNPFVQEITEDEQLCSDICEQYGWGSKYYSDFSKGYIYCCDVNELRETVDTIPVLVNGILQA

SEQ ID NO: 35745 - protein, 132 aa, Diabrotica virgifera
  misc_feature: Coding regions on vcDNA: vcDNA=SeqID_15442; Strand=+; Position=49-447
  misc_feature: Homolog annotation: Hit_ID=XP_309435.1; Match level="QueryCoverage =84%, HitCoverage=22%, E-value=8e-27, Identity=50%"; Hit description =ENSANGP00000011164 [Anopheles gambiae]
  misc_feature: Gene Ontology Annotation: Molecular function=polyamine oxidase activity; Biological process=spermine catabolism
MPHTPSIIIIGAGAAGIAAATRLLKHGISNFKILEAENRIGGRIYSTQFGGSIVDVGGQWVHGEKGNIVYDMVKDLNLLSSSVNDYEDNTFYLSNGTQVTKKLSDHLFAIYSEVVENAEDARDMHHPYADIL

SEQ ID NO: 35746 - protein, 142 aa, Diabrotica virgifera
  misc_feature: Coding regions on vcDNA: vcDNA=SeqID_15443; Strand=-; Position=348-776
  misc_feature: Homolog annotation: Hit_ID=S36442; Match level="QueryCoverage=80%, HitCoverage=76%, E-value=3e-14, Identity=36%"; Hit description =reverse transcriptase-like protein - bovine (fragment)
GVWGEQGCLMSTILFNVYSEEILKKALHCQTAGIKVNGVPINNIRYADDTVILAENIKDLQRLVTRIAEFGQEYGLATNVKNRKFMRISKSQKNNENLFINGTNVERVDQYAYLGTMINSTGYYFLEIKIRTLILIHFEVAI

SEQ ID NO: 35747 - protein, 66 aa, Diabrotica virgifera; identical to SEQ ID NO: 26808
  misc_feature: Coding regions on vcDNA: vcDNA=SeqID_15444; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35748 - protein, 73 aa, Diabrotica virgifera
  misc_feature: Coding regions on vcDNA: vcDNA=SeqID_15445; Strand=+; Position=17-238
ITHWVTFYINTMLDELARYVIAYNLLGKLETLLTEVHEFFLEEKNRESCNHGISSTKRRYRHQRMNIRRNIHM

SEQ ID NO: 35749 - protein, 143 aa, Diabrotica virgifera
  misc_feature: Coding regions on vcDNA: vcDNA=SeqID_15446; Strand=+; Position=59-485
  misc_feature: Homolog annotation: Hit_ID=NP_570088.1; Match level="QueryCoverage =95%, HitCoverage=21%, E-value=1e-29, Identity=50%"; Hit description =CG6428-PA [Drosophila melanogaster] gb|AAF45911.1| CG6428-PA [Drosophila melanogaster]
  misc_feature: Gene Ontology Annotation: Molecular function=lysophospholipase activity; Cellular component=cellular_component unknown; Biological process=phospholipid metabolism
  misc_feature (44)..(44): Xaa can be any naturally occurring amino acid
MDCYSTKKILVLYVGGTIGMKKNHNGTLIPAQNAFLNKIKNNPXNYDAKWANLFLEDRLKENEMVLPQSCGDKIIYRMIEYSPLLDSSNMTSKDWIRIARDIEFYYNKYDEFVVLHGTDTLAYTSSALSFMLDGLPKPVIITG

SEQ ID NO: 35750 - protein, 254 aa, Diabrotica virgifera
  misc_feature: Coding regions on vcDNA: vcDNA=SeqID_15447; Strand=+; Position=24-788
  misc_feature: Homolog annotation: Hit_ID=XP_415274.1; Match level="QueryCoverage =96%, HitCoverage=11%, E-value=5e-37, Identity=33%"; Hit description =PREDICTED: similar to yeast translation activator GCN1 like (3D287) [Gallus gallus]
LCHSLEMMSLWTSKLSQDVPKKILDILKNGIGLKTSTPAVKIAYIQCMIATFNTKTIPQASIFIPILTKSVEKAVAQPTIALSVTEGLCAALLLFKLASVQKDKDNDFQSVWNAVLDMEKQIFFAEKYLSTTTEESLIYVMQLCEVLLVQYPEKLKKPEPIHRAVLYCTTVCSSSTRRKCLAILKRIVGSLSGAAIARSLFQELQRFLETNKVINEKSEDNKESDNNFLSSPTVVEMITTLCSLAGYPPKMCSF

SEQ ID NO: 35751 - protein, 194 aa, Diabrotica virgifera
  misc_feature: Coding regions on vcDNA: vcDNA=SeqID_15448; Strand=+; Position=3-582
  misc_feature: Homolog annotation: Hit_ID=XP_314089.1; Match level="QueryCoverage =98%, HitCoverage=19%, E-value=4e-74, Identity=74%"; Hit description =ENSANGP00000003705 [Anopheles gambiae]
  misc_feature: Gene Ontology Annotation: Molecular function=GDP-dissociation stimulator activity; Cellular component=exosome (RNase complex); Biological process=rRNA processing
  misc_feature: Pfam annotation: Pfam_ID=RNB; Match level="Score=29.9, E-value=5e-09, Copies=1"; Pfam description=RNB-like protein
  misc_feature (30)..(39): Xaa can be any naturally occurring amino acid
  misc_feature (161)..(161): Xaa can be any naturally occurring amino acid
EEDEKRRVDIRHIDICSVDPPGCTDIDDAXXXXXXXXXXLEVGVHIADVSHFIRPGTAIDIEAASRATTVYLVNKRIDMVPELLSSNLCSLRGGEERFAFSCIWEMDKEANILNTRFHKSIIKSKAAMTYEEAQIIIDDKSKNDTVAFSLRGLNMLAKILXKKRRLEKGALVLASPEVKIPMDSETMEPLDVEV

SEQ ID NO: 35752 - protein, 42 aa, Diabrotica virgifera
  misc_feature: Coding regions on vcDNA: vcDNA=SeqID_15449; Strand=-; Position=1-126
  misc_feature (6)..(14): Xaa can be any naturally occurring amino acid
GDIPTXXXXXXXXXGGRRSCFLPGEIRGLIPPTFQSFKKVSS

SEQ ID NO: 35753 - protein, 66 aa, Diabrotica virgifera; identical to SEQ ID NO: 26808
  misc_feature: Coding regions on vcDNA: vcDNA=SeqID_15450; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35754 - protein, 164 aa, Diabrotica virgifera
  misc_feature: Coding regions on vcDNA: vcDNA=SeqID_15451; Strand=+; Position=161-655
  misc_feature: Homolog annotation: Hit_ID=XP_392691.1; Match level="QueryCoverage =98%, HitCoverage=10%, E-value=7e-44, Identity=60%"; Hit description =similar to translation elongation factor 2 [Apis mellifera]
  misc_feature: Gene Ontology Annotation: Molecular function=translation elongation factor activity; Biological process=protein biosynthesis
  misc_feature (7)..(7): Xaa can be any naturally occurring amino acid
  misc_feature (22)..(22): Xaa can be any naturally occurring amino acid
  misc_feature (45)..(45): Xaa can be any naturally occurring amino acid
  misc_feature (53)..(53): Xaa can be any naturally occurring amino acid
  misc_feature (61)..(61): Xaa can be any naturally occurring amino acid
  misc_feature (65)..(65): Xaa can be any naturally occurring amino acid
  misc_feature (91)..(91): Xaa can be any naturally occurring amino acid
  misc_feature (98)..(98): Xaa can be any naturally occurring amino acid
  misc_feature (115)..(115): Xaa can be any naturally occurring amino acid
  misc_feature (136)..(136): Xaa can be any naturally occurring amino acid
  misc_feature (138)..(138): Xaa can be any naturally occurring amino acid
MLFIMKXGIVLKDEDKDKDGKXLLKVVMCRWLIVGEDLFKMIEIXVNIICGRXKYRMEMLXEGFXDDEGDVGIKKCDRNEIIMMYVYKMVXIFDKGCXYGFGCVLCGKVGIGMKXCIMRRNYKIGKKEDLYEKGIXSXILMMGSYVEDIEDVEFGKICGFGGVD

SEQ ID NO: 35755 - protein, 52 aa, Diabrotica virgifera
  misc_feature: Coding regions on vcDNA: vcDNA=SeqID_15452; Strand=-; Position=1-156
  misc_feature (6)..(14): Xaa can be any naturally occurring amino acid
  misc_feature (22)..(28): Xaa can be any naturally occurring amino acid
ISPLPXXXXXXXXXGDILNPKXXXXXXXYGGPEVFFFPGGQIGGKYPPPQNR

SEQ ID NO: 35756 - protein, 304 aa, Diabrotica virgifera
  misc_feature: Coding regions on vcDNA: vcDNA=SeqID_15453; Strand=+; Position=1-912
  misc_feature: Homolog annotation: Hit_ID=XP_315649.1; Match level="QueryCoverage =78%, HitCoverage=48%, E-value=5e-56, Identity=47%"; Hit description =ENSANGP00000021688 [Anopheles gambiae]
LYSCLRAMFGLSVSGILVCIFSCMLVYQLLSHEKKKMYWEQLELRCRSFYQQHSGPPSNHGSVRGPPMPPSTYCSCCEECRYPSITTGPQVYPWDNHITNERFWTPGRVGNFYSPNPEDNTPNISDNHNNRIRSLSGWSWRRLPWSRSNVGQNNSQRGNSIAYQGGASSADSQYGFSNRSGADTNMQDQIAGSTGSYSILDNRLPPGGVYVWGPPPPYSNPNSPARRPIQSPGRYHHIHHHSHGHENENSQFSRTSRRTRPHFNNKDNYENTTETEIHHGNDNNESTDTSSCVERVSHTLPVRK

SEQ ID NO: 35757 - protein, 22 aa, Diabrotica virgifera
  misc_feature: Coding regions on vcDNA: vcDNA=SeqID_15454; Strand=-; Position=26-94
RKISTVVDDNWSLVLYTARLFQ

SEQ ID NO: 35758 - protein, 32 aa, Diabrotica virgifera
  misc_feature: Coding regions on vcDNA: vcDNA=SeqID_15455; Strand=-; Position=7-105
IIVIRVIEKNLNFAREKSYSSLKICYNIELYP

SEQ ID NO: 35759 - protein, 64 aa, Diabrotica virgifera
  misc_feature: Coding regions on vcDNA: vcDNA=SeqID_15456; Strand=-; Position=335-529
PHLKLCNSGNKHRYISLYIRLAMGRSVHRCVTPILRTPLVNIHFEWSSHLCPSYERYRLVKRVR

SEQ ID NO: 35760 - protein, 121 aa, Diabrotica virgifera
  misc_feature: Coding regions on vcDNA: vcDNA=SeqID_15457; Strand=-; Position=0-362
  misc_feature (5)..(115): Xaa can be any naturally occurring amino acid
  misc_feature (117)..(117): Xaa can be any naturally occurring amino acid
KLRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXRAQA

SEQ ID NO: 35761 - protein, 110 aa, Diabrotica virgifera
  misc_feature: Coding regions on vcDNA: vcDNA=SeqID_15458; Strand=+; Position=61-393
  misc_feature: Homolog annotation: Hit_ID=NP_572710.1; Match level="QueryCoverage =59%, HitCoverage=59%, E-value=6e-16, Identity=60%"; Hit description =CG11752-PA [Drosophila melanogaster] gb|AAF48031.1| CG11752-PA [Drosophila melanogaster]
MASKGLLRNLNNYSKFCNFSSINRALSSGKIIYNKSQSSGGSIPNVPGLSDNCVKVPSSPVGPGAAKNTGYKNPEYFCYDKNSYFEAEVEMLEHRCPQPSVHVPYYPTSK

SEQ ID NO: 35762 - protein, 64 aa, Diabrotica virgifera
  misc_feature: Coding regions on vcDNA: vcDNA=SeqID_15459; Strand=+; Position=5-196
  misc_feature: Homolog annotation: Hit_ID=XP_392856.1; Match level="QueryCoverage =89%, HitCoverage=14%, E-value=5e-10, Identity=57%"; Hit description =similar to RAD23B protein [Apis mellifera]
  misc_feature: Gene Ontology Annotation: Molecular function=single-stranded DNA binding; Cellular component=nucleus; Biological process=nucleotide -excision repair
  misc_feature: Pfam annotation: Pfam_ID=ubiquitin; Match level="Score=6.5, E-value =0.034, Copies=1"; Pfam description=Ubiquitin family
  misc_feature (32)..(32): Xaa can be any naturally occurring amino acid
DSRREGIGSNYPSEHQRLIYAGKILTDETALXEYNIDEKKFIVVMATKPKQSEKTDSGDGNSTP

SEQ ID NO: 35763 - protein, 73 aa, Diabrotica virgifera
  misc_feature: Coding regions on vcDNA: vcDNA=SeqID_15460; Strand=-; Position=36-257
  misc_feature (31)..(37): Xaa can be any naturally occurring amino acid
  misc_feature (54)..(60): Xaa can be any naturally occurring amino acid
NFAERFDLFVVQGYFFLNVSLKLSLIHIFQXXXXXXXRLVLFVPKYGHLSRVSXXXXXXXIRILVFVFKRLST

SEQ ID NO: 35764 - protein, 109 aa, Diabrotica virgifera
  misc_feature: Coding regions on vcDNA: vcDNA=SeqID_15461; Strand=+; Position=74-402
  misc_feature: Homolog annotation: Hit_ID=XP_285129.3; Match level="QueryCoverage =88%, HitCoverage=47%, E-value=3e-20, Identity=54%"; Hit description =similar to Elongation factor 1-alpha 1 (EF-1-alpha-1) (Elongation factor 1 A-1) (eEF1A-1)
  misc_feature: Gene Ontology Annotation: Molecular function=translation factor activity, nucleic acid binding; Biological process=protein biosynthesis
  misc_feature (24)..(24): Xaa can be any naturally occurring amino acid
  misc_feature (58)..(58): Xaa can be any naturally occurring amino acid
  misc_feature (79)..(79): Xaa can be any naturally occurring amino acid
FPKKQNGIKRRYHINIMVMGHVNXDEMTTTGHLIEKCAEIRKRIIENSQKQDAIFGNXYYKYAVLIHKIMDETKRGITXIDIVLRKWERSKYYVNSIDAPRTQTDHETT

SEQ ID NO: 35765 - protein, 46 aa, Diabrotica virgifera
  misc_feature: Coding regions on vcDNA: vcDNA=SeqID_15462; Strand=-; Position=1-138
YHALSSALKSRRSTPAHILNDPSYTIILRTSSYAHFPHGYVYARIL

SEQ ID NO: 35766 - protein, 68 aa, Diabrotica virgifera
  misc_feature: Coding regions on vcDNA: vcDNA=SeqID_15463; Strand=-; Position=110-316
NNSQFNILSHRYVHGHRQHALSLPLLHTPFCPAVSNARSARSYLGLSLKCKIYEQASSSHSLFLGGVA

SEQ ID NO: 35767 - protein, 82 aa, Diabrotica virgifera
  misc_feature: Coding regions on vcDNA: vcDNA=SeqID_15464; Strand=+; Position=3-248
  misc_feature: Homolog annotation: Hit_ID=NP_611544.1; Match level="QueryCoverage =100%, HitCoverage=27%, E-value=2e-09, Identity=39%"; Hit description= CG10527-PA [Drosophila melanogaster] gb|AAF46666.1| CG10527-PA [Drosophila melanogaster]
  misc_feature (36)..(36): Xaa can be any naturally occurring amino acid
  misc_feature (40)..(40): Xaa can be any naturally occurring amino acid
  misc_feature (50)..(50): Xaa can be any naturally occurring amino acid
DKVEYSLFPHSSGLDKFCVRGVNDVYLEIKREVVEXRSCXEMLMGGWGNXICIMCKKRRKGDVDEVKFLGFLKENEFRGMWI

SEQ ID NO: 35768 - protein, 83 aa, Diabrotica virgifera
  misc_feature: Coding regions on vcDNA: vcDNA=SeqID_15465; Strand=+; Position=241-489
TFFKISHRDPYSMTQALLCGGSELRRWGIRHGYCWIPAEIWSPMNCPRFDKSRRGDATNFNQVQQIRTLDKCGRERYEAIQSF

SEQ ID NO: 35769 - protein, 57 aa, Diabrotica virgifera
  misc_feature: Coding regions on vcDNA: vcDNA=SeqID_15466; Strand=-; Position=301-474
WVDGVIRRPDLEMSFSIKATKIELGWVLGQCLVSVSISDIHLLHICLVQSLLYKKKM

SEQ ID NO: 35770 - protein, 128 aa, Diabrotica virgifera
  misc_feature: Coding regions on vcDNA: vcDNA=SeqID_15467; Strand=-; Position=3-385
  misc_feature: Homolog annotation: Hit_ID=CAA64425.1; Match level="QueryCoverage =86%, HitCoverage=52%, E-value=1e-17, Identity=39%"; Hit description =cell wall-plasma membrane linker protein [Brassica napus] pir||S71558 probable cell wall-plasma membrane l
  misc_feature: Gene Ontology Annotation: Molecular function=protein binding; Cellular component=extracellular space; Biological process=response to pathogenic bacteria
  misc_feature (8)..(14): Xaa can be any naturally occurring amino acid
  misc_feature (38)..(38): Xaa can be any naturally occurring amino acid
  misc_feature (85)..(85): Xaa can be any naturally occurring amino acid
  misc_feature (93)..(93): Xaa can be any naturally occurring amino acid
  misc_feature (103)..(103): Xaa can be any naturally occurring amino acid
  misc_feature (105)..(105): Xaa can be any naturally occurring amino acid
  misc_feature (109)..(109): Xaa can be any naturally occurring amino acid
PTPLPPPXXXXXXXIPPPSTSILTLPPPTPTTSLFPTXTPLTPSPPTPTPPHLLPPPPPTSPLPFPPLLITNTTTPPIPYLPFPXPRGGPLLXPPPPPPTTPXPXPSPXSPLMARISKINTYKPALMY

SEQ ID NO: 35771 - protein, 306 aa, Diabrotica virgifera
  misc_feature: Coding regions on vcDNA: vcDNA=SeqID_15468; Strand=-; Position=1-918
  misc_feature (1)..(25): Xaa can be any naturally occurring amino acid
  misc_feature (28)..(62): Xaa can be any naturally occurring amino acid
  misc_feature (66)..(303): Xaa can be any naturally occurring amino acid
XXXXXXXXXXXXXXXXXXXXXXXXXNFXXXXXXXXXXXXXXXXXXXXXXXXXXXXXXXXXXXSFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRK

SEQ ID NO: 35772 - protein, 166 aa, Diabrotica virgifera
  misc_feature: Coding regions on vcDNA: vcDNA=SeqID_15469; Strand=+; Position=118-618
  misc_feature: Homolog annotation: Hit_ID=AAH84097.1; Match level="QueryCoverage =91%, HitCoverage=17%, E-value=3e-19, Identity=36%"; Hit description =Unknown (protein for MGC:83476) [Xenopus laevis]
  misc_feature: Gene Ontology Annotation: Cellular component=nuclear pore; Biological process=protein-nucleus import
  misc_feature: Pfam annotation: Pfam_ID=IBN_N; Match level="Score=20.5, E-value =0.0011, Copies=1"; Pfam description=Importin-beta N-terminal domain
MMNLSEWRPQESIIKNIEETLQLALVPNSDAQKTVQDRLILMKSLTDFPNYLLFILGNPSFSEDIRSLAGIVLKNNIQTSHATLSAEYLLKIKSECLRLLKDPSREVRISISNIIVIIAKDNLKTWPEIVPYLTKGFVAQDEFSEVALTTLFKVCEELINSQKPPR

SEQ ID NO: 35773 - protein, 79 aa, Diabrotica virgifera
  misc_feature: Coding regions on vcDNA: vcDNA=SeqID_15470; Strand=-; Position=84-323
  misc_feature (12)..(18): Xaa can be any naturally occurring amino acid
YKVLNTTHRRLXXXXXXXSHSDGTPVGKGKRSGPFLFTTPVVYGGSATSRLSVVIPIRASTILVVKNSRPVSRIYVTLS

SEQ ID NO: 35774 - protein, 56 aa, Diabrotica virgifera
  misc_feature: Coding regions on vcDNA: vcDNA=SeqID_15471; Strand=-; Position=1-168
  misc_feature (13)..(38): Xaa can be any naturally occurring amino acid
  misc_feature (42)..(56): Xaa can be any naturally occurring amino acid
GHSKFIQGARRGXXXXXXXXXXXXXXXXXXXXXXXXXXYILXXXXXXXXXXXXXXX

SEQ ID NO: 35775 - protein, 133 aa, Diabrotica virgifera
  misc_feature: Coding regions on vcDNA: vcDNA=SeqID_15472; Strand=+; Position=94-495
  misc_feature: Homolog annotation: Hit_ID=YP_078022.1; Match level="QueryCoverage =97%, HitCoverage=23%, E-value=1e-30, Identity=47%"; Hit description =Glycoside Hydrolase Family 13 [Bacillus licheniformis ATCC 14580] gb|AAU22384.1| Glycoside
  misc_feature (1)..(1): Xaa can be any naturally occurring amino acid
  misc_feature (13)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (30)..(31): Xaa can be any naturally occurring amino acid
  misc_feature (43)..(43): Xaa can be any naturally occurring amino acid
  misc_feature (45)..(45): Xaa can be any naturally occurring amino acid
  misc_feature (68)..(68): Xaa can be any naturally occurring amino acid
  misc_feature (73)..(73): Xaa can be any naturally occurring amino acid
  misc_feature (107)..(107): Xaa can be any naturally occurring amino acid
XDDEWWKIAIFYXXYXKXFKDYDGNGIGDXXGVIEKLDYIKDXGXIGVWLYDILKCKEDDNGYDISDXRDIDXEFGSMEIFLEILYYVYKGGIKVVLEYVKNYMSEXYEWFKKYENGEKIYDEYYIWKDGKDG

SEQ ID NO: 35776 - protein, 92 aa, Diabrotica virgifera
  misc_feature: Coding regions on vcDNA: vcDNA=SeqID_15473; Strand=-; Position=3-278
  misc_feature (10)..(23): Xaa can be any naturally occurring amino acid
  misc_feature (25)..(48): Xaa can be any naturally occurring amino acid
  misc_feature (56)..(92): Xaa can be any naturally occurring amino acid
EINLCYRIIXXXXXXXXXXXXXXKXXXXXXXXXXXXXXXXXXXXXXXXPFVFPSNXXXXXXXXXXXXXXXXXXXXXXXXXXXXXXXXXXXXX

SEQ ID NO: 35777 - protein, 63 aa, Diabrotica virgifera
  misc_feature: Coding regions on vcDNA: vcDNA=SeqID_15474; Strand=-; Position=9-200
  misc_feature (5)..(12): Xaa can be any naturally occurring amino acid
LVSMXXXXXXXXTIQNHCLSTDLTFEYYVKIILFHRIFSCNCTRALKFYINFRDRVQFVAIVS

SEQ ID NO: 35778 - protein, 81 aa, Diabrotica virgifera
  misc_feature: Coding regions on vcDNA: vcDNA=SeqID_15475; Strand=-; Position=161-406
TGEIRFNSISKAALPRLVTVYFPGCSSLPSTYSLKAVTPVLRLKAKFSTNGYFNCRLSSESRRCSMLFSKSSIKISAFSRK

SEQ ID NO: 35779 - protein, 79 aa, Diabrotica virgifera
  misc_feature: Coding regions on vcDNA: vcDNA=SeqID_15476; Strand=+; Position=136-375
SKRLVGKSRITAHFLVHSIVICQVLTIQLKSVTLCNLIVYHDYSLIIMQPIQQLCITMKILSRRLKLKETEIARMRLII

SEQ ID NO: 35780 - protein, 61 aa, Diabrotica virgifera
  misc_feature: Coding regions on vcDNA: vcDNA=SeqID_15477; Strand=+; Position=17-202
HETEFSYDSYSLTQQLSEYNEHMPYEIQFAMIKYPHMATLPLSPLDFPLNYSRKTDRAPMN

SEQ ID NO: 35781 - protein, 69 aa, Diabrotica virgifera
  misc_feature: Coding regions on vcDNA: vcDNA=SeqID_15478; Strand=+; Position=143-349
  misc_feature: Homolog annotation: Hit_ID=XP_393322.1; Match level="QueryCoverage =75%, HitCoverage=29%, E-value=8e-16, Identity=79%"; Hit description =similar to ribosomal protein L18A [Apis mellifera]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L18ae; Match level="Score=-75.8, E- value=0.025, Copies=1"; Pfam description=Ribosomal L18ae protein family
NCPTGDLLAQVIKVEEVKASNTRRPQVKQFHDSKISFPLPKRIQHKSMNRFSVRKPRTYFLKIMLLWVV

SEQ ID NO: 35782 - protein, 86 aa, Diabrotica virgifera
  misc_feature: Coding regions on vcDNA: vcDNA=SeqID_15479; Strand=+; Position=77-334
  misc_feature: Homolog annotation: Hit_ID=AAU95193.1; Match level="QueryCoverage =93%, HitCoverage=25%, E-value=6e-11, Identity=43%"; Hit description =putative mitochondrial ADP/ATP translocase [Oncometopia nigricans]
  misc_feature (48)..(48): Xaa can be any naturally occurring amino acid
MLENIEDLLTGDIYFATPQTSIFPIEREQLHMLAQHLDNHIVEDQRHXGMGHWFAHIRQEHICIAYRRGTTANGIRYIPTLALKFL

SEQ ID NO: 35783 - protein, 183 aa, Diabrotica virgifera
  misc_feature: Coding regions on vcDNA: vcDNA=SeqID_15480; Strand=+; Position=107-655
  misc_feature (22)..(99): Xaa can be any naturally occurring amino acid
  misc_feature (105)..(111): Xaa can be any naturally occurring amino acid
  misc_feature (148)..(157): Xaa can be any naturally occurring amino acid
LTYKCHNMMCSLCYKILSNPKXXXXXXXXXXXXXXXXXXXXXXXXXXXXXXXXXXXXXXXXXXXXXXXXXXXXXXXXXXXXXXXXXXXXXXXXXXXXXXHRGGGXXXXXXXGPKIIFPGPLFKNRGGEKPGGPPILSLWKHPPFSGVXXXXXXXXXXPLPKFCQLYREKGPPPLSHIKTGGGG

SEQ ID NO: 35784 - protein, 259 aa, Diabrotica virgifera
  misc_feature: Coding regions on vcDNA: vcDNA=SeqID_15481; Strand=+; Position=27-803
  misc_feature (91)..(96): Xaa can be any naturally occurring amino acid
  misc_feature (143)..(149): Xaa can be any naturally occurring amino acid
GLYQGYSRLYHFAKSLSNPKKADGKRKKVDTDKTTQSSQAAALKKESIPDTIWNFPVVKKALSLLHEPKLTWTTVTEANTVKTKKELHQHXXXXXXYLVQQVKRRKDLETLTKKTYFDHVTYVASIIFKRIIKRLEEFVDFDXXXXXXXLECFGIILNLVNAQYKSNLKSFLSKVVSEEDSNTEDMITSLNSIVEIYQKIFERGEEELADDLEQRKLSLIAITTLNSLISHVPETSSILSVQMVEWLKNYAYHNTLSSK

SEQ ID NO: 35785 - protein, 92 aa, Diabrotica virgifera
  misc_feature: Coding regions on vcDNA: vcDNA=SeqID_15482; Strand=+; Position=182-460
AQPRSTEQYWEDEALNLQPNTCHYYSDIWTTERHAIVFSGNIQNTTPRIQITSHMNKMAQKFAKKKERWLLLLYIDYNSNGSSIDTSKSSDI

SEQ ID NO: 35786 - protein, 104 aa, Diabrotica virgifera
  misc_feature: Coding regions on vcDNA: vcDNA=SeqID_15483; Strand=+; Position=128-442
NIRCRSNPKQAYVRRIGCSTFLYRGLFMLNLGNIDEKRGKLRIYRFLPPLPPPNPTLEWCDFFLSITWPYGAVWCWRITFTLDVWDMPLFGSTVSYYRVYFLSF

SEQ ID NO: 35787 - protein, 97 aa, Diabrotica virgifera
  misc_feature: Coding regions on vcDNA: vcDNA=SeqID_15484; Strand=-; Position=1-291
CIYLGKSNVVLSKKSFSSQVWAIEGDVVSGCLGGVIGLGSDFILGFIFIVGKVTAVLIILVVKSTELIESLVIGTCTLRISLRDSRRWCTKCRERSR

SEQ ID NO: 35788 - protein, 77 aa, Diabrotica virgifera
  misc_feature: Coding regions on vcDNA: vcDNA=SeqID_15485; Strand=-; Position=198-431
  misc_feature (55)..(61): Xaa can be any naturally occurring amino acid
QLRVSPFKVNALDDDDISRPTSNNMECHKGSCYRRLDRVYSHRKHNQVYMLIWNXXXXXXXKSLTSSKRGVSCLQNN

SEQ ID NO: 35789 - protein, 50 aa, Diabrotica virgifera
  misc_feature: Coding regions on vcDNA: vcDNA=SeqID_15486; Strand=-; Position=245-397
VFSLEIFSCYSSGWLSRRTVMSVIHVRSTVLVFLIRQVHLSCLELATFEL

SEQ ID NO: 35790 - protein, 166 aa, Diabrotica virgifera
  misc_feature: Coding regions on vcDNA: vcDNA=SeqID_15487; Strand=-; Position=1-498
  misc_feature (18)..(33): Xaa can be any naturally occurring amino acid
  misc_feature (42)..(55): Xaa can be any naturally occurring amino acid
  misc_feature (57)..(74): Xaa can be any naturally occurring amino acid
  misc_feature (78)..(158): Xaa can be any naturally occurring amino acid
YYIILNKVSRLSKKSKLXXXXXXXXXXXXXXXXLSSTPPSHXXXXXXXXXXXXXXHXXXXXXXXXXXXXXXXXXQKDXXXXXXXXXXXXXXXXXXXXXXXXXXXXXXXXXXXXXXXXXXXXXXXXXXXXXXXXXXXXXXXXXXXXXXXXXXXXXXXXXTYNFIFNL

SEQ ID NO: 35791 - protein, 49 aa, Diabrotica virgifera
  misc_feature: Coding regions on vcDNA: vcDNA=SeqID_15488; Strand=+; Position=98-247
LNRNQTAPSDSTPDPLAVLSSSTPPMSPGDALKTHNIVHRTDTPRETAK

SEQ ID NO: 35792 - protein, 284 aa, Diabrotica virgifera
  misc_feature: Coding regions on vcDNA: vcDNA=SeqID_15489; Strand=-; Position=2-853
  misc_feature (8)..(17): Xaa can be any naturally occurring amino acid
  misc_feature (20)..(44): Xaa can be any naturally occurring amino acid
  misc_feature (50)..(59): Xaa can be any naturally occurring amino acid
  misc_feature (63)..(90): Xaa can be any naturally occurring amino acid
  misc_feature (92)..(102): Xaa can be any naturally occurring amino acid
  misc_feature (112)..(120): Xaa can be any naturally occurring amino acid
  misc_feature (122)..(135): Xaa can be any naturally occurring amino acid
  misc_feature (142)..(154): Xaa can be any naturally occurring amino acid
  misc_feature (156)..(284): Xaa can be any naturally occurring amino acid
MLVFFRAXXXXXXXXXXYGXXXXXXXXXXXXXXXXXXXXXXXXXYIMLVXXXXXXXXXXLGLXXXXXXXXXXXXXXXXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35793 - protein, 63 aa, Diabrotica virgifera
  misc_feature: Coding regions on vcDNA: vcDNA=SeqID_15490; Strand=-; Position=88-279
LISLLILFSTLNIIAFLCLVFRDLPRSLYLICNTPEYTALVASRDQEIYSIFFCLFSFFPNQC

SEQ ID NO: 35794 - protein, 78 aa, Diabrotica virgifera
  misc_feature: Coding regions on vcDNA: vcDNA=SeqID_15491; Strand=-; Position=0-233
  misc_feature (22)..(31): Xaa can be any naturally occurring amino acid
  misc_feature (48)..(69): Xaa can be any naturally occurring amino acid
PILFYSHQSCLFTILPCRINCXXXXXXXXXXKWCRRQCLKIEKIVNTXXXXXXXXXXXXXXXXXXXXXXVKKITRTRR

SEQ ID NO: 35795 - protein, 305 aa, Diabrotica virgifera
  misc_feature: Coding regions on vcDNA: vcDNA=SeqID_15492; Strand=-; Position=0-914
  misc_feature (1)..(289): Xaa can be any naturally occurring amino acid
  misc_feature (291)..(302): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXGGG

SEQ ID NO: 35796 - protein, 346 aa, Diabrotica virgifera
  misc_feature: Coding regions on vcDNA: vcDNA=SeqID_15493; Strand=+; Position=2-1039
  misc_feature (1)..(23): Xaa can be any naturally occurring amino acid
  misc_feature (25)..(38): Xaa can be any naturally occurring amino acid
  misc_feature (40)..(49): Xaa can be any naturally occurring amino acid
  misc_feature (57)..(76): Xaa can be any naturally occurring amino acid
  misc_feature (78)..(89): Xaa can be any naturally occurring amino acid
  misc_feature (99)..(117): Xaa can be any naturally occurring amino acid
  misc_feature (120)..(142): Xaa can be any naturally occurring amino acid
  misc_feature (148)..(177): Xaa can be any naturally occurring amino acid
  misc_feature (181)..(196): Xaa can be any naturally occurring amino acid
  misc_feature (198)..(235): Xaa can be any naturally occurring amino acid
  misc_feature (244)..(250): Xaa can be any naturally occurring amino acid
  misc_feature (253)..(267): Xaa can be any naturally occurring amino acid
  misc_feature (277)..(312): Xaa can be any naturally occurring amino acid
  misc_feature (315)..(339): Xaa can be any naturally occurring amino acid
XXXXXXXXXXXXXXXXXXXXXXXFXXXXXXXXXXXXXXSXXXXXXXXXXNSPPPLCXXXXXXXXXXXXXXXXXXXXAXXXXXXXXXXXXLLWLVAGEGXXXXXXXXXXXXXXXXXXXVCXXXXXXXXXXXXXXXXXXXXXXXSFLTYXXXXXXXXXXXXXXXXXXXXXXXXXXXXXXGRGXXXXXXXXXXXXXXXXVXXXXXXXXXXXXXXXXXXXXXXXXXXXXXXXXXXXXXXFPLPNSGTXXXXXXXDKXXXXXXXXXXXXXXXPQKTSPHPLXXXXXXXXXXXXXXXXXXXXXXXXXXXXXXXXXXXXARXXXXXXXXXXXXXXXXXXXXXXXXXVEGEKER

SEQ ID NO: 35797 - protein, 40 aa, Diabrotica virgifera
  misc_feature: Coding regions on vcDNA: vcDNA=SeqID_15494; Strand=-; Position=3-125
  misc_feature (34)..(34): Xaa can be any naturally occurring amino acid
GGTHIPFDLINLYHEQLFFFCFKRFSKGALILFXFCQDVP

SEQ ID NO: 35798 - protein, 87 aa, Diabrotica virgifera
  misc_feature: Coding regions on vcDNA: vcDNA=SeqID_15495; Strand=-; Position=1-261
  misc_feature (2)..(37): Xaa can be any naturally occurring amino acid
  misc_feature (40)..(81): Xaa can be any naturally occurring amino acid
  misc_feature (84)..(84): Xaa can be any naturally occurring amino acid
LXXXXXXXXXXXXXXXXXXXXXXXXXXXXXXXXXXXXARXXXXXXXXXXXXXXXXXXXXXXXXXXXXXXXXXXXXXXXXXXTKXYNF

SEQ ID NO: 35799 - protein, 62 aa, Diabrotica virgifera
  misc_feature: Coding regions on vcDNA: vcDNA=SeqID_15496; Strand=-; Position=1-186
  misc_feature (1)..(5): Xaa can be any naturally occurring amino acid
XXXXXRSLHSSFSFTTRSLASSCCPTIASVFSVPLSISRVISFIFLLFEFMLMIFFLFRVGQ

SEQ ID NO: 35800 - protein, 295 aa, Diabrotica virgifera
  misc_feature: Coding regions on vcDNA: vcDNA=SeqID_15497; Strand=-; Position=1-885
  misc_feature (1)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTE

SEQ ID NO: 35801 - protein, 132 aa, Diabrotica virgifera
  misc_feature: Coding regions on vcDNA: vcDNA=SeqID_15498; Strand=-; Position=87-485
  misc_feature (5)..(14): Xaa can be any naturally occurring amino acid
  misc_feature (25)..(32): Xaa can be any naturally occurring amino acid
  misc_feature (45)..(45): Xaa can be any naturally occurring amino acid
  misc_feature (56)..(56): Xaa can be any naturally occurring amino acid
  misc_feature (70)..(101): Xaa can be any naturally occurring amino acid
  misc_feature (104)..(125): Xaa can be any naturally occurring amino acid
VPLLXXXXXXXXXXTPTWVPHGLNXXXXXXXXRTDLINITATPFXKLNPNIEVGIXIIDLTSPIKFTLLXXXXXXXXXXXXXXXXXXXXXXXXXXXXXXXXSPXXXXXXXXXXXXXXXXXXXXXXSIGLSRL

SEQ ID NO: 35802 - protein, 90 aa, Diabrotica virgifera
  misc_feature: Coding regions on vcDNA: vcDNA=SeqID_15499; Strand=-; Position=39-311
FLISGAIIVISLNGHSITTPDYRISRFIITPRTPPTTWSSDSKGDTCLVNPILSIATLNKDQITSIMIWLAGGLVSSLRRFYMVGSPQSD

SEQ ID NO: 35803 - protein, 92 aa, Diabrotica virgifera
  misc_feature: Coding regions on vcDNA: vcDNA=SeqID_15500; Strand=+; Position=3-281
AHPLCPTMYTCVFMRNEDMYYRLYRLTHIRLCRLRKASLDHTDLPSESTGYIVFCPHSEHHAKYYGTTMNVYKFLLNKKYVLLLPQRYEIRR

SEQ ID NO: 35804 - protein, 208 aa, Diabrotica virgifera
  misc_feature: Coding regions on vcDNA: vcDNA=SeqID_15501; Strand=-; Position=1-624
  misc_feature (4)..(205): Xaa can be any naturally occurring amino acid
KKWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSP

SEQ ID NO: 35805 - protein, 237 aa, Diabrotica virgifera
  misc_feature: Coding regions on vcDNA: vcDNA=SeqID_15502; Strand=+; Position=3-716
YLCFVFMQVKRGTTLDKTAPIMLSWLQEASLDHTNHHLIKLFISNFGHILNFSPNMMLHQWTFINSWLIKYLSFCYHKDMTSTLEVILSALEKVENPDSWPFWIRVFRNFVYPVIKQLSCVHNAQKTIGTIAGKLHLLIPHSSTEIFSYFTSDIVPPQIALSFLTIVLEDYPSRCILNAQQETDVIQCWIKVCLLSSEPYSALTKIVTKFDTFPMHLKTYINSSDDPLRALVEYFGK

SEQ ID NO: 35806 - protein, 108 aa, Diabrotica virgifera
  misc_feature: Coding regions on vcDNA: vcDNA=SeqID_15503; Strand=-; Position=3-326
RVLHRRPHGSLIARTDDLEILSTSIATERKIHDCADDSGCLPTTICSGFYSGRAPGLLNLALAKIPDVAPTILQEFSYSSMIPTYYVGASGGPAAFRPGPAGDHFPYR

SEQ ID NO: 35807 - protein, 266 aa, Diabrotica virgifera
  misc_feature: Coding regions on vcDNA: vcDNA=SeqID_15504; Strand=+; Position=57-854
  misc_feature: Homolog annotation: Hit_ID=XP_317854.1; Match level="QueryCoverage =93%, HitCoverage=27%, E-value=1e-27, Identity=36%"; Hit description =ENSANGP00000014393 [Anopheles gambiae]
MEDRRTYHLIAYLNMEVELLKPGTVPISPETILWFEFLLDPNLLLKHLEKLSADPPPSELITKFYDVISETLRNNPDTENGEIINVETNNGKTKPPAKTTALKILSLKVGAFLKWNLVQIRNLPFKTQISLLQDLMYFTNDKKTVEIPNVEEEDVKTASPPYLFALLLFHRWLLSTSMHRITSNWQIRYGINDISKADESIICCPENINKTVNFLTEALEWQIIPALLTFDCFKLPTESNDCIEFEWTKSEELKKNEFCAQINYDL

SEQ ID NO: 35808 - protein, 95 aa, Diabrotica virgifera
  misc_feature: Coding regions on vcDNA: vcDNA=SeqID_15505; Strand=-; Position=234-521
KMAKSQESTMHPMAETWKQDETTNKKLQTFVNKSLRKNHDKSREKLDWPYFEDIDAFLAKWRKWHFLKSCFSFKITLLLFIRHFQSVVSLYIYYV

SEQ ID NO: 35809 - protein, 82 aa, Diabrotica virgifera
  misc_feature: Coding regions on vcDNA: vcDNA=SeqID_15506; Strand=-; Position=2-247
DLHHVSSRQGTPVWVLPGYTMEVQVDGTLEAQDMDMDLKIANIDMDFKGMGVLQGVVNSVGTFFFDSMKPFVLREANTNMRA

SEQ ID NO: 35810 - protein, 167 aa, Diabrotica virgifera
  misc_feature: Coding regions on vcDNA: vcDNA=SeqID_15507; Strand=+; Position=102-603
  misc_feature: Homolog annotation: Hit_ID=NP_649835.1; Match level="QueryCoverage =96%, HitCoverage=29%, E-value=5e-28, Identity=44%"; Hit description =CG8351-PA [Drosophila melanogaster] gb|AAF54292.2| CG8351-PA [Drosophila melanogaster]
  misc_feature: Gene Ontology Annotation: Molecular function=chaperone activity; Cellular component=cytoskeleton; Biological process=cytoskeleton organization and biogenesis
  misc_feature (136)..(136): Xaa can be any naturally occurring amino acid
MMLPHILLLQQGAASSHGTPPLSSNLNACHNDTYAVVATLVSRSMDKLVATREGHASISYKGTSILRLLDFVLHAMKTFVDIDKSQYGEGGDCTTRASITESGEFSPQIKPYGDEDVQPRIILLAGRVAYLICLEXIIEMAVDIKKAYADELQTTLESLGSSRHDLK

SEQ ID NO: 35811 - protein, 44 aa, Diabrotica virgifera
  misc_feature: Coding regions on vcDNA: vcDNA=SeqID_15508; Strand=-; Position=3-134
LLACFGVAVVAVGVRFLVVEQAILGYECVRGWVVVLLAGLGFQC

SEQ ID NO: 35812 - protein, 189 aa, Diabrotica virgifera
  misc_feature: Coding regions on vcDNA: vcDNA=SeqID_15509; Strand=-; Position=41-610
  misc_feature: Homolog annotation: Hit_ID=AAA29354.1; Match level="QueryCoverage =98%, HitCoverage=21%, E-value=5e-31, Identity=36%"; Hit description =reverse transcriptase-like protein
ITGLLYKMRGYGYSEAMTRLISSYLGDRSFRVRIGQVLSELGNPEAGVPQGAVLSPLLYTIYTADVPRTPGTLMSLYADDTAIAAKHRNVDIAVTNLQTALQEIEEWSIKWKIAINSEKTQAVLYKKGRQQPKEQLTVQNTPIEWKNEAKYLGVIMDKGLTFQKHVEATVHKANIAKSTLRGLTGRKAK

SEQ ID NO: 35813 - protein, 106 aa, Diabrotica virgifera
  misc_feature: Coding regions on vcDNA: vcDNA=SeqID_15510; Strand=+; Position=23-343
  misc_feature: Homolog annotation: Hit_ID=XP_394962.1; Match level="QueryCoverage =71%, HitCoverage=12%, E-value=2e-15, Identity=53%"; Hit description =similar to ENSANGP00000003484 [Apis mellifera]
MVRAKRAAYRKDILHPKMDESHYILRPDTIPPARQMFYQFCDVLLPEIQEMMQRLPKAQAKLDAKNGWLPVNFLDQCREIANKYVMKNVHQQLVAYSLKTGNKTNI

SEQ ID NO: 35814 - protein, 84 aa, Diabrotica virgifera
  misc_feature: Coding regions on vcDNA: vcDNA=SeqID_15511; Strand=-; Position=332-586
ITFEEKHDVARPTLLSTILGHGLCPIDCYKNPAETMISSIPPSLEISSTVWGVFTLSALVLKGTSMALTEGPSRHTRCSYLPRA

SEQ ID NO: 35815 - protein, 70 aa, Diabrotica virgifera
  misc_feature: Coding regions on vcDNA: vcDNA=SeqID_15512; Strand=+; Position=65-275
  misc_feature: Homolog annotation: Hit_ID=AAL90273.1; Match level="QueryCoverage =100%, HitCoverage=19%, E-value=2e-18, Identity=71%"; Hit description= LD04994p [Drosophila melanogaster]
  misc_feature: Gene Ontology Annotation: Biological process=reproduction
  misc_feature (16)..(16): Xaa can be any naturally occurring amino acid
  misc_feature (32)..(32): Xaa can be any naturally occurring amino acid
  misc_feature (41)..(41): Xaa can be any naturally occurring amino acid
AELSLNAAGRSNGIVXHSGDGVSHTGPIYEKXALPPAILRXDLYDRELSDYLMNILNERGESFTTTAVRE

SEQ ID NO: 35816 - protein, 228 aa, Diabrotica virgifera
  misc_feature: Coding regions on vcDNA: vcDNA=SeqID_15513; Strand=+; Position=3-686
  misc_feature: Homolog annotation: Hit_ID=XP_393213.1; Match level="QueryCoverage =86%, HitCoverage=16%, E-value=9e-38, Identity=45%"; Hit description =similar to ENSANGP00000014350 [Apis mellifera]
  misc_feature (139)..(161): Xaa can be any naturally occurring amino acid
RSSTSITTGSYTPTVKFRNNSNDLGGTTVTTSPLVTSSTEDYVSDSSPAPDGESSGRDDNTGKIAAIVISTVGAVSLILLAGLLYIMRKRQKRFNYKQRCRPVSLDHYNVDNVSSFNSQRRKAERQSKRSYGNPAFDDXXXXXXXXXXXXXXXXXXXXXXXKAEFSRIPQITAKISELPDGCETKNRYANVIPLPETRVYLQPIDGYPTSDYINANYVTGPKNTKGYY

SEQ ID NO: 35817 - protein, 62 aa, Diabrotica virgifera
  misc_feature: Coding regions on vcDNA: vcDNA=SeqID_15514; Strand=+; Position=12-200
KAPCMDALITRGVGGAHTETDTHASHLPTAPFSLFPSFLSPLARFPPPALSRSLPPCMRSID

SEQ ID NO: 35818 - protein, 19 aa, Diabrotica virgifera
  misc_feature: Coding regions on vcDNA: vcDNA=SeqID_15515; Strand=-; Position=1-57
LKSSYLIFSGYKIAPPRRL

SEQ ID NO: 35819 - protein, 144 aa, Diabrotica virgifera
  misc_feature: Coding regions on vcDNA: vcDNA=SeqID_15516; Strand=+; Position=127-561
  misc_feature: Homolog annotation: Hit_ID=AAA56741.1; Match level="QueryCoverage =90%, HitCoverage=69%, E-value=1e-14, Identity=37%"; Hit description =lacZ alpha peptide
  misc_feature (25)..(25): Xaa can be any naturally occurring amino acid
  misc_feature (45)..(51): Xaa can be any naturally occurring amino acid
  misc_feature (98)..(98): Xaa can be any naturally occurring amino acid
QHPDWTHLDLPELNPPVAHRPNTKXGHTEQPPPHLPSQNGQSQKXXXXXXXTAAVMATRVVTTTIATATLAAPLASFPSFLFTSFLFTRDGLPRQVPXRGLPIGLRYIDPQNLDHKEVDHSDASPRETSPRHTTLHPTTLMSKS

SEQ ID NO: 35820 - protein, 123 aa, Diabrotica virgifera
  misc_feature: Coding regions on vcDNA: vcDNA=SeqID_15517; Strand=+; Position=3-371
CPVRHSCVWLIHLSPRPELPKVGLPQKLKRGETTQTQHTGLRKGSNGSRESRRRIAHTLVICTKISYPLKDGTEIVQISKKDPRRNRDDNSQPPHWPSSVWERTTAGLEADQTVRCIILPNIY

SEQ ID NO: 35821 - protein, 57 aa, Diabrotica virgifera
  misc_feature: Coding regions on vcDNA: vcDNA=SeqID_15518; Strand=-; Position=2-172
LMIQQIPIKQETHFSRLSAPSFYGPAPSHLSGRRRDGSRNKHILRRSEEKGGGPGEF

SEQ ID NO: 35822 - protein, 70 aa, Diabrotica virgifera
  misc_feature: Coding regions on vcDNA: vcDNA=SeqID_15519; Strand=+; Position=222-434
NLNAFAVLPLFERFVSPQTLVCGPLQAPPYLRIFHTKKGKKKRPHLNAPHIHHQFILQFDLISVRQFKPI

SEQ ID NO: 35823 - protein, 55 aa, Diabrotica virgifera
  misc_feature: Coding regions on vcDNA: vcDNA=SeqID_15520; Strand=-; Position=148-315
VYRGICIYAYVSPTRVVGLVDSLSMFFSDFCLLGDIWHQVHVLRVSTHTVQGSVS

SEQ ID NO: 35824 - protein, 267 aa, Diabrotica virgifera
  misc_feature: Coding regions on vcDNA: vcDNA=SeqID_15521; Strand=+; Position=113-917
  misc_feature: Homolog annotation: Hit_ID=XP_394536.1; Match level="QueryCoverage =94%, HitCoverage=60%, E-value=1e-105, Identity=75%"; Hit description= similar to ENSANGP00000012356 [Apis mellifera]
  misc_feature: Gene Ontology Annotation: Molecular function=cyclin-dependent protein kinase, intrinsic regulator activity; Cellular component =transcription factor complex; Biological process=regulation of CDK activity
  misc_feature: Pfam annotation: Pfam_ID=Cyclin_N; Match level="Score=41.7, E-value =2.1e-09, Copies=1"; Pfam description=Cyclin, N-terminal domain
  misc_feature (5)..(13): Xaa can be any naturally occurring amino acid
  misc_feature (111)..(118): Xaa can be any naturally occurring amino acid
  misc_feature (219)..(219): Xaa can be any naturally occurring amino acid
MPGWXXXXXXXXXTPSSQDGIDYKTEMRYRKEGARLIIDTGTKMDLGYNTMATGVVYYHRFYMFHSFKQFPRYVTACCCLFLAGKVEETPKKCKDIIKTARGLLNDHKFAXXXXXXXXEVMTLERILLQTIKFDLQVEHPYQYLLKYAKCLKGDKGKLQKMGQMAWNFVNDRLCTTLCLQWGPEIIAVALMYLAGKLSKIESIDWIGRHSKQCRMWDMXVENVTWDLLKDICLQGLGLNIPINNKPPKRPPRGQKGPQNTFTHSKRF

SEQ ID NO: 35825 - protein, 84 aa, Diabrotica virgifera
  misc_feature: Coding regions on vcDNA: vcDNA=SeqID_15522; Strand=+; Position=2-254
  misc_feature: Homolog annotation: Hit_ID=NP_476443.1; Match level="QueryCoverage =94%, HitCoverage=26%, E-value=1e-20, Identity=63%"; Hit description =solute carrier family 25, member 5 [Rattus norvegicus] gb|AAH59108.1| Solute carrier family 25,
  misc_feature: Gene Ontology Annotation: Molecular function=transporter activity; Cellular component=integral to plasma membrane; Biological process =transport
  misc_feature (64)..(64): Xaa can be any naturally occurring amino acid
GTRVILNTWCGKCDNEIRYYTSLALNFACKEKYKQIFLRGGDKKTQDWSYFLGNLVSGGVDGAXTSLCFVYRLDFSRIKLAGDD

SEQ ID NO: 35826 - protein, 283 aa, Diabrotica virgifera
  misc_feature: Coding regions on vcDNA: vcDNA=SeqID_15523; Strand=+; Position=3-851
  misc_feature (16)..(269): Xaa can be any naturally occurring amino acid
NIVVIHLTFKILDWDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSPKSRDSAGQKGE

SEQ ID NO: 35827 - protein, 170 aa, Diabrotica virgifera
  misc_feature: Coding regions on vcDNA: vcDNA=SeqID_15524; Strand=-; Position=1-510
  misc_feature (4)..(169): Xaa can be any naturally occurring amino acid
LITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 35828 - protein, 109 aa, Diabrotica virgifera
  misc_feature: Coding regions on vcDNA: vcDNA=SeqID_15525; Strand=-; Position=911 -1240
  misc_feature (4)..(13): Xaa can be any naturally occurring amino acid
  misc_feature (18)..(35): Xaa can be any naturally occurring amino acid
GGTXXXXXXXXXXFLKGXXXXXXXXXXXXXXXXXXGNFGGIGKLLGCFFSPPGVKDPSGSKGQMGDKKAQKTILPSFLDLPDVCSDYKELFRNLPNLVSNRLIFQYVPR

SEQ ID NO: 35829 - protein, 149 aa, Diabrotica virgifera
  misc_feature: Coding regions on vcDNA: vcDNA=SeqID_15526; Strand=+; Position=231-680
IIRYFPYNNKKMNSYNRINGYESIEIHNLQEVYNESCDAVKFKIWGLREDRTRNFLYHFGCVILLGIPYLLFCFYPKLKSVKFKKAPLESATILLITDNFGVSEYVTVQNEIISLLNVTELRYFLYQHTRYIWHCETKSFVTLQDFMPA

SEQ ID NO: 35830 - protein, 178 aa, Diabrotica virgifera
  misc_feature: Coding regions on vcDNA: vcDNA=SeqID_15527; Strand=+; Position=1-537
PITSIINNCTSPNVTISVSNQPSNIPCKEIIFQMRLNFENPFKYPDCNKTLNIKTVEHLIMTKPPHVVINFLQEEMDILKNCNIDPKRLKRKIPKLDKVLDSKKKIAKKVFRETNYWYKVLNMFVFGLYKHKDGNLHINYLEKFLSQSKNMTLDHNKRTSLFSSYSYVFGCNRHVYVD

SEQ ID NO: 35831 - protein, 196 aa, Diabrotica virgifera
  misc_feature: Coding regions on vcDNA: vcDNA=SeqID_15528; Strand=-; Position=2-589
  misc_feature (24)..(194): Xaa can be any naturally occurring amino acid
TIIQHRGRNLYYRFDLSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDK

SEQ ID NO: 35832 - protein, 179 aa, Diabrotica virgifera
  misc_feature: Coding regions on vcDNA: vcDNA=SeqID_15529; Strand=+; Position=3-534
  misc_feature: Homolog annotation: Hit_ID=AAO57982.1; Match level="QueryCoverage =99%, HitCoverage=34%, E-value=2e-47, Identity=58%"; Hit description =peptide ABC transporter, periplasmic peptide-binding protein, putative [Pseudomonas syringae pv. tomato st
  misc_feature (61)..(61): Xaa can be any naturally occurring amino acid
  misc_feature (108)..(108): Xaa can be any naturally occurring amino acid
  misc_feature (127)..(127): Xaa can be any naturally occurring amino acid
  misc_feature (142)..(142): Xaa can be any naturally occurring amino acid
EDHLLINRGHGLLAKPEVRQELDMAIYKQSLEKTAAFGQGTEYYSYIPKGSLYHYANNLQXPSYDPTEAKKLLAADGAQDLKLNYVDDALATRPTSRLAEMIKDNVAXKPCVVRSTCKRTIRPHMWXQMLMDVEYDISLMNXTMDILDPNEKTTFVLLHETNQNYMTRYKNDNVKELLL

SEQ ID NO: 35833 - protein, 18 aa, Diabrotica virgifera
  misc_feature: Coding regions on vcDNA: vcDNA=SeqID_15530; Strand=-; Position=1-54
  misc_feature (3)..(15): Xaa can be any naturally occurring amino acid
LLXXXXXXXXXXXXXIKK

SEQ ID NO: 35834 - protein, 50 aa, Diabrotica virgifera
  misc_feature: Coding regions on vcDNA: vcDNA=SeqID_15531; Strand=+; Position=3-152
KEIRQHYFPLSYESHGFFRLINNVSPAHRLIFNGRVHFDRAIGTESSRSL

SEQ ID NO: 35835 - protein, 64 aa, Diabrotica virgifera
  misc_feature: Coding regions on vcDNA: vcDNA=SeqID_15532; Strand=+; Position=34-229
  misc_feature: Homolog annotation: Hit_ID=AAH86701.1; Match level="QueryCoverage =87%, HitCoverage=12%, E-value=2e-22, Identity=91%"; Hit description =Zgc:101545 [Danio rerio] ref|NP_001008638.1| zgc:101545 [Danio rerio] sp|P02993|EF1A_ARTSA Elongation fact
  misc_feature: Gene Ontology Annotation: Molecular function=translation factor activity, nucleic acid binding; Biological process=protein biosynthesis
  misc_feature (16)..(16): Xaa can be any naturally occurring amino acid
MGKELIHINIDVIGHXDSGKSTSTGHLIYYCGGIDKRTIEKFEKEAQEMGKGSFKYDHGYYDQT

SEQ ID NO: 35836 - protein, 184 aa, Diabrotica virgifera
  misc_feature: Coding regions on vcDNA: vcDNA=SeqID_15533; Strand=-; Position=89-643
  misc_feature (165)..(171): Xaa can be any naturally occurring amino acid
PVHPTKGRQDLLWLVFSLLLLQWLFTSFLGFSRAFPCRFFMHRVPVAYASISPVIAIPVVIIDVFISFNSNRLLSSFLLQHLAIRLFYPHYHIFSVLYFTCRFVSVLVLLFTISLSWGPSLSCSCLPYSRPSRFWVLLWGVSLFISPFGSCLCFLPQSVPKIQIXXXXXXXLLSYPCGPIRVGL

SEQ ID NO: 35837 - protein, 100 aa, Diabrotica virgifera
  misc_feature: Coding regions on vcDNA: vcDNA=SeqID_15534; Strand=-; Position=9-311
LLVYQMQVRINIEAHIHYVRAPLVLRAPATAPHSGYVRATGSCNGARSSSARQSVSVYTLLQEIKAPTQKLIIFDVSNSLNLLSNLSDFLNMSYSLTISL

SEQ ID NO: 35838 - protein, 138 aa, Diabrotica virgifera
  misc_feature: Coding regions on vcDNA: vcDNA=SeqID_15535; Strand=-; Position=2-415
  misc_feature: Homolog annotation: Hit_ID=AAP46694.1; Match level="QueryCoverage =89%, HitCoverage=23%, E-value=6e-50, Identity=82%"; Hit description =AlgG [Pseudomonas fluorescens] sp|P59828|ALGG_PSEFL Poly(beta-D -mannuronate) C5 epimerase precursor
FARDLELVGRESRRCAMNPQALKGSVSLLVAAMLLASTSAFADVAQQVKAPTIAKELQQAKTYTISSPPTEPLELAKPALPDVSGYTAANIAKKIVRSKPGKISIRRMMQEDAVKDFIGGDNKKAEWGVRQHGIPQAK

SEQ ID NO: 35839 - protein, 80 aa, Diabrotica virgifera
  misc_feature: Coding regions on vcDNA: vcDNA=SeqID_15536; Strand=-; Position=1-240
  misc_feature (71)..(78): Xaa can be any naturally occurring amino acid
FSFSWTIASHSSHFIASPLSRHVLHLFFKRLSSLLRASASKPSFRGYIIKPLPSNVGRGSYSSLTKASCAXXXXXXXXHK

SEQ ID NO: 35840 - protein, 36 aa, Diabrotica virgifera
  misc_feature: Coding regions on vcDNA: vcDNA=SeqID_15537; Strand=-; Position=1-108
  misc_feature (23)..(29): Xaa can be any naturally occurring amino acid
FPRVFSPCVGIPSLNLTPLGAPXXXXXXXFLLSTKG

SEQ ID NO: 35841 - protein, 122 aa, Diabrotica virgifera
  misc_feature: Coding regions on vcDNA: vcDNA=SeqID_15538; Strand=+; Position=85-449
  misc_feature: Homolog annotation: Hit_ID=XP_312606.1; Match level="QueryCoverage =91%, HitCoverage=25%, E-value=5e-28, Identity=51%"; Hit description =ENSANGP00000014953 [Anopheles gambiae]
  misc_feature: Gene Ontology Annotation: Molecular function=lipase activity; Cellular component=extracellular; Biological process=digestion
  misc_feature (33)..(33): Xaa can be any naturally occurring amino acid
STLTTLKKIYLVYLSHELLCSSIDWVILLPNNXLSFLLHDEAYDPWIRNDTGNNYSRNHTTLDPYKHADAFWDFSCNEIDMYDIPTMIDYILKTTGKSQVFLVGHSPGTTSFYVIASEKPEY

SEQ ID NO: 35842 - protein, 68 aa, Diabrotica virgifera
  misc_feature: Coding regions on vcDNA: vcDNA=SeqID_15539; Strand=+; Position=46-253
  misc_feature (25)..(25): Xaa can be any naturally occurring amino acid
  misc_feature (55)..(55): Xaa can be any naturally occurring amino acid
CPFNLYVVFYSSYLFAEQRSTTIEXDVAPYIWYSSVGGLFTRLPNDEQPLPRGTXIDLYSKKDKTEFL

SEQ ID NO: 35843 - protein, 104 aa, Diabrotica virgifera
  misc_feature: Coding regions on vcDNA: vcDNA=SeqID_15540; Strand=+; Position=2-313
  misc_feature (3)..(14): Xaa can be any naturally occurring amino acid
  misc_feature (18)..(24): Xaa can be any naturally occurring amino acid
ASXXXXXXXXXXXXFLLXXXXXXXGISSVKSKSLTITKNNYDFINPVSEVVEEKVGTTFSLICELILSDQEKESSAVDDHLTWAKKEILSNQTGFQKIISSIQG

SEQ ID NO: 35844 - protein, 94 aa, Diabrotica virgifera
  misc_feature: Coding regions on vcDNA: vcDNA=SeqID_15541; Strand=+; Position=1-282
  misc_feature (3)..(11): Xaa can be any naturally occurring amino acid
  misc_feature (16)..(59): Xaa can be any naturally occurring amino acid
  misc_feature (63)..(81): Xaa can be any naturally occurring amino acid
PLXXXXXXXXXPLAPXXXXXXXXXXXXXXXXXXXXXXXXXXXXXXXXXXXXXXXXXXXXPNSXXXXXXXXXXXXXXXXXXXVMTCYSYVTISNF

SEQ ID NO: 35845 - protein, 92 aa, Diabrotica virgifera
  misc_feature: Coding regions on vcDNA: vcDNA=SeqID_15542; Strand=-; Position=356-634
CLNNRAKYRNNGQGYRVRNYTFEIVNKFIHLDSFIICNNYTMERIKRTIHDTTRETCYFRLSKYLKNWDLNSNFSMESIPSALVKKKINKTT

SEQ ID NO: 35846 - protein, 189 aa, Diabrotica virgifera
  misc_feature: Coding regions on vcDNA: vcDNA=SeqID_15543; Strand=+; Position=106-675
  misc_feature: Homolog annotation: Hit_ID=NP_651528.1; Match level="QueryCoverage =34%, HitCoverage=10%, E-value=2e-09, Identity=49%"; Hit description =CG14257-PA [Drosophila melanogaster] gb|AAF56659.1| CG14257-PA [Drosophila melanogaster]
  misc_feature (41)..(51): Xaa can be any naturally occurring amino acid
MVSAYNSCELLVRNYQCCTLIYICPFAFDFWDLKKSVLNTXXXXXXXXXXXVIAVKGQLIKGGGKLVSASGHLVSSQGDAITNLGKQIATSAILVPWMGSSGKGHPHAEYESDHHYTAPSAPEDIHYHHGPHSDHHEDYHVPEHYPPPHRADAAGLLVLKKVTNRWQPQPPSTRPLRFNVGHQPPPSIS

SEQ ID NO: 35847 - protein, 206 aa, Diabrotica virgifera
  misc_feature: Coding regions on vcDNA: vcDNA=SeqID_15544; Strand=-; Position=1-621
  misc_feature (1)..(8): Xaa can be any naturally occurring amino acid
  misc_feature (11)..(21): Xaa can be any naturally occurring amino acid
  misc_feature (31)..(38): Xaa can be any naturally occurring amino acid
  misc_feature (40)..(48): Xaa can be any naturally occurring amino acid
  misc_feature (59)..(72): Xaa can be any naturally occurring amino acid
  misc_feature (74)..(192): Xaa can be any naturally occurring amino acid
  misc_feature (200)..(200): Xaa can be any naturally occurring amino acid
XXXXXXXXFFXXXXXXXXXXXTTLVTPGLTXXXXXXXXEXXXXXXXXXNYKLNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRETLYLEXATRSPQ

SEQ ID NO: 35848 - protein, 22 aa, Diabrotica virgifera
  misc_feature: Coding regions on vcDNA: vcDNA=SeqID_15545; Strand=+; Position=2-70
WEKPPKTYLPVNSFELKRKLPI

SEQ ID NO: 35849 - protein, 60 aa, Diabrotica virgifera
  misc_feature: Coding regions on vcDNA: vcDNA=SeqID_15546; Strand=+; Position=237-419
  misc_feature (30)..(47): Xaa can be any naturally occurring amino acid
TLKRFLNCKNYIRFNGFCWQTIRLNKNTCXXXXXXXXXXXXXXXXXXEPKQIYYSLMIGY

SEQ ID NO: 35850 - protein, 81 aa, Diabrotica virgifera
  misc_feature: Coding regions on vcDNA: vcDNA=SeqID_15547; Strand=+; Position=2-247
FVRNYDGNFTVIIVSYTRPEIDKDLYYLVFLKHVSQLNSVESVDHHYFCLSFIDFQTNFIALVSVLSTLRRRLNIVAHLLL

SEQ ID NO: 35851 - protein, 124 aa, Diabrotica virgifera
  misc_feature: Coding regions on vcDNA: vcDNA=SeqID_15548; Strand=+; Position=131-505
  misc_feature: Homolog annotation: Hit_ID=EAL29075.1; Match level="QueryCoverage =79%, HitCoverage=18%, E-value=2e-24, Identity=52%"; Hit description =GA19749-PA [Drosophila pseudoobscura]
  misc_feature: Gene Ontology Annotation: Molecular function=UDP-glycosyltransferase activity; Cellular component=endoplasmic reticulum; Biological process=digestion
IVYILVIHYYLQDLEKFITDSKHGVIYMCMGSTIRGARFPESKKQAFMKAFSKLPQRVIWKWEEEMKDKPDNVFDTRWAPQRDVLWHPNVKLFITHSGLLRTLKADDCGKLQMTLLYLLGDQYV

SEQ ID NO: 35852 - protein, 34 aa, Diabrotica virgifera
  misc_feature: Coding regions on vcDNA: vcDNA=SeqID_15549; Strand=-; Position=0-101
  misc_feature (3)..(13): Xaa can be any naturally occurring amino acid
  misc_feature (22)..(22): Xaa can be any naturally occurring amino acid
  misc_feature (25)..(25): Xaa can be any naturally occurring amino acid
  misc_feature (27)..(28): Xaa can be any naturally occurring amino acid
KNXXXXXXXXXXXNATNDGVDXREXSXXPGTCPG

SEQ ID NO: 35853 - protein, 152 aa, Diabrotica virgifera
  misc_feature: Coding regions on vcDNA: vcDNA=SeqID_15550; Strand=+; Position=7-465
  misc_feature (6)..(7): Xaa can be any naturally occurring amino acid
  misc_feature (28)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (66)..(72): Xaa can be any naturally occurring amino acid
  misc_feature (127)..(127): Xaa can be any naturally occurring amino acid
YRGQPXXRRTAHLSSKRAPKKRQRRRRXTKHTXTKPPPLPRRXRNKSTPGHPPEQRAQQRPREAEXXXXXXXRTAPSTEKRSRPRRQDTATTKTRRHKGARTSQTKPRRERKRTGLNKARRKRATTXTNRKHQVPLKAVTLLTTWKTTFKNF

SEQ ID NO: 35854 - protein, 182 aa, Diabrotica virgifera
  misc_feature: Coding regions on vcDNA: vcDNA=SeqID_15551; Strand=+; Position=169-717
REVYRQAKVCLGSRADYIKTTVRQFFNESGLSAIRQIDYKEACKVWPEVHNCINPLVSSIKQCLKSDVQKIFDTFLEFIDVSQSFFCDNNADRISSLVSDGSVQCFSLVDKDLKECQTNFKKKLGDSINAINIWGDVDSYKGMTGKNLADETCSTFQSYRNCITFKLAKCKSNILPKLEMNI

SEQ ID NO: 35855 - protein, 67 aa, Diabrotica virgifera
  misc_feature: Coding regions on vcDNA: vcDNA=SeqID_15552; Strand=-; Position=1-201
  misc_feature: Homolog annotation: Hit_ID=CAD22154.1; Match level="QueryCoverage =95%, HitCoverage=51%, E-value=1e-21, Identity=68%"; Hit description =pherophorin-dz1 protein [Volvox carteri f. nagariensis]
  misc_feature: Gene Ontology Annotation: Molecular function=profilin binding; Cellular component=lamellipodium; Biological process=actin filament organization
YGRGLLSPPRSPPSRPPPPLPPPRPPPKPPPPRPPPPRPPPNPPPRLPLSRKPRPPPPPPRPPPPLE

SEQ ID NO: 35856 - protein, 137 aa, Diabrotica virgifera
  misc_feature: Coding regions on vcDNA: vcDNA=SeqID_15553; Strand=+; Position=60-470
  misc_feature (117)..(117): Xaa can be any naturally occurring amino acid
  misc_feature (130)..(130): Xaa can be any naturally occurring amino acid
LKRTLLTWKLGKICIKHGFEEMGILSKCSLVAFELLNEMFAAVGAGFLGVLYLVKKGFNKYDSIRTLTILVVTTASVAYITHKNNKQIKPNKKKVICITGCDSGLGFSLAQHSVDMXFTVIAGFLSLDSXGCKEIRQ

SEQ ID NO: 35857 - protein, 195 aa, Diabrotica virgifera
  misc_feature: Coding regions on vcDNA: vcDNA=SeqID_15554; Strand=+; Position=1-588
  misc_feature (14)..(21): Xaa can be any naturally occurring amino acid
TKQGQRRKGRKSQXXXXXXXXCGSSKEELSPIEEKLRVSKAKETWDSSKEETSSGEEEIKLTNESEKNMIETVVFEEEVYANEDAECTVNICEESEEKDRKLICGEGKEKELRLMLRNYENLINEENRVAKKYEHSFEVKNLGNFRSKTYPIPYKYRQEIKVRKYTGSWFCLEKIYLKMQINFIEYKAGICYIPI

SEQ ID NO: 35858 - protein, 35 aa, Diabrotica virgifera
  misc_feature: Coding regions on vcDNA: vcDNA=SeqID_15555; Strand=-; Position=1-105
KGSQGEIVIKLMILLFWVYLGPFFRGLFVLGGSRF

SEQ ID NO: 35859 - protein, 92 aa, Diabrotica virgifera
  misc_feature: Coding regions on vcDNA: vcDNA=SeqID_15556; Strand=+; Position=239-517
QTVELFCSKGCEFESQGRKFFIYYKLINENGFYPCGIGTHRRDCRRSDTINKSASPSNNTFLCSTHTHAVHITLPSCEINCTMPMAICSQGL

SEQ ID NO: 35860 - protein, 96 aa, Diabrotica virgifera
  misc_feature: Coding regions on vcDNA: vcDNA=SeqID_15557; Strand=+; Position=341-631
SPENRPDNFGLFPSLQRWSTIQRWSDQCLMVLCMYLLHVNNRGVSSRMTENLLPVLCERNCQSFWVQSLDAIQPEVRLWSVRNETWGIMQECNNGC

SEQ ID NO: 35861 - protein, 59 aa, Diabrotica virgifera
  misc_feature: Coding regions on vcDNA: vcDNA=SeqID_15558; Strand=-; Position=0-176
ASNLIHSEQLSGTVPISPGAQRIPCHFLEDPLFTPFPCKLFRGNRRQGDRNPAVSGPLP

SEQ ID NO: 35862 - protein, 277 aa, Diabrotica virgifera
  misc_feature: Coding regions on vcDNA: vcDNA=SeqID_15559; Strand=+; Position=1-835
  misc_feature: Homolog annotation: Hit_ID=XP_317367.1; Match level="QueryCoverage =89%, HitCoverage=12%, E-value=4e-29, Identity=31%"; Hit description =ENSANGP00000011592 [Anopheles gambiae]
  misc_feature (174)..(174): Xaa can be any naturally occurring amino acid
AKNIGEGLAEYGQLTWLMKVLAVELKILSQLKQVTYLKQLKVFLINLPTEESRQKDTLMGVSKMALNLTALHAEVGKSDNFLTRLIPYFELDLPVVEMPNWEYFDNNVLSQILQSCQQKSSKLIDLRKLHIILYEELKTLQGTAVMGQIQAITHEIQKVLKYALELNKKRGLCXMVQFADAWRQVTEVLVLYTPMEILSVQEQQIVSLALLKPLLKDISKSELLPEVARLLSGAVLMLMYNIKRSYVREKRLEKISELGEDSPFQILKVHQPLLKEI

SEQ ID NO: 35863 - protein, 21 aa, Diabrotica virgifera
  misc_feature: Coding regions on vcDNA: vcDNA=SeqID_15560; Strand=+; Position=1-63
MRQPDALTHDSLATTSPFAVR

SEQ ID NO: 35864 - protein, 48 aa, Diabrotica virgifera
  misc_feature: Coding regions on vcDNA: vcDNA=SeqID_15561; Strand=-; Position=0-143
  misc_feature (41)..(47): Xaa can be any naturally occurring amino acid
SSPASFLGFSLSCHLSLPGRSFFCLRYLSSSVSTFSCFKEXXXXXXXL

SEQ ID NO: 35865 - protein, 148 aa, Diabrotica virgifera
  misc_feature: Coding regions on vcDNA: vcDNA=SeqID_15562; Strand=+; Position=169-615
  misc_feature: Homolog annotation: Hit_ID=XP_314571.1; Match level="QueryCoverage =91%, HitCoverage=87%, E-value=7e-15, Identity=37%"; Hit description =ENSANGP00000017982 [Anopheles gambiae]
  misc_feature: Pfam annotation: Pfam_ID=DnaJ; Match level="Score=83.0, E-value=7.7e -22, Copies=1"; Pfam description=DnaJ domain
MANEDTSGLENSINSELDYYAVLQCNQNSTLEELKQSYRNLIKKFHPDKQSQTGSSGSEQLFILIDKAYKTLSDTKLRKEYDAQLTENNFNENSLIYAELKKSDLKFVDEVCYFPCRCGQNIEISADVLQEEECLVECSECTNCILIK

SEQ ID NO: 35866 - protein, 55 aa, Diabrotica virgifera
  misc_feature: Coding regions on vcDNA: vcDNA=SeqID_15563; Strand=+; Position=57-224
HLASVSHILQRWRQTSSRRINVRKISMLLCDHIRTYRRRDRRLLVRRILSIVHKQ

SEQ ID NO: 35867 - protein, 55 aa, Diabrotica virgifera
  misc_feature: Coding regions on vcDNA: vcDNA=SeqID_15564; Strand=+; Position=81-245
KMKSHIFFLYSILVPRLNSIPVDVILRHTSMPDSECIDPVLLTLDIVCHDVAMLL

SEQ ID NO: 35868 - protein, 66 aa, Diabrotica virgifera
  misc_feature: Coding regions on vcDNA: vcDNA=SeqID_15565; Strand=-; Position=38-238
LSGIDHMQAYACCRLVVHLYWVLAVQGHPQLGHVGVSVEKVSVPFSYTPSNSDPQITLSYTSRERS

SEQ ID NO: 35869 - protein, 126 aa, Diabrotica virgifera
  misc_feature: Coding regions on vcDNA: vcDNA=SeqID_15566; Strand=-; Position=465-845
  misc_feature (6)..(15): Xaa can be any naturally occurring amino acid
  misc_feature (58)..(66): Xaa can be any naturally occurring amino acid
KDGPRXXXXXXXXXXPNPHYFYFYLLGLWRFSLENPLNPFPLNFSPPAPPFLPIPILXXXXXXXXXSNFHSFGGHYQGGNGYFLLIKNPLVYWLTKPLELSGDLRLKDIPVTFIFLNLVPIKINPN

SEQ ID NO: 35870 - protein, 279 aa, Diabrotica virgifera
  misc_feature: Coding regions on vcDNA: vcDNA=SeqID_15567; Strand=-; Position=2-838
  misc_feature (47)..(277): Xaa can be any naturally occurring amino acid
GKPLVPPTRWPCPRLWPLDGIFSRYQFWVDFKNKQFQAFFFLRVWIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFQ

SEQ ID NO: 35871 - protein, 100 aa, Diabrotica virgifera
  misc_feature: Coding regions on vcDNA: vcDNA=SeqID_15568; Strand=+; Position=70-372
LNNKMGSLEDVTSAYEILILHGLDETDEFKSLKNSFKKSRVCSKEEISNLKEESVHSICCNSDDELISSVFKLLVPGGHVIITQISNKEETKLNLIMKGL

SEQ ID NO: 35872 - protein, 155 aa, Diabrotica virgifera
  misc_feature: Coding regions on vcDNA: vcDNA=SeqID_15569; Strand=+; Position=72-539
  misc_feature: Homolog annotation: Hit_ID=XP_317737.1; Match level="QueryCoverage =83%, HitCoverage=22%, E-value=3e-13, Identity=33%"; Hit description =ENSANGP00000010087 [Anopheles gambiae]
MVAILMGLINTEAVVTNEDIRGAILQLLSVARVTRDKLEKHEYADRVFGEQLKKALVTIDKRIKILDPIKGTAARLEDRLAAVETILMQTNEKEKLQLQMTFEAVTDIQKNLPLLMEEMKNEIISKILENEVSGVAVMNKSKSYRYYRNNRKRGF

SEQ ID NO: 35873 - protein, 62 aa, Diabrotica virgifera
  misc_feature: Coding regions on vcDNA: vcDNA=SeqID_15570; Strand=-; Position=53-241
CRSRRGGEISIALRGRSVSYLSGSVSMSKTPIRHYRSRISWCKNLWIPLNSIAVTNNRLHTI

SEQ ID NO: 35874 - protein, 122 aa, Diabrotica virgifera
  misc_feature: Coding regions on vcDNA: vcDNA=SeqID_15571; Strand=+; Position=191-556
  misc_feature: Homolog annotation: Hit_ID=XP_392002.1; Match level="QueryCoverage =82%, HitCoverage=6%, E-value=3e-39, Identity=71%"; Hit description =similar to ENSANGP00000024998 [Apis mellifera]
MSGNAPPVAQPNPENHVGALINTNRIRNNNNQNPLFNVRDRLFHTLFYRAALAYARTFPRPLRRFLEFLTLVKAIAAFFVLVYIHITFSRTPSTCLMHVKDNWPRDGILRVKIVRNVGKDYN

SEQ ID NO: 35875 - protein, 124 aa, Diabrotica virgifera
  misc_feature: Coding regions on vcDNA: vcDNA=SeqID_15572; Strand=+; Position=2-377
  misc_feature: Homolog annotation: Hit_ID=XP_319490.1; Match level="QueryCoverage =98%, HitCoverage=25%, E-value=1e-29, Identity=52%"; Hit description =ENSANGP00000020198 [Anopheles gambiae]
  misc_feature: Pfam annotation: Pfam_ID=RVT_2; Match level="Score=6.7, E-value=1.8e -18, Copies=1"; Pfam description=Reverse transcriptase (RNA-dependent
  misc_feature (112)..(112): Xaa can be any naturally occurring amino acid
SDPVSVEDAMSRPDSNLWLGAMTEELQSFEDNSAWEVVDVPEDGCVVKCKWVYKKKVDNSGKVKYRARLVAKGYTQKFGVDYNETFSPVIRHSTLRLLFALSANLNLDIFHXDVATAFLFGDLY

SEQ ID NO: 35876 - protein, 92 aa, Diabrotica virgifera
  misc_feature: Coding regions on vcDNA: vcDNA=SeqID_15573; Strand=-; Position=2-277
FVISYKIHMIFKHRWSSLQDRRFGGHSIYACHVVISQRIRRNVIHVHKVHDQYFHDLISGRWIHQDLLSRNFTSCCSFHWNLSNCHILIRSR

SEQ ID NO: 35877 - protein, 59 aa, Diabrotica virgifera
  misc_feature: Coding regions on vcDNA: vcDNA=SeqID_15574; Strand=-; Position=1-177
QKEEMFMYKSCRISTFYIHDKEDHHHKEDYNVVKEVPHHHPDNYHHDKDPAIEIVKVLE

SEQ ID NO: 35878 - protein, 119 aa, Diabrotica virgifera
  misc_feature: Coding regions on vcDNA: vcDNA=SeqID_15575; Strand=+; Position=53-412
MELLVLPIPVKSKLFSEVQTQEPRCSKWFPNLEHLGSCVWEPLRTGEAIDRTLVGVSRYQNNNQGDILTDIFRQYEGTLDDTKYYSLLNRIQMLVEAGLINETIYDIIRDWDLNTVYRN

SEQ ID NO: 35879 - protein, 181 aa, Diabrotica virgifera
  misc_feature: Coding regions on vcDNA: vcDNA=SeqID_15576; Strand=-; Position=112-657
  misc_feature: Homolog annotation: Hit_ID=EAL28162.1; Match level="QueryCoverage =75%, HitCoverage=25%, E-value=4e-10, Identity=31%"; Hit description =GA15464-PA [Drosophila pseudoobscura]
GGYTSYEERFSKPNVTTIVIRLNHTFKIDNGQNGPYGRETSSSLPPDVVSIVTSLLPGASLVKLNDTIDHQLLQIRESPSIMRGNCDMYAVSNDTVFAFVREISGNPGVLVLLNTGDQKVTLNVKQNIAALSDLDEVTIQYYSKNYNETTHKDINAKKDSTDIPISPKSVLVLQYVPKKKQ

SEQ ID NO: 35880 - protein, 83 aa, Diabrotica virgifera
  misc_feature: Coding regions on vcDNA: vcDNA=SeqID_15577; Strand=-; Position=288-536
  misc_feature: Homolog annotation: Hit_ID=XP_320597.1; Match level="QueryCoverage =89%, HitCoverage=12%, E-value=1e-31, Identity=82%"; Hit description =ENSANGP00000015354 [Anopheles gambiae]
  misc_feature (16)..(16): Xaa can be any naturally occurring amino acid
  misc_feature (32)..(32): Xaa can be any naturally occurring amino acid
FVNQCPRLSQWIQNPXDPSPKPKNFDPWREKXCVVEGIPACWVPHSCKLTSSEVPGETINLQTCVRCPNNYPWLNDPTGDGVF

SEQ ID NO: 35881 - protein, 206 aa, Diabrotica virgifera
  misc_feature: Coding regions on vcDNA: vcDNA=SeqID_15578; Strand=+; Position=53-670
  misc_feature (3)..(9): Xaa can be any naturally occurring amino acid
  misc_feature (11)..(13): Xaa can be any naturally occurring amino acid
  misc_feature (16)..(22): Xaa can be any naturally occurring amino acid
  misc_feature (28)..(28): Xaa can be any naturally occurring amino acid
  misc_feature (31)..(31): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (45)..(45): Xaa can be any naturally occurring amino acid
  misc_feature (48)..(48): Xaa can be any naturally occurring amino acid
  misc_feature (63)..(65): Xaa can be any naturally occurring amino acid
  misc_feature (70)..(73): Xaa can be any naturally occurring amino acid
  misc_feature (81)..(81): Xaa can be any naturally occurring amino acid
  misc_feature (83)..(83): Xaa can be any naturally occurring amino acid
  misc_feature (94)..(95): Xaa can be any naturally occurring amino acid
  misc_feature (99)..(102): Xaa can be any naturally occurring amino acid
  misc_feature (106)..(106): Xaa can be any naturally occurring amino acid
DKXXXXXXXEXXXERXXXXXXXKLSRDXKKXARRXXNRQXTKXRXREXRGQQESEEDHKPEGXXXERTNXXXXTKKHTRTXKXPKRNREAQTAXXATRXXXXTFNXYIVNFSHKLHYKSVSYITLFLLIIRIYQYCSISFFSLLIHPPPHVHSIFHIHLNPFFQKIFFSPTKQFNYIHTSFWHNLSTIIQIQYISQSPHIIFPNRF

SEQ ID NO: 35882 - protein, 169 aa, Diabrotica virgifera
  misc_feature: Coding regions on vcDNA: vcDNA=SeqID_15579; Strand=-; Position=1-507
  misc_feature (2)..(10): Xaa can be any naturally occurring amino acid
  misc_feature (34)..(41): Xaa can be any naturally occurring amino acid
  misc_feature (44)..(57): Xaa can be any naturally occurring amino acid
  misc_feature (63)..(76): Xaa can be any naturally occurring amino acid
  misc_feature (78)..(167): Xaa can be any naturally occurring amino acid
IXXXXXXXXXGPFVLKYINNLKIEASLAHAGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTK

SEQ ID NO: 35883 - protein, 199 aa, Diabrotica virgifera
  misc_feature: Coding regions on vcDNA: vcDNA=SeqID_15580; Strand=+; Position=1-597
  misc_feature: Homolog annotation: Hit_ID=AAH84749.1; Match level="QueryCoverage =99%, HitCoverage=19%, E-value=5e-26, Identity=33%"; Hit description =Unknown (protein for MGC:80320) [Xenopus laevis]
  misc_feature: Gene Ontology Annotation: Molecular function=receptor activity; Cellular component=integral to plasma membrane; Biological process =pathogenesis
GSKTSVKQKQRIIQTLTGEIAHQWFGNYITPERWSDVWLNEGFTTFLKYHLPDLTLQELETTNQFSIEILQDTLYQDSIQGEEELSTIENTAMNPKTQERMNKFKAIKGASIIRMMQSTLGEKIFEEHINSYLNKYKFNYTNPTNLLEAMELVNKMEKWLYMPGYPLVTARLSNNGKSVSLSQEPLLLLKDDQESATVW

SEQ ID NO: 35884 - protein, 242 aa, Diabrotica virgifera
  misc_feature: Coding regions on vcDNA: vcDNA=SeqID_15581; Strand=+; Position=11-738
  misc_feature: Homolog annotation: Hit_ID=XP_313331.1; Match level="QueryCoverage =90%, HitCoverage=44%, E-value=3e-49, Identity=47%"; Hit description =ENSANGP00000011393 [Anopheles gambiae]
  misc_feature: Gene Ontology Annotation: Molecular function=electron transporter activity; Cellular component=mitochondrion; Biological process =alcohol metabolism
  misc_feature: Pfam annotation: Pfam_ID=Aldedh; Match level="Score=-293.5, E-value =0.0018, Copies=1"; Pfam description=Aldehyde dehydrogenase family
  misc_feature (14)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (27)..(28): Xaa can be any naturally occurring amino acid
  misc_feature (32)..(36): Xaa can be any naturally occurring amino acid
  misc_feature (38)..(38): Xaa can be any naturally occurring amino acid
  misc_feature (41)..(41): Xaa can be any naturally occurring amino acid
  misc_feature (43)..(44): Xaa can be any naturally occurring amino acid
  misc_feature (52)..(52): Xaa can be any naturally occurring amino acid
  misc_feature (55)..(55): Xaa can be any naturally occurring amino acid
  misc_feature (63)..(63): Xaa can be any naturally occurring amino acid
  misc_feature (67)..(68): Xaa can be any naturally occurring amino acid
  misc_feature (72)..(72): Xaa can be any naturally occurring amino acid
  misc_feature (74)..(74): Xaa can be any naturally occurring amino acid
  misc_feature (82)..(82): Xaa can be any naturally occurring amino acid
  misc_feature (84)..(87): Xaa can be any naturally occurring amino acid
  misc_feature (91)..(92): Xaa can be any naturally occurring amino acid
  misc_feature (95)..(95): Xaa can be any naturally occurring amino acid
  misc_feature (98)..(99): Xaa can be any naturally occurring amino acid
  misc_feature (102)..(103): Xaa can be any naturally occurring amino acid
  misc_feature (106)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (117)..(118): Xaa can be any naturally occurring amino acid
  misc_feature (120)..(121): Xaa can be any naturally occurring amino acid
  misc_feature (124)..(125): Xaa can be any naturally occurring amino acid
  misc_feature (127)..(127): Xaa can be any naturally occurring amino acid
  misc_feature (129)..(130): Xaa can be any naturally occurring amino acid
  misc_feature (132)..(132): Xaa can be any naturally occurring amino acid
  misc_feature (134)..(140): Xaa can be any naturally occurring amino acid
  misc_feature (142)..(143): Xaa can be any naturally occurring amino acid
  misc_feature (146)..(147): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(155): Xaa can be any naturally occurring amino acid
  misc_feature (157)..(157): Xaa can be any naturally occurring amino acid
  misc_feature (164)..(165): Xaa can be any naturally occurring amino acid
  misc_feature (168)..(168): Xaa can be any naturally occurring amino acid
  misc_feature (183)..(183): Xaa can be any naturally occurring amino acid
LERHAADAGTHFHXXXKKXEXKXTKQXXNNQXXXXXSXKTXEXXNPSTGKPXTKXAEGDKEDXDKAXXAAKXAXARGAPGRXRXXXXRGAXXNKXAEXXEQXXEEXXEXEXXEKGKXXEXXKRXXQXAXXGXRXXXXXXXKXXGQXXPAEXPXMXMXRKEPIGXXGQXIPWNFPALMLTWKWXAPALAAGCTLGLEPAEQTPLTALYMAALTKKARFPEGSINVVNGFGPTAGASLALTQGW

SEQ ID NO: 35885 - protein, 63 aa, Diabrotica virgifera
  misc_feature: Coding regions on vcDNA: vcDNA=SeqID_15582; Strand=+; Position=160-351
YFQFYICFCILFCILCIFGHSSLLVSLNGLYAVDTFIHPCSNIFFSTIIPSDPKTFSFSLVFP

SEQ ID NO: 35886 - protein, 39 aa, Diabrotica virgifera
  misc_feature: Coding regions on vcDNA: vcDNA=SeqID_15583; Strand=+; Position=1-120
  misc_feature (2)..(9): Xaa can be any naturally occurring amino acid
  misc_feature (17)..(24): Xaa can be any naturally occurring amino acid
RXXXXXXXXAGRERESXXXXXXXXKPRTFFFNAALLRNS

SEQ ID NO: 35887 - protein, 63 aa, Diabrotica virgifera
  misc_feature: Coding regions on vcDNA: vcDNA=SeqID_15584; Strand=+; Position=150-341
  misc_feature: Homolog annotation: Hit_ID=CAE47497.1; Match level="QueryCoverage =100%, HitCoverage=20%, E-value=1e-12, Identity=55%"; Hit description= cathepsin L-like proteinase [Diabrotica virgifera virgifera]
  misc_feature (2)..(2): Xaa can be any naturally occurring amino acid
  misc_feature (32)..(32): Xaa can be any naturally occurring amino acid
  misc_feature (41)..(41): Xaa can be any naturally occurring amino acid
  misc_feature (45)..(45): Xaa can be any naturally occurring amino acid
LXVNKFGDWIRDELKVMLESKMDKKLKELFIXKYVCDFNVXSCRXVDWRDSEVLGVKDKGECG

SEQ ID NO: 35888 - protein, 40 aa, Diabrotica virgifera
  misc_feature: Coding regions on vcDNA: vcDNA=SeqID_15585; Strand=-; Position=1-120
  misc_feature (14)..(14): Xaa can be any naturally occurring amino acid
  misc_feature (19)..(19): Xaa can be any naturally occurring amino acid
  misc_feature (25)..(25): Xaa can be any naturally occurring amino acid
  misc_feature (27)..(34): Xaa can be any naturally occurring amino acid
RRRRLLSGRWCFFXRGVLXRLLLGXLXXXXXXXXCPFTVG

SEQ ID NO: 35889 - protein, 197 aa, Diabrotica virgifera
  misc_feature: Coding regions on vcDNA: vcDNA=SeqID_15586; Strand=+; Position=99-689
  misc_feature (34)..(36): Xaa can be any naturally occurring amino acid
  misc_feature (39)..(40): Xaa can be any naturally occurring amino acid
  misc_feature (45)..(45): Xaa can be any naturally occurring amino acid
  misc_feature (48)..(48): Xaa can be any naturally occurring amino acid
  misc_feature (52)..(54): Xaa can be any naturally occurring amino acid
  misc_feature (57)..(57): Xaa can be any naturally occurring amino acid
  misc_feature (61)..(61): Xaa can be any naturally occurring amino acid
  misc_feature (63)..(65): Xaa can be any naturally occurring amino acid
  misc_feature (67)..(68): Xaa can be any naturally occurring amino acid
  misc_feature (70)..(71): Xaa can be any naturally occurring amino acid
  misc_feature (73)..(85): Xaa can be any naturally occurring amino acid
  misc_feature (88)..(88): Xaa can be any naturally occurring amino acid
  misc_feature (90)..(92): Xaa can be any naturally occurring amino acid
  misc_feature (94)..(98): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(111): Xaa can be any naturally occurring amino acid
  misc_feature (116)..(117): Xaa can be any naturally occurring amino acid
  misc_feature (119)..(119): Xaa can be any naturally occurring amino acid
  misc_feature (122)..(122): Xaa can be any naturally occurring amino acid
  misc_feature (124)..(126): Xaa can be any naturally occurring amino acid
  misc_feature (130)..(130): Xaa can be any naturally occurring amino acid
  misc_feature (134)..(134): Xaa can be any naturally occurring amino acid
  misc_feature (136)..(137): Xaa can be any naturally occurring amino acid
  misc_feature (139)..(139): Xaa can be any naturally occurring amino acid
  misc_feature (142)..(150): Xaa can be any naturally occurring amino acid
  misc_feature (181)..(187): Xaa can be any naturally occurring amino acid
LERSRDEAPFKGERSIKKPKKDGKNERGNPGEPXXXTDXXKAGKXEEXQNQXXXQGXDTEXKXXXGXXTXXKXXXXXXXXXXXXXQRXPXXXPXXXXXQGGPGXTXRXGXXQEKGXXTXKEXEXXXRPTXGKRXHXXIXIDXXXXXXXXXTNGGYAKDQHKVATDLYQSLQQFFTLFYQYXXXXXXXNRESYGGKDC

SEQ ID NO: 35890 - protein, 82 aa, Diabrotica virgifera
  misc_feature: Coding regions on vcDNA: vcDNA=SeqID_15587; Strand=+; Position=18-266
  misc_feature (14)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (24)..(24): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (39)..(40): Xaa can be any naturally occurring amino acid
  misc_feature (45)..(45): Xaa can be any naturally occurring amino acid
  misc_feature (55)..(55): Xaa can be any naturally occurring amino acid
  misc_feature (57)..(57): Xaa can be any naturally occurring amino acid
  misc_feature (64)..(65): Xaa can be any naturally occurring amino acid
  misc_feature (68)..(68): Xaa can be any naturally occurring amino acid
  misc_feature (79)..(79): Xaa can be any naturally occurring amino acid
TRGEEEERTFIKGXIXRXIWKNMXIKFXKXEXLSPHERXXIVIFXGYLRLILSVXKXWEDCLWXXMKXMVDIRVELEIXECV

SEQ ID NO: 35891 - protein, 131 aa, Diabrotica virgifera
  misc_feature: Coding regions on vcDNA: vcDNA=SeqID_15588; Strand=+; Position=31-426
MMFKFFIFSLMVTSSLAFIPEIIGFGLGVHLLHKVAEKLGVPDTVFKVEHNVPDQVFAEPDGRQYVLKKQWIGSTPVLAKVYSDNGQVAFVDSSSSVGTPVNNNAVNQGESGSGNAAIEYSNEEEWNNRHN

SEQ ID NO: 35892 - protein, 114 aa, Diabrotica virgifera
  misc_feature: Coding regions on vcDNA: vcDNA=SeqID_15589; Strand=+; Position=3-345
  misc_feature: Homolog annotation: Hit_ID=AAV88529.1; Match level="QueryCoverage =94%, HitCoverage=27%, E-value=3e-22, Identity=58%"; Hit description =cadherin-like protein [Diabrotica virgifera virgifera]
  misc_feature (10)..(10): Xaa can be any naturally occurring amino acid
  misc_feature (21)..(21): Xaa can be any naturally occurring amino acid
  misc_feature (100)..(100): Xaa can be any naturally occurring amino acid
  misc_feature (108)..(108): Xaa can be any naturally occurring amino acid
AQGRREEPRXRRKGTGKGPPXNRRAPQRKRTKPAGAARPTPATGNRKDTAQAQDDDESEQQRGAMCPRASDDNRTGEGQHTRRGEPGQASTENDAAKILXDFTVQTTXMTGRFE

SEQ ID NO: 35893 - protein, 74 aa, Diabrotica virgifera
  misc_feature: Coding regions on vcDNA: vcDNA=SeqID_15590; Strand=-; Position=1034 -1258
GGGDPPPPFFTPRGVPPMQRGPFGGLFFATNLITHIQKNSQFPIKIVSKIKIVKGPTKKGYNFFPFSLQQKYHQ

SEQ ID NO: 35894 - protein, 69 aa, Diabrotica virgifera
  misc_feature: Coding regions on vcDNA: vcDNA=SeqID_15591; Strand=+; Position=3-209
  misc_feature (1)..(3): Xaa can be any naturally occurring amino acid
  misc_feature (5)..(5): Xaa can be any naturally occurring amino acid
XXXPXPPFCVRFISGRHQAPLSCHLTKPATKKRRHNGRDQQENACFLTSNKTVQVMVPTRWMAVTNTPH

SEQ ID NO: 35895 - protein, 201 aa, Diabrotica virgifera
  misc_feature: Coding regions on vcDNA: vcDNA=SeqID_15592; Strand=+; Position=181-786
  misc_feature: Homolog annotation: Hit_ID=XP_393567.1; Match level="QueryCoverage =75%, HitCoverage=15%, E-value=4e-17, Identity=37%"; Hit description =similar to ENSANGP00000020994 [Apis mellifera]
  misc_feature (47)..(47): Xaa can be any naturally occurring amino acid
  misc_feature (50)..(50): Xaa can be any naturally occurring amino acid
  misc_feature (52)..(57): Xaa can be any naturally occurring amino acid
  misc_feature (59)..(65): Xaa can be any naturally occurring amino acid
  misc_feature (72)..(72): Xaa can be any naturally occurring amino acid
  misc_feature (76)..(78): Xaa can be any naturally occurring amino acid
  misc_feature (81)..(82): Xaa can be any naturally occurring amino acid
  misc_feature (84)..(84): Xaa can be any naturally occurring amino acid
  misc_feature (88)..(88): Xaa can be any naturally occurring amino acid
  misc_feature (90)..(92): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(100): Xaa can be any naturally occurring amino acid
  misc_feature (103)..(103): Xaa can be any naturally occurring amino acid
  misc_feature (108)..(108): Xaa can be any naturally occurring amino acid
  misc_feature (110)..(110): Xaa can be any naturally occurring amino acid
  misc_feature (113)..(113): Xaa can be any naturally occurring amino acid
  misc_feature (118)..(118): Xaa can be any naturally occurring amino acid
  misc_feature (121)..(121): Xaa can be any naturally occurring amino acid
  misc_feature (157)..(157): Xaa can be any naturally occurring amino acid
  misc_feature (172)..(172): Xaa can be any naturally occurring amino acid
RARGAKKSHKARARAGAGPQKEKRKRRKGKRKREEEERKKKEEGKEXEKXEXXXXXXDXXXXXXXREEEKRXERRXXXREXXRXGRRXRXXXGRRXRXGXEAXQRPTXAXDEXKEKEXEPXPETRTDGEGPKKTGERGRDRHRGKQTNAGSAETRPXDPENPEEETEGERNXEEEGKSRGKIKSKKTIRWKESRAREEIGK

SEQ ID NO: 35896 - protein, 82 aa, Diabrotica virgifera
  misc_feature: Coding regions on vcDNA: vcDNA=SeqID_15593; Strand=-; Position=185-433
GGGRLVPVPLSGRMGQRVDSVSVGFAFSLLAAGVPCVRTQSLLGFLVSVRQSVFSLNPWVSRVGLSGRELLVRVLTCFSLVL

SEQ ID NO: 35897 - protein, 220 aa, Diabrotica virgifera
  misc_feature: Coding regions on vcDNA: vcDNA=SeqID_15594; Strand=+; Position=1-660
  misc_feature: Homolog annotation: Hit_ID=BAB85498.1; Match level="QueryCoverage =98%, HitCoverage=16%, E-value=2e-98, Identity=70%"; Hit description =18 wheeler [Bombyx mori]
  misc_feature: Gene Ontology Annotation: Molecular function=cell adhesion molecule activity; Cellular component=plasma membrane; Biological process =cell adhesion
  misc_feature: Pfam annotation: Pfam_ID=LRR_1; Match level="Score=22.5, E-value =0.0013, Copies=3"; Pfam description=Leucine Rich Repeat
FVRNHLVWFDYAFILSNLKWLDIHGNFIEHLANYYKIQDVIRVKTLDASHNRITEISPMSIPNSIELLFINNNFIKSVQPNTFLDKSNLARVDMYANDMTNLDLNSLRIAPVHSNRSLPEIYLGGNTFHCDCTMEWLQLINNMSASRQYPRVMDMDNIVCKMTHSRGMTHMPLNQAKQSDFLCNYETHWFALCHCWDFDACDCEMTCPNNWTCYHDQTWN

SEQ ID NO: 35898 - protein, 93 aa, Diabrotica virgifera
  misc_feature: Coding regions on vcDNA: vcDNA=SeqID_15595; Strand=-; Position=0-278
  misc_feature (1)..(7): Xaa can be any naturally occurring amino acid
XXXXXXXQIYIQKKSKKKHERQQFCLLPHNPPPRRYSHRHCFTEKKVPSFLFKMTFRRSTYDLEFPKYDFSKFATHSDPGTLSLSLRKNCSAT

SEQ ID NO: 35899 - protein, 247 aa, Diabrotica virgifera
  misc_feature: Coding regions on vcDNA: vcDNA=SeqID_15596; Strand=+; Position=115-857
  misc_feature: Homolog annotation: Hit_ID=XP_534585.1; Match level="QueryCoverage =90%, HitCoverage=61%, E-value=3e-31, Identity=33%"; Hit description =PREDICTED: similar to hypothetical protein FLJ32191 [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=115.8, E-value =1e-31, Copies=7"; Pfam description=Zinc finger, C2H2 type
  misc_feature (212)..(212): Xaa can be any naturally occurring amino acid
PKQKRERKPQPEYNLDQVVNLNEITKPLICTICYKAFLTHIEFGYHSKTHQEDGLYHCHLCEYSVEAKDTFKKHVRTHDVFKCEKCGKILKTKFSADKHVKSHQAPTTVQCELCGKHLKKQCLYLHKRTVHATDKVLAKCPICGKEYQNSGSLRQHYSAFHRELGIDMSVVCDICGMRLSCKATLAQHTRTHTGDKPFACHLCPKRFLLKTXMVAHMRVHTGEKTIHLEIFAGKRFGPGGFPYKEPR

SEQ ID NO: 35900 - protein, 39 aa, Diabrotica virgifera
  misc_feature: Coding regions on vcDNA: vcDNA=SeqID_15597; Strand=+; Position=53-169
KKRFFSPYKIGSPKFLKRDLLGIKQGKNKIKPKLTEHYF

SEQ ID NO: 35901 - protein, 74 aa, Diabrotica virgifera
  misc_feature: Coding regions on vcDNA: vcDNA=SeqID_15598; Strand=+; Position=140-364
  misc_feature (31)..(38): Xaa can be any naturally occurring amino acid
EEYSRPVYNIVFYLKKTKNLVLFTTMSSAMXXXXXXXXCRENFLFGFTLPLNITSLKLTLIILAYLGLNPQPSK

SEQ ID NO: 35902 - protein, 20 aa, Diabrotica virgifera
  misc_feature: Coding regions on vcDNA: vcDNA=SeqID_15599; Strand=-; Position=1-60
  misc_feature (5)..(20): Xaa can be any naturally occurring amino acid
PGEKXXXXXXXXXXXXXXXX

SEQ ID NO: 35903 - protein, 128 aa, Diabrotica virgifera
  misc_feature: Coding regions on vcDNA: vcDNA=SeqID_15600; Strand=-; Position=1-384
  misc_feature (2)..(33): Xaa can be any naturally occurring amino acid
  misc_feature (37)..(127): Xaa can be any naturally occurring amino acid
IXXXXXXXXXXXXXXXXXXXXXXXXXXXXXXXXRDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXF

SEQ ID NO: 35904 - protein, 372 aa, Diabrotica virgifera
  misc_feature: Coding regions on vcDNA: vcDNA=SeqID_15601; Strand=+; Position=2-1120
  misc_feature (1)..(322): Xaa can be any naturally occurring amino acid
  misc_feature (361)..(367): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLPLGKISVILFGKFQIRKIKNWEPPRVGLKVFKLGGNXXXXXXXRFPTF

SEQ ID NO: 35905 - protein, 129 aa, Diabrotica virgifera
  misc_feature: Coding regions on vcDNA: vcDNA=SeqID_15602; Strand=+; Position=3-391
  misc_feature: Homolog annotation: Hit_ID=CAE47499.1; Match level="QueryCoverage =97%, HitCoverage=40%, E-value=6e-34, Identity=55%"; Hit description =cathepsin L-like proteinase [Diabrotica virgifera virgifera]
  misc_feature: Gene Ontology Annotation: Molecular function=cysteine-type peptidase activity; Cellular component=extracellular space; Biological process= proteolysis and peptidolysis
  misc_feature (55)..(55): Xaa can be any naturally occurring amino acid
  misc_feature (89)..(89): Xaa can be any naturally occurring amino acid
  misc_feature (107)..(107): Xaa can be any naturally occurring amino acid
NSKGMLDSRDLHQPRRSITSRRVAEPQLTDPEPNDWREKGGAAPIRYQGQRGACXAFRAAGDLERQRYLQKNELQVLTTQQEKERSGEXDKEGCKGGWPHWTYNYIXDHGPGLQSDHKNKGGDGDCKQG

SEQ ID NO: 35906 - protein, 214 aa, Diabrotica virgifera
  misc_feature: Coding regions on vcDNA: vcDNA=SeqID_15603; Strand=+; Position=2-646
  misc_feature: Homolog annotation: Hit_ID=BAC87874.1; Match level="QueryCoverage =98%, HitCoverage=86%, E-value=2e-32, Identity=34%"; Hit description =arylalkylamine N-acetyltransferase [Periplaneta americana]
  misc_feature: Gene Ontology Annotation: Molecular function=arylalkylamine N -acetyltransferase activity; Biological process=catecholamine metabolism
  misc_feature: Pfam annotation: Pfam_ID=Acetyltransf_1; Match level="Score=19.4, E -value=0.0053, Copies=1"; Pfam description=Acetyltransferase (GNAT) family
TSPTEKSYKIRDATKADRDAIVEFLRISFFRDEPLNAFLELVTEENPTCETLEEFTVGHIPNGINLVAIHNDQIVGLILSTPLEKVQEEQYDCKNEKYNKLVRLLDYAAKHADPFVIYPSSTKGISVQVISVRKDFTGRGLAVELLQKTCDLAQQQGYDFVEIACTSLYSAKLSEKLNFDLKYSLKYTDYKENGEIVFKPESPHTTLNVYLKKL

SEQ ID NO: 35907 - protein, 79 aa, Diabrotica virgifera
  misc_feature: Coding regions on vcDNA: vcDNA=SeqID_15604; Strand=-; Position=35-274
  misc_feature: Homolog annotation: Hit_ID=CAE47502.1; Match level="QueryCoverage =93%, HitCoverage=22%, E-value=4e-39, Identity=100%"; Hit description= cathepsin B-like proteinase [Diabrotica virgifera virgifera]
  misc_feature: Gene Ontology Annotation: Molecular function=peroxidase activity; Cellular component=extracellular space; Biological process=protein targeting
MARNYFVNYKSGVYQHVAGEYLGGHAVRILGWGEESGVPYWLVANSWNEDWGDKGLFKIRRGNNESGFEDSIVAAPAQV

SEQ ID NO: 35908 - protein, 197 aa, Diabrotica virgifera
  misc_feature: Coding regions on vcDNA: vcDNA=SeqID_15605; Strand=-; Position=22-615
  misc_feature (7)..(13): Xaa can be any naturally occurring amino acid
  misc_feature (22)..(31): Xaa can be any naturally occurring amino acid
  misc_feature (51)..(64): Xaa can be any naturally occurring amino acid
  misc_feature (71)..(83): Xaa can be any naturally occurring amino acid
  misc_feature (85)..(167): Xaa can be any naturally occurring amino acid
  misc_feature (181)..(181): Xaa can be any naturally occurring amino acid
  misc_feature (183)..(184): Xaa can be any naturally occurring amino acid
  misc_feature (187)..(187): Xaa can be any naturally occurring amino acid
VWGNIYXXXXXXXLYYLGPFVXXXXXXXXXXNQLGSHRFKLRSRKILKVEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXRFFPPRLPSGFPSXSXXFCXLRSEGIPRPF

SEQ ID NO: 35909 - protein, 83 aa, Diabrotica virgifera
  misc_feature: Coding regions on vcDNA: vcDNA=SeqID_15606; Strand=-; Position=120-371
RYRVGSIGGCQDHQHFYQRVSVTNNSCGGGIDSRNISDEHVARDVLHLCNAIHTCGVDMGSLGRGCMRSTFPCRRIRSRWKGW

SEQ ID NO: 35910 - protein, 191 aa, Diabrotica virgifera
  misc_feature: Coding regions on vcDNA: vcDNA=SeqID_15607; Strand=+; Position=1-576
  misc_feature (156)..(162): Xaa can be any naturally occurring amino acid
FKAAQDYSSSSFTSALGDSGNSDKTETVQKESNGPVEAPASAKILLEMPRVKYIKPKFAMNFEEARKIMKIRKQLAMLERQNQLSLARLIPVQNSIVNGETNKDDNTSQTAASVNKEQTKTVDISEEKENINTSRAVDDTIIQAPVDNKSVNKVEXXXXXXXINLITEIESRDISKGNWEALETQTGTSYV

SEQ ID NO: 35911 - protein, 24 aa, Diabrotica virgifera
  misc_feature: Coding regions on vcDNA: vcDNA=SeqID_15608; Strand=-; Position=1-72
LCAALRVVNVRSVRASLATRPCSL

SEQ ID NO: 35912 - protein, 115 aa, Diabrotica virgifera
  misc_feature: Coding regions on vcDNA: vcDNA=SeqID_15609; Strand=+; Position=29-373
KNQKVKWHNSEDQDKPYQSVQLNKCVICNLICTPFGIQFYYLTSKSPLTMSTQVPVINKIERILGKIPTTKHYVCNDCLGLINTIDHLQLKILTFNNELVSKYKKTCIENKTFFR

SEQ ID NO: 35913 - protein, 182 aa, Diabrotica virgifera
  misc_feature: Coding regions on vcDNA: vcDNA=SeqID_15610; Strand=+; Position=3-548
  misc_feature: Homolog annotation: Hit_ID=EAA08947.2; Match level="QueryCoverage =96%, HitCoverage=41%, E-value=5e-41, Identity=47%"; Hit description =ENSANGP00000010464 [Anopheles gambiae str. PEST] ref|XP_562394.1| ENSANGP00000010464 [Anopheles gambiae st
  misc_feature: Gene Ontology Annotation: Molecular function=beta-14 -mannosyltransferase activity; Cellular component=integral to membrane; Biological process=N-linked glycosylation
VRRCEPGWLFCLIFRSKFVIDWHNYAHSIMALNLSKDNVLVTITKKVESFAGKRADHNFCVTNAMKKDLCDNWNISATTLYDKPPTVFKSISLEEKHKFLSKLGETYRQLLCDDGSTVFTKDTSTGVNIKNDRPGLLVSSTSWTEDEDFSVLFGALQEYENHIVEGNVRKFPALFCLITGKG

SEQ ID NO: 35914 - protein, 161 aa, Diabrotica virgifera
  misc_feature: Coding regions on vcDNA: vcDNA=SeqID_15611; Strand=-; Position=2-487
  misc_feature: Homolog annotation: Hit_ID=XP_314867.1; Match level="QueryCoverage =93%, HitCoverage=20%, E-value=9e-30, Identity=44%"; Hit description =ENSANGP00000005174 [Anopheles gambiae]
TSKYSFHCKNGLRQGDGLSCLLFNLALEKIIRESQIITNGTIFNKSVQIVGYADEIDIIGRSTESPTEAFRSLIASAQRMGLNINVQRTKYMCCTRSSNPTSTSIIIDDLELEGVDTFIYLGSLLTKDNNVSEEIKRIVLANKCYYGLRRQIASKMPRKLN

SEQ ID NO: 35915 - protein, 388 aa, Diabrotica virgifera
  misc_feature: Coding regions on vcDNA: vcDNA=SeqID_15612; Strand=+; Position=3-1169
  misc_feature (3)..(273): Xaa can be any naturally occurring amino acid
  misc_feature (275)..(302): Xaa can be any naturally occurring amino acid
  misc_feature (304)..(335): Xaa can be any naturally occurring amino acid
  misc_feature (340)..(346): Xaa can be any naturally occurring amino acid
  misc_feature (348)..(355): Xaa can be any naturally occurring amino acid
  misc_feature (377)..(383): Xaa can be any naturally occurring amino acid
LSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXGXXXXXXXXXXXXXXXXXXXXXXXXXXXXXXXXLGKQXXXXXXXFXXXXXXXXTPHVWIKVLNWGEHLNFLKLCXXXXXXXMDFGF

SEQ ID NO: 35916 - protein, 155 aa, Diabrotica virgifera
  misc_feature: Coding regions on vcDNA: vcDNA=SeqID_15613; Strand=+; Position=2-469
  misc_feature: Homolog annotation: Hit_ID=XP_393388.1; Match level="QueryCoverage =97%, HitCoverage=12%, E-value=1e-47, Identity=57%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=14.2, E-value =4.4e-07, Copies=1"; Pfam description=ABC transporter
  misc_feature (102)..(108): Xaa can be any naturally occurring amino acid
VSIGGEISYSSLEPWLFQSSVRKNILFGKPYEKTWYDKVVKVCALERDFEQFPHKDRTIVGEKGVSLSGGQRARINLARAIYRNADVYLLDDPLSAVDTHVXXXXXXXCIVNHLRGKTRILVTHQIQYFKKEILFVVVNDGKIESPGTFDELMEI

SEQ ID NO: 35917 - protein, 83 aa, Diabrotica virgifera
  misc_feature: Coding regions on vcDNA: vcDNA=SeqID_15614; Strand=+; Position=434-682
ENLKKQINDYFESNSLFAVQQFTLAIHHFTGSNLEGFENFLDNLGSVLDLTKAFDCVTHSILSKKLHAYNFHPMSIQLIESYL

SEQ ID NO: 35918 - protein, 43 aa, Diabrotica virgifera
  misc_feature: Coding regions on vcDNA: vcDNA=SeqID_15615; Strand=-; Position=45-176
SRKSTELATSLYSIEHRWSGLNLACRITVDFTSHPRVRKVRCI

SEQ ID NO: 35919 - protein, 105 aa, Diabrotica virgifera
  misc_feature: Coding regions on vcDNA: vcDNA=SeqID_15616; Strand=+; Position=126-443
  misc_feature: Homolog annotation: Hit_ID=XP_312147.1; Match level="QueryCoverage =94%, HitCoverage=89%, E-value=2e-29, Identity=64%"; Hit description =ENSANGP00000022176 [Anopheles gambiae]
YARRMNRLSNRIFGEVVRPTNPKSMKVVKLFAAEPVHLQREVYAYYPRHIETGKLMMKLRHYGLYRDEHADFQDEMDRMRALRGKPKHIRKSKGEREKEAADKKE

SEQ ID NO: 35920 - protein, 75 aa, Diabrotica virgifera
  misc_feature: Coding regions on vcDNA: vcDNA=SeqID_15617; Strand=-; Position=239-466
KCFSKIELINIKFPSDHLGMGYFMWMTQSPTYTPDLTPSDYYLFRFFLKQVLPDIFHLAPIILCYKHVFYEITII

SEQ ID NO: 35921 - protein, 121 aa, Diabrotica virgifera
  misc_feature: Coding regions on vcDNA: vcDNA=SeqID_15618; Strand=-; Position=297-662
QTYQSIRRIVDSMCCLGYRRTSHSRSHEDDRIISFIWSYVSKRGTVWKVQGYSEIRLFGSSASLCHSRLQGIFVFASCRSSSRQGEGDMCIMQMGVLQLHLMYRYPGQRLEGGRGESISGM

SEQ ID NO: 35922 - protein, 116 aa, Diabrotica virgifera
  misc_feature: Coding regions on vcDNA: vcDNA=SeqID_15619; Strand=+; Position=209-559
  misc_feature (102)..(108): Xaa can be any naturally occurring amino acid
SPIIKCPLVIPSKHIHLKLIKLLKNCEKSSNPIPGYPPLKTNHDNEYLLDIPWENFSEPVIIYCTRINVDTLTILTISNVSTAQYYTNNKNIARSVHPKMNXXXXXXXSAYSDCAA

SEQ ID NO: 35923 - protein, 138 aa, Diabrotica virgifera
  misc_feature: Coding regions on vcDNA: vcDNA=SeqID_15620; Strand=-; Position=309-725
  misc_feature (12)..(23): Xaa can be any naturally occurring amino acid
  misc_feature (25)..(47): Xaa can be any naturally occurring amino acid
  misc_feature (49)..(76): Xaa can be any naturally occurring amino acid
  misc_feature (80)..(110): Xaa can be any naturally occurring amino acid
  misc_feature (117)..(123): Xaa can be any naturally occurring amino acid
KKICAVFFPLGXXXXXXXXXXXXGXXXXXXXXXXXXXXXXXXXXXXXPXXXXXXXXXXXXXXXXXXXXXXXXXXXXLGGXXXXXXXXXXXXXXXXXXXXXXXXXXXXXXXHPFLPTXXXXXXXLCSLSPGQNPRAHSN

SEQ ID NO: 35924 - protein, 68 aa, Diabrotica virgifera
  misc_feature: Coding regions on vcDNA: vcDNA=SeqID_15621; Strand=-; Position=113-319
TTICGAPDQSNGVFFDKLVVHEMIEFETGEVHINKSMFTQSSGGIPCHKMAIIKSLRDGNGALESSFK

SEQ ID NO: 35925 - protein, 85 aa, Diabrotica virgifera
  misc_feature: Coding regions on vcDNA: vcDNA=SeqID_15622; Strand=-; Position=44-301
  misc_feature (34)..(39): Xaa can be any naturally occurring amino acid
EFSGHVDVITFDFSLGKLARPASTCFSFVSVALXXXXXXGSRCRGHRSHRVYTHQAWTSKKIGHRWESLLQLSNEPWGTLGTRIA

SEQ ID NO: 35926 - protein, 109 aa, Diabrotica virgifera
  misc_feature: Coding regions on vcDNA: vcDNA=SeqID_15623; Strand=+; Position=111-440
  misc_feature: Homolog annotation: Hit_ID=LUFF9; Match level="QueryCoverage=86%, HitCoverage=31%, E-value=1e-10, Identity=36%"; Hit description =annexin IX - fruit fly (Drosophila melanogaster) (fragment) gb|AAA28370.1| annexin IX
  misc_feature (21)..(21): Xaa can be any naturally occurring amino acid
  misc_feature (36)..(36): Xaa can be any naturally occurring amino acid
  misc_feature (48)..(48): Xaa can be any naturally occurring amino acid
LKNVMKGFGLEKKEIINVMVXRGFEKSFEIGEIFEXNKVKILNKSFRXDLWGMYEDVMIVILFILCILYGRDLNYVVLGLGIYVEVMIKILCILLYDRIVLMKGICIKK

SEQ ID NO: 35927 - protein, 149 aa, Diabrotica virgifera
  misc_feature: Coding regions on vcDNA: vcDNA=SeqID_15624; Strand=+; Position=209-655
  misc_feature: Homolog annotation: Hit_ID=XP_317373.1; Match level="QueryCoverage =100%, HitCoverage=59%, E-value=3e-35, Identity=49%"; Hit description= ENSANGP00000006936 [Anopheles gambiae]
  misc_feature: Gene Ontology Annotation: Molecular function=general RNA polymerase II transcription factor activity; Cellular component=transcription factor TFIID complex; Biological process=transcription initiation from Pol II promoter
  misc_feature: Pfam annotation: Pfam_ID=TBP; Match level="Score=7.5, E-value=0.002, Copies=1"; Pfam description=Transcription factor TFIID (or TATA-bi
  misc_feature (23)..(23): Xaa can be any naturally occurring amino acid
  misc_feature (50)..(50): Xaa can be any naturally occurring amino acid
  misc_feature (81)..(81): Xaa can be any naturally occurring amino acid
  misc_feature (112)..(112): Xaa can be any naturally occurring amino acid
  misc_feature (115)..(115): Xaa can be any naturally occurring amino acid
TITARTRNSECNPSRVHEAIMRXKITKNHCPYFRSGKIVCTGNKNEHDEXVEAEKFDTIKRRLGYNIKFCNYQRQSLLCIXDLTIAIKLENLYMMHGQFRSYKAEHVSVLAXQMXKPKVMILVFVNGKVVFTDAKPKRDIKESLNNIYP

SEQ ID NO: 35928 - protein, 138 aa, Diabrotica virgifera
  misc_feature: Coding regions on vcDNA: vcDNA=SeqID_15625; Strand=-; Position=1-414
  misc_feature (58)..(64): Xaa can be any naturally occurring amino acid
SGCGVTRSCSLCLCSSGGGPAGCLLCSCFAVPRSAVCRLSCFPSFFVLVVHLAGLPAXXXXXXXVGAFFPRLPVGLSSPLFPNSAFLVCFACFLGFLCFVVLLHLLFTLGYGLEKKWSLLLGLVVGFLWPLLGAAARF

SEQ ID NO: 35929 - protein, 48 aa, Diabrotica virgifera
  misc_feature: Coding regions on vcDNA: vcDNA=SeqID_15626; Strand=-; Position=159-305
  misc_feature (2)..(8): Xaa can be any naturally occurring amino acid
HXXXXXXXLLLLLLKKLNLNKLLFLHSSLQILNTNHINISNYTYPPHN

SEQ ID NO: 35930 - protein, 86 aa, Diabrotica virgifera
  misc_feature: Coding regions on vcDNA: vcDNA=SeqID_15627; Strand=+; Position=2-262
LHDRREEYAGSDLMVRTGRMPTKRFAYPTPTFKKENPLAPLVCPRYQFMTRCYSPFWTYKAPVQPIAETHIHLAPDVVIDDQLRPN

SEQ ID NO: 35931 - protein, 298 aa, Diabrotica virgifera
  misc_feature: Coding regions on vcDNA: vcDNA=SeqID_15628; Strand=+; Position=34-927
  misc_feature: Homolog annotation: Hit_ID=XP_318948.1; Match level="QueryCoverage =99%, HitCoverage=70%, E-value=1e-112, Identity=70%"; Hit description= ENSANGP00000015673 [Anopheles gambiae]
  misc_feature: Gene Ontology Annotation: Cellular component=signalosome complex; Biological process=photoreceptor differentiation (sensu Drosophila)
  misc_feature (273)..(273): Xaa can be any naturally occurring amino acid
  misc_feature (282)..(282): Xaa can be any naturally occurring amino acid
YLKIAMSNKAQNLRVQLQNIIASGGSHKDQAEKYRSTLEGILQESGTDLIECLQTFIEAILNENVSLVISRQILTEISAHLMKLKDDVSKAVSHYMLDKVQPRVISFEEQVASIRQHLALIYERNQMWREAAVVLVGIPLETGQKQYTVDYKLETYLKIARLYLENDDPVQAEAFINRASLLQAESRNEQLQIYYKVCYARVLDYRRKFIEAAQRYNELSYRNIVHEDERMTALRNALVCTVLASAGQQRSRMLATLFKDERCQQLPAVGILXKCILKRLLXDLNFGDFRSLLSPHQK

SEQ ID NO: 35932 - protein, 61 aa, Diabrotica virgifera
  misc_feature: Coding regions on vcDNA: vcDNA=SeqID_15629; Strand=-; Position=148-333
DLIALTNIFDFQHFFNNISRYLQKLRYFVGTLKLNFVLLPTSFEMVIVYSYLLSGQLFTLC

SEQ ID NO: 35933 - protein, 66 aa, Diabrotica virgifera
  misc_feature: Coding regions on vcDNA: vcDNA=SeqID_15630; Strand=-; Position=2-199
  misc_feature (2)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
FXXXXXXXXXXXNPTWLTPVLNXXXXXXXXSNXXXXXXXXXXXXXXPTSRSXXXXXXXXXXXXXXV

SEQ ID NO: 35934 - protein, 100 aa, Diabrotica virgifera
  misc_feature: Coding regions on vcDNA: vcDNA=SeqID_15631; Strand=+; Position=38-340
GKRMNELCTFVDTFFQKNGLRAFHLKPNWPYTDQIESPQYDGIVEQAAPYHDVNTSKKTSLDPDAQRINQSLKLQIGALYRTELPARRVVDSPTAPINTD

SEQ ID NO: 35935 - protein, 304 aa, Diabrotica virgifera
  misc_feature: Coding regions on vcDNA: vcDNA=SeqID_15632; Strand=+; Position=282 -1192
  misc_feature: Homolog annotation: Hit_ID=CAB62280.1; Match level="QueryCoverage =90%, HitCoverage=93%, E-value=3e-42, Identity=39%"; Hit description =hydroxyproline-rich glycoprotein DZ-HRGP [Volvox carteri f. nagariensis]
  misc_feature: Gene Ontology Annotation: Molecular function=profilin binding; Cellular component=lamellipodium; Biological process=actin filament organization
  misc_feature (68)..(68): Xaa can be any naturally occurring amino acid
  misc_feature (100)..(106): Xaa can be any naturally occurring amino acid
  misc_feature (122)..(122): Xaa can be any naturally occurring amino acid
  misc_feature (183)..(192): Xaa can be any naturally occurring amino acid
  misc_feature (195)..(201): Xaa can be any naturally occurring amino acid
  misc_feature (221)..(238): Xaa can be any naturally occurring amino acid
  misc_feature (245)..(253): Xaa can be any naturally occurring amino acid
  misc_feature (263)..(263): Xaa can be any naturally occurring amino acid
IHLIFPQIHLNLFINHILIIQYFYLLTIAYSSPPAYHRTATNTSFFTQPPGPISLHISPHRPHSPPPXPPRTTLPSFPPSPSPLLPPPTAPPTPPPPPPXXXXXXXRSAPPPPPSSPRSPPXPPPPPFPPSSPPPRFPPPPSSSSIYLYSPTLLYHPLPPPFPLFPSSPRPLFPLPPASSPSXXXXXXXXXXPPXXXXXXXSLSPPSPLLLHSPLLITAPXXXXXXXXXXXXXXXXXXPSPPPPXXXXXXXXXSSHSPPPPPXSPRLPHPPPMSPPPPLLLCRPRPPSPPPPAPAPPPLLSCLP

SEQ ID NO: 35936 - protein, 239 aa, Diabrotica virgifera
  misc_feature: Coding regions on vcDNA: vcDNA=SeqID_15633; Strand=-; Position=1-717
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(235): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGREG

SEQ ID NO: 35937 - protein, 111 aa, Diabrotica virgifera
  misc_feature: Coding regions on vcDNA: vcDNA=SeqID_15634; Strand=+; Position=237-570
  misc_feature: Homolog annotation: Hit_ID=AAL51056.1; Match level="QueryCoverage =97%, HitCoverage=27%, E-value=5e-25, Identity=54%"; Hit description =cathepsin D [Apriona germari]
  misc_feature: Gene Ontology Annotation: Molecular function=aspartic-type endopeptidase activity; Cellular component=lysosome; Biological process=induction of non-apoptotic programmed cell death
  misc_feature (27)..(27): Xaa can be any naturally occurring amino acid
  misc_feature (45)..(45): Xaa can be any naturally occurring amino acid
  misc_feature (51)..(51): Xaa can be any naturally occurring amino acid
  misc_feature (63)..(63): Xaa can be any naturally occurring amino acid
  misc_feature (73)..(73): Xaa can be any naturally occurring amino acid
NRYGGPTPKALCDYSNGQYYGPIILGXPPQTFRDNFHTGSSSLLXVPSCRXGFTNIACLLHTXYDSSKSSIYXQNGTKYEIHYVSGSLSGLLYTEVDPYGNDAYREHPFVE

SEQ ID NO: 35938 - protein, 97 aa, Diabrotica virgifera
  misc_feature: Coding regions on vcDNA: vcDNA=SeqID_15635; Strand=+; Position=239-532
  misc_feature (18)..(24): Xaa can be any naturally occurring amino acid
FLLHSMPINYFNHWIHSXXXXXXXELIIYATVIREHSKVISKIMVTKSLSNNLYVQGYSLYFDHPVNCFIHRVRKKYKKTKVIRFLNYDFLPYVSYC

SEQ ID NO: 35939 - protein, 216 aa, Diabrotica virgifera
  misc_feature: Coding regions on vcDNA: vcDNA=SeqID_15636; Strand=+; Position=161-811
  misc_feature: Homolog annotation: Hit_ID=XP_393203.1; Match level="QueryCoverage =89%, HitCoverage=8%, E-value=2e-38, Identity=47%"; Hit description =similar to RE38148p [Apis mellifera]
  misc_feature (66)..(77): Xaa can be any naturally occurring amino acid
  misc_feature (108)..(114): Xaa can be any naturally occurring amino acid
MENNEYPTDQNKERRNSNTEYMSTKCRITKPEPPKPATNPLQFIKVAPCPLFQKAHEQIKKVEEIXXXXXXXXXXXXDWQTNLDNWKSSRRKRQEHIIERVVEVKKLXXXXXXXKSRRKSKTFNEMMEERSRGRHKFNIPLYEDDSNDLSDYGIGSSSSKTNSIKDVDTDDSSSILDEKDNHTFDLSSTKGNSSTSNQSQSEDETNTTKNEPISGK

SEQ ID NO: 35940 - protein, 57 aa, Diabrotica virgifera
  misc_feature: Coding regions on vcDNA: vcDNA=SeqID_15637; Strand=+; Position=1-171
  misc_feature (1)..(14): Xaa can be any naturally occurring amino acid
XXXXXXXXXXXXXXQIYRPHQRTSRTFFPPCLLQTCLFVLTLKAPPAPLITSNARRI

SEQ ID NO: 35941 - protein, 89 aa, Diabrotica virgifera
  misc_feature: Coding regions on vcDNA: vcDNA=SeqID_15638; Strand=+; Position=117-386
MRDYNKKSLLNKDLAQGIFQRTLEPRTTPFSKEHLYMSSKLAYEITTPEKVSKRDRWPRTSELPEIFRSLIHYYLAGMHSDAATAPDEL

SEQ ID NO: 35942 - protein, 71 aa, Diabrotica virgifera
  misc_feature: Coding regions on vcDNA: vcDNA=SeqID_15639; Strand=-; Position=1-213
  misc_feature (1)..(24): Xaa can be any naturally occurring amino acid
  misc_feature (37)..(48): Xaa can be any naturally occurring amino acid
  misc_feature (52)..(71): Xaa can be any naturally occurring amino acid
XXXXXXXXXXXXXXXXXXXXXXXXCNKKIKDYGTLAXXXXXXXXXXXXGRRXXXXXXXXXXXXXXXXXXXX

SEQ ID NO: 35943 - protein, 84 aa, Diabrotica virgifera
  misc_feature: Coding regions on vcDNA: vcDNA=SeqID_15640; Strand=+; Position=221-472
RYTQKSGYFFITTGLNQSLCEVSKLCELLLTIPVTSASVERSFSVFKNALKVLQEILQSKTDFTSPLKTTAFNHYQNFDRTIEL

SEQ ID NO: 35944 - protein, 189 aa, Diabrotica virgifera
  misc_feature: Coding regions on vcDNA: vcDNA=SeqID_15641; Strand=+; Position=36-602
  misc_feature: Homolog annotation: Hit_ID=CAD22154.1; Match level="QueryCoverage =98%, HitCoverage=53%, E-value=6e-51, Identity=51%"; Hit description =pherophorin-dz1 protein [Volvox carteri f. nagariensis]
  misc_feature: Gene Ontology Annotation: Cellular component=extracellular space
PPAPTPPQNLPPKNPQKNPPPMPPKPPRAPPFNKTPQGPNIFGGPPKKPQLFSPNPPPGPPKKPPPKHPPQKIPPPLFKQHPLPPPPQPPPLSPPPPPSPAPRPPLPHPSPAPHTPPVPPPPPSPRDTPIPSPTPTTPPHTLIPTPPSLPPPSPPPHPHPHTPPSLPPYPTPPPYPTSHPHPLPYPSAF

SEQ ID NO: 35945 - protein, 76 aa, Diabrotica virgifera
  misc_feature: Coding regions on vcDNA: vcDNA=SeqID_15642; Strand=-; Position=2-229
YLRKQYSVNRYFYFGLQSYKSIFADRGEDCNKFLLAFDLEFFQKASLSFFVHFCISSIMLVGVTPRNGFERSRTQG

SEQ ID NO: 35946 - protein, 88 aa, Diabrotica virgifera
  misc_feature: Coding regions on vcDNA: vcDNA=SeqID_15643; Strand=+; Position=184-450
IFVSALLDRVARPVLTLSVLYPLQDGLAEAPTKYVLFVHILSEFHPNYLAADSSFAFKKSIEISRFFLGPVNTVKSVLTVTCQNRPVS

SEQ ID NO: 35947 - protein, 103 aa, Diabrotica virgifera
  misc_feature: Coding regions on vcDNA: vcDNA=SeqID_15644; Strand=-; Position=128-439
  misc_feature: Homolog annotation: Hit_ID=ZP_00205237.1; Match level="QueryCoverage =99%, HitCoverage=43%, E-value=3e-41, Identity=72%"; Hit description =hypothetical protein Paer03002168 [Pseudomonas aeruginosa UCBPP -PA14] gb|AAP84234.1| putative
LRTTPDGYQQKKITDTGYPPVDWKAVHVLLWEEHHGPVPINMCVCFKDGNKAHIALNNLELLTRAERMRRNTIHRYPEELKSAIRAIGKLKRTIREVEHEEQD

SEQ ID NO: 35948 - protein, 75 aa, Diabrotica virgifera
  misc_feature: Coding regions on vcDNA: vcDNA=SeqID_15645; Strand=-; Position=65-292
  misc_feature (29)..(36): Xaa can be any naturally occurring amino acid
  misc_feature (62)..(68): Xaa can be any naturally occurring amino acid
ETVGVLGIPPHNIFEVLGRALRAQLFCGXXXXXXXXGSPFWFFANKFCFFFPHPKNIFPFEXXXXXXXPFVKLFH

SEQ ID NO: 35949 - protein, 147 aa, Diabrotica virgifera
  misc_feature: Coding regions on vcDNA: vcDNA=SeqID_15646; Strand=+; Position=165-606
  misc_feature: Homolog annotation: Hit_ID=AAB87895.1; Match level="QueryCoverage =97%, HitCoverage=47%, E-value=5e-29, Identity=47%"; Hit description =glyceraldehyde-3-phosphate dehydrogenase-2 [Drosophila subobscura] sp|O44105|G3P2_DROSU Glyceraldehyde-3-p
  misc_feature: Gene Ontology Annotation: Molecular function=glyceraldehyde 3 -phosphate dehydrogenase (phosphorylating) activity; Cellular component=cytoplasm; Biological process=glycolysis
  misc_feature: Pfam annotation: Pfam_ID=Gp_dh_N; Match level="Score=-28.2, E-value =9.7e-06, Copies=1"; Pfam description=Glyceraldehyde 3-phosphate dehydrogena
  misc_feature (18)..(18): Xaa can be any naturally occurring amino acid
  misc_feature (97)..(97): Xaa can be any naturally occurring amino acid
YSDNDPFLDVHYMIYLIXFDSTPVRYNVCAYHDGIYSFVDVIVISVHRERHPSAIPWSTSDAYYAIKSTGEYTYSSQTSTNILTALLIKPSSQHPSXDAPMYECGDNLDAYYPADPVMSTASYTTNCLAPLARAIHDDFEIYESLMT

SEQ ID NO: 35950 - protein, 166 aa, Diabrotica virgifera
  misc_feature: Coding regions on vcDNA: vcDNA=SeqID_15647; Strand=+; Position=1-498
  misc_feature (7)..(13): Xaa can be any naturally occurring amino acid
  misc_feature (21)..(40): Xaa can be any naturally occurring amino acid
  misc_feature (42)..(164): Xaa can be any naturally occurring amino acid
SLKGRPXXXXXXXHFFKKSIXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYI

SEQ ID NO: 35951 - protein, 195 aa, Diabrotica virgifera
  misc_feature: Coding regions on vcDNA: vcDNA=SeqID_15648; Strand=+; Position=1-588
  misc_feature: Homolog annotation: Hit_ID=XP_396366.1; Match level="QueryCoverage =95%, HitCoverage=9%, E-value=1e-42, Identity=44%"; Hit description =similar to CG4733-PA [Apis mellifera]
  misc_feature: Gene Ontology Annotation: Molecular function=protein binding; Cellular component=nucleus; Biological process=response to nutrients
  misc_feature: Pfam annotation: Pfam_ID=TPR_1; Match level="Score=105.1, E-value =1.8e-28, Copies=4"; Pfam description=Tetratricopeptide repeat
  misc_feature (153)..(158): Xaa can be any naturally occurring amino acid
EIRPNFAAAWMNLGIVLTNLNQSEEAEHCYRMAITHRKKYPDCYYNLGNLYLDLRRNEDALKSWEMAVLYRPTHVAAWSNTLVLLDSMTKYDEVLELGRTALIHNPKAPALHFSFANTLGKIQQFEKAEGHFLEAINLNPDNGLYYSNLGVLXXXXXXKEKARQMYQKALQINPTLKSAELNLKRLTTDAQQDKH

SEQ ID NO: 35952 - protein, 125 aa, Diabrotica virgifera
  misc_feature: Coding regions on vcDNA: vcDNA=SeqID_15649; Strand=+; Position=152-527
  misc_feature: Homolog annotation: Hit_ID=NP_599225.1; Match level="QueryCoverage =80%, HitCoverage=31%, E-value=2e-11, Identity=33%"; Hit description =p34 protein [Rattus norvegicus] gb|AAD51852.1| p34 [Rattus norvegicus]
  misc_feature (106)..(106): Xaa can be any naturally occurring amino acid
MISINVMTNPDVYNTHWNIDTKYYTAQVNLLGIETTEIEKDEDFLSRIEALIIHMDSNSKTGLDDLKKWEFLGDVWNVDVKLLLANYCTDSTNMTKSQALECCLKXGLELIEMASHDPTRQTTEL

SEQ ID NO: 35953 - protein, 176 aa, Diabrotica virgifera
  misc_feature: Coding regions on vcDNA: vcDNA=SeqID_15650; Strand=-; Position=99-629
  misc_feature: Homolog annotation: Hit_ID=XP_394859.1; Match level="QueryCoverage =97%, HitCoverage=53%, E-value=6e-63, Identity=66%"; Hit description =similar to ENSANGP00000021628 [Apis mellifera]
RISPEQKSIPKEETRVALLANFFVSEGKPGKVLKVHVKKRTGEDNFITSIRKAIVEEYKELVGLGGVFLLKEGKAKQHVMRDFSKTPIENEEMLNQWLKFYNMSAPLIAVGTLVNSDGGDLDLRVQHFHSFSHHNEAGHYHYDTTPDTVEYLGYFNVGEEIYRIDKPVDTHYWGRD

SEQ ID NO: 35954 - protein, 124 aa, Diabrotica virgifera
  misc_feature: Coding regions on vcDNA: vcDNA=SeqID_15651; Strand=-; Position=2-373
  misc_feature (13)..(20): Xaa can be any naturally occurring amino acid
  misc_feature (22)..(46): Xaa can be any naturally occurring amino acid
  misc_feature (53)..(70): Xaa can be any naturally occurring amino acid
  misc_feature (75)..(92): Xaa can be any naturally occurring amino acid
  misc_feature (95)..(123): Xaa can be any naturally occurring amino acid
ITLQSDTKPNPSXXXXXXXXLXXXXXXXXXXXXXXXXXXXXXXXXXPLIYSSXXXXXXXXXXXXXXXXXXDIQSXXXXXXXXXXXXXXXXXXITXXXXXXXXXXXXXXXXXXXXXXXXXXXXXA

SEQ ID NO: 35955 - protein, 32 aa, Diabrotica virgifera
  misc_feature: Coding regions on vcDNA: vcDNA=SeqID_15652; Strand=-; Position=1-96
  misc_feature (2)..(30): Xaa can be any naturally occurring amino acid
KXXXXXXXXXXXXXXXXXXXXXXXXXXXXXNK

SEQ ID NO: 35956 - protein, 21 aa, Diabrotica virgifera
  misc_feature: Coding regions on vcDNA: vcDNA=SeqID_15653; Strand=-; Position=3-65
QMTSSVEGFTVEIVIPPSDAE

SEQ ID NO: 35957 - protein, 99 aa, Diabrotica virgifera
  misc_feature: Coding regions on vcDNA: vcDNA=SeqID_15654; Strand=+; Position=685-981
  misc_feature (20)..(26): Xaa can be any naturally occurring amino acid
KTMEKPFNFFLLGSFSHIPXXXXXXXGPLSKRIPSFTSPACHTKTSFKMCTLKSISLAAIYHPRDGKNPGFPHLIPFTTFPPFLPLWGNTKSPPTSPLP

SEQ ID NO: 35958 - protein, 109 aa, Diabrotica virgifera
  misc_feature: Coding regions on vcDNA: vcDNA=SeqID_15655; Strand=+; Position=107-437
  misc_feature: Homolog annotation: Hit_ID=AAA93214.1; Match level="QueryCoverage =63%, HitCoverage=16%, E-value=1e-21, Identity=73%"; Hit description =elongation factor 1-alpha
  misc_feature (83)..(83): Xaa can be any naturally occurring amino acid
  misc_feature (91)..(91): Xaa can be any naturally occurring amino acid
  misc_feature (100)..(100): Xaa can be any naturally occurring amino acid
FPPQRVQTPTAVPAPPRSYIPSSVPFILSLFSNSKWFTNCGAIDKRTIEKLENKTQEMGKGSFKYAWVLDKLKGERKREITIXIFALRKFXTAHYYVILXDGPGHQNFH

SEQ ID NO: 35959 - protein, 159 aa, Diabrotica virgifera
  misc_feature: Coding regions on vcDNA: vcDNA=SeqID_15656; Strand=+; Position=49-525
FNTLEPLFKNTFKFEMESSEDFMKRKQNVLISDHHGDSLEKPDNVQIKSEPEECMFESNYAEDSLPDSYCSDVIKIEEQHLQCETDSPFPIISKQEIKTEIKKELDDDNLGVNHGCESRFKSTNTKELDSEKDVKLQIGASTEIHHEQHCRSTKRSKLL

SEQ ID NO: 35960 - protein, 92 aa, Diabrotica virgifera
  misc_feature: Coding regions on vcDNA: vcDNA=SeqID_15657; Strand=+; Position=98-375
  misc_feature: Homolog annotation: Hit_ID=AAF67724.2; Match level="QueryCoverage =96%, HitCoverage=16%, E-value=3e-11, Identity=52%"; Hit description =insecticide resistance-associated cytochrome P450 [Diabrotica virgifera virgifera]
  misc_feature (29)..(35): Xaa can be any naturally occurring amino acid
  misc_feature (58)..(58): Xaa can be any naturally occurring amino acid
  misc_feature (83)..(83): Xaa can be any naturally occurring amino acid
MFFKNLSAALAAVFVIYNSFTNFLKNTVXXXXXXXKLPGPPKLPIFGELPLNLFLLLXYATNFKNFREWNRKIFPTFISVVVXLDLPVSIVP

SEQ ID NO: 35961 - protein, 46 aa, Diabrotica virgifera
  misc_feature: Coding regions on vcDNA: vcDNA=SeqID_15658; Strand=+; Position=1-141
IYPYLRIPFGGPFALNPLPFRVQVPEGKTTQVFTPGNSDVTLFPPP

SEQ ID NO: 35962 - protein, 81 aa, Diabrotica virgifera
  misc_feature: Coding regions on vcDNA: vcDNA=SeqID_15659; Strand=-; Position=2-244
  misc_feature (3)..(15): Xaa can be any naturally occurring amino acid
  misc_feature (18)..(28): Xaa can be any naturally occurring amino acid
  misc_feature (38)..(45): Xaa can be any naturally occurring amino acid
  misc_feature (48)..(61): Xaa can be any naturally occurring amino acid
  misc_feature (67)..(80): Xaa can be any naturally occurring amino acid
LLXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 35963 - protein, 92 aa, Diabrotica virgifera
  misc_feature: Coding regions on vcDNA: vcDNA=SeqID_15660; Strand=+; Position=20-298
  misc_feature: Homolog annotation: Hit_ID=XP_531711.1; Match level="QueryCoverage =77%, HitCoverage=14%, E-value=2e-15, Identity=53%"; Hit description =PREDICTED: similar to kraken-like [Canis familiaris]
  misc_feature: Gene Ontology Annotation: Molecular function=hydrolase activity; Cellular component=cytoplasmic vesicle; Biological process=digestion
MDLLPLNDMVENNEESRNINELTIPVAWGHIAVKAWGEPHHKHVLMFHGIGDNAGSFDNLLALLPKNFYYICTDFPSHGKSSHLPLTIPDKC

SEQ ID NO: 35964 - protein, 134 aa, Diabrotica virgifera
  misc_feature: Coding regions on vcDNA: vcDNA=SeqID_15661; Strand=-; Position=28-432
  misc_feature (7)..(15): Xaa can be any naturally occurring amino acid
  misc_feature (59)..(77): Xaa can be any naturally occurring amino acid
AKLILKXXXXXXXXXILKQIGTPITIFYTSFRSLILNLSTKSQCSFMYTFQNLNRYVLXXXXXXXXXXXXXXXXXXXCHSYRRLEIIKAILTLFTADLKSSLVVQPNHSLKFRNHDILLRPGFRFPSIFPCIIF

SEQ ID NO: 35965 - protein, 63 aa, Diabrotica virgifera
  misc_feature: Coding regions on vcDNA: vcDNA=SeqID_15662; Strand=+; Position=1-189
  misc_feature (1)..(41): Xaa can be any naturally occurring amino acid
  misc_feature (46)..(53): Xaa can be any naturally occurring amino acid
XXXXXXXXXXXXXXXXXXXXXXXXXXXXXXXXXXXXXXXXXNKTLXXXXXXXXIQDQTSSTFK

SEQ ID NO: 35966 - protein, 47 aa, Diabrotica virgifera
  misc_feature: Coding regions on vcDNA: vcDNA=SeqID_15663; Strand=-; Position=23-166
  misc_feature (28)..(34): Xaa can be any naturally occurring amino acid
VWQMSFNIVYGPLLGVRGYRDKYQKQSXXXXXXXGTINIGCEGRCRS

SEQ ID NO: 35967 - protein, 40 aa, Diabrotica virgifera
  misc_feature: Coding regions on vcDNA: vcDNA=SeqID_15664; Strand=+; Position=1-123
  misc_feature (1)..(12): Xaa can be any naturally occurring amino acid
XXXXXXXXXXXXFFIRKLALKGWDDKKTGPYFILIRKSVF

SEQ ID NO: 35968 - protein, 142 aa, Diabrotica virgifera
  misc_feature: Coding regions on vcDNA: vcDNA=SeqID_15665; Strand=+; Position=252-677
TRGEARWVSDKRLLKGPSFTTAGLRRLSFFYSGPQNSISWPRVFNTPGTGKTPGVTPPFIALTTPPPFFPPLGKKAKKGPPPTPPSPHNLSPPFNGDNGAPPPCTPPPILTRGRRLGGVESAQTATPPSNFLPGAPNNRPLL

SEQ ID NO: 35969 - protein, 101 aa, Diabrotica virgifera
  misc_feature: Coding regions on vcDNA: vcDNA=SeqID_15666; Strand=-; Position=1-303
  misc_feature (31)..(42): Xaa can be any naturally occurring amino acid
KILNLRPLYHDYQVSGFLILNLVNKAGVWFXXXXXXXXXXXXCITSRILSENFRLIRVKLPKIQRVEYPYRCGFAPARLSVVRNVQQLFAFSFVNYSAIHK

SEQ ID NO: 35970 - protein, 70 aa, Diabrotica virgifera
  misc_feature: Coding regions on vcDNA: vcDNA=SeqID_15667; Strand=+; Position=23-235
  misc_feature (56)..(61): Xaa can be any naturally occurring amino acid
YYRTIPSSMDWLINRSIVTCRTRSTTISSKLLWKLPTPKNLGTVLKEPRRRYLYWXXXXXXPCQKFYLEN

SEQ ID NO: 35971 - protein, 78 aa, Diabrotica virgifera
  misc_feature: Coding regions on vcDNA: vcDNA=SeqID_15668; Strand=-; Position=131-367
  misc_feature: Pfam annotation: Pfam_ID=RRM_1; Match level="Score=31.1, E-value=3.4e- 06, Copies=1"; Pfam description=RNA recognition motif. (a.k.a. RRM, RB
YKQNFLQKKVLISNLPSTLSYNLLNEKCQEFGDVQGFETKGQGSVLLTYASDWQAEKAIKNLDKARIDGRMIDARLYF

SEQ ID NO: 35972 - protein, 291 aa, Diabrotica virgifera
  misc_feature: Coding regions on vcDNA: vcDNA=SeqID_15669; Strand=+; Position=2-872
  misc_feature: Homolog annotation: Hit_ID=EAL34457.1; Match level="QueryCoverage =99%, HitCoverage=47%, E-value=5e-72, Identity=54%"; Hit description =GA10876-PA [Drosophila pseudoobscura]
  misc_feature: Gene Ontology Annotation: Molecular function=transcription co -activator activity; Cellular component=nucleus; Biological process =transcription
  misc_feature: Pfam annotation: Pfam_ID=RRM_1; Match level="Score=47.5, E-value=3.9e- 11, Copies=1"; Pfam description=RNA recognition motif. (a.k.a. RRM, R
  misc_feature (53)..(63): Xaa can be any naturally occurring amino acid
  misc_feature (282)..(282): Xaa can be any naturally occurring amino acid
SRGRRSTSRSNRSTSRGRRSTSRSRRSTSRSRRSTSRSKRSRSKERRRSKERXXXXXXXXXXXDRKRRSSSKDRKSRSRDRRDRSKSKDRRSRSRDRRSRSRDRKKRERRERSRTPKERKPSPKRRTPSPTPFGKPPFLKRPRSPLGIRGTSPLEELSAEERDARTVFIMQLSQRIRARDLEDFFSSVGKVRDVRMIVCNKTRRFKGIAYIEFKDPESVALALGLSGQKLLGIPIIVQHTQAEKNRMGNSMPNMLPKGMIGSMRLYVGSLHFYITEEMLRGXIFEPFGQID

SEQ ID NO: 35973 - protein, 266 aa, Diabrotica virgifera; identical to SEQ ID NO: 31687
  misc_feature: Coding regions on vcDNA: vcDNA=SeqID_15670; Strand=-; Position=1-798
  misc_feature (1)..(266): Xaa can be any naturally occurring amino acid

SEQ ID NO: 35974 - protein, 261 aa, Diabrotica virgifera
  misc_feature: Coding regions on vcDNA: vcDNA=SeqID_15671; Strand=-; Position=0-782
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(254): Xaa can be any naturally occurring amino acid
  misc_feature (256)..(260): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 35975 - protein, 44 aa, Diabrotica virgifera
  misc_feature: Coding regions on vcDNA: vcDNA=SeqID_15672; Strand=-; Position=1-132
  misc_feature (1)..(1): Xaa can be any naturally occurring amino acid
  misc_feature (4)..(44): Xaa can be any naturally occurring amino acid
XFIXXXXXXXXXXXXXXXXXXXXXXXXXXXXXXXXXXXXXXXXX

SEQ ID NO: 35976 - protein, 77 aa, Diabrotica virgifera
  misc_feature: Coding regions on vcDNA: vcDNA=SeqID_15673; Strand=+; Position=452-685
  misc_feature (18)..(23): Xaa can be any naturally occurring amino acid
FLLSLSYSKTRCGVLMWXXXXXXTDHQFSILSNFLIFFVGLLCRRSFHNPQINYMPIFLHTCNTQPTTEMALEYQWS

SEQ ID NO: 35977 - protein, 180 aa, Diabrotica virgifera
  misc_feature: Coding regions on vcDNA: vcDNA=SeqID_15674; Strand=+; Position=375-914
  misc_feature: Homolog annotation: Hit_ID=EAL29203.1; Match level="QueryCoverage =83%, HitCoverage=22%, E-value=8e-36, Identity=50%"; Hit description =GA18297-PA [Drosophila pseudoobscura]
  misc_feature: Gene Ontology Annotation: Molecular function=growth factor activity; Cellular component=extracellular space; Biological process=FGF receptor signaling pathway
  misc_feature: Pfam annotation: Pfam_ID=FGF; Match level="Score=118.9, E-value=1.2e -32, Copies=1"; Pfam description=Fibroblast growth factor
  misc_feature (157)..(157): Xaa can be any naturally occurring amino acid
  misc_feature (166)..(166): Xaa can be any naturally occurring amino acid
MVKTFLGLLAASICGLVYAAPLADSCNNLTPFRTDSTTPTSSEESLLEDPAARNERSTNLSHVTGTARKIQMFIKNRHLQILPDGTVNGTTDDTSAYSILQRTTVGIGQMKIQGVVTCQYLCMARCGLLYGSREFGQECVFNETIEQSNYNTYSSQXYSNEKRTLXLALNQRGQSRKVVL

SEQ ID NO: 35978 - protein, 31 aa, Diabrotica virgifera
  misc_feature: Coding regions on vcDNA: vcDNA=SeqID_15675; Strand=-; Position=1-93
  misc_feature (1)..(1): Xaa can be any naturally occurring amino acid
  misc_feature (4)..(30): Xaa can be any naturally occurring amino acid
XIIXXXXXXXXXXXXXXXXXXXXXXXXXXXN

SEQ ID NO: 35979 - protein, 52 aa, Diabrotica virgifera
  misc_feature: Coding regions on vcDNA: vcDNA=SeqID_15676; Strand=+; Position=2-157
  misc_feature (1)..(1): Xaa can be any naturally occurring amino acid
  misc_feature (38)..(38): Xaa can be any naturally occurring amino acid
  misc_feature (45)..(45): Xaa can be any naturally occurring amino acid
  misc_feature (48)..(48): Xaa can be any naturally occurring amino acid
XDDKKTVFTYSLRIYFFSKSSHFLKTRRPIEFIKYYTXFSINSLXYNXFICV

SEQ ID NO: 35980 - protein, 283 aa, Diabrotica virgifera
  misc_feature: Coding regions on vcDNA: vcDNA=SeqID_15677; Strand=+; Position=4-855
  misc_feature: Pfam annotation: Pfam_ID=THAP; Match level="Score=47.3, E-value=4.3e -11, Copies=1"; Pfam description=THAP domain
  misc_feature (258)..(267): Xaa can be any naturally occurring amino acid
MGRLCAVPHCYTGYKRKSTEKISLYKVPDDDFFLTKWQEAIAREDRPITPKDYVCEKHFTEDDIIRKRIRKDVVEEYQRPKLRQDAIPSIFPELPEFILKMTKKRRKIVEGATTTNNTNATSMNKINEENEDIKPDIKIEPEAVNEFERTNTFEAEINTDEIEIKEEIDCEPTNESEEIEEMDSSGIKLYQCDTCNYRTKFSHNLRTHKIKHLSGEDAYMTCEYCSFKSKWETTYINHMKTKHGVILKELFKCPFCKXXXXXXXXXXKHCEKQHEDQDKLIVT

SEQ ID NO: 35981 - protein, 210 aa, Diabrotica virgifera
  misc_feature: Coding regions on vcDNA: vcDNA=SeqID_15678; Strand=+; Position=228-857
  misc_feature: Homolog annotation: Hit_ID=XP_311452.1; Match level="QueryCoverage =97%, HitCoverage=35%, E-value=2e-76, Identity=63%"; Hit description =ENSANGP00000018551 [Anopheles gambiae]
  misc_feature: Gene Ontology Annotation: Molecular function=glucose-6-phosphate 1 -dehydrogenase activity; Cellular component=cytoplasm; Biological process=pentose-phosphate shunt
  misc_feature: Pfam annotation: Pfam_ID=G6PD_N; Match level="Score=296.6, E-value =3.9e-86, Copies=1"; Pfam description=Glucose-6-phosphate dehydrogenase, NA
  misc_feature (202)..(202): Xaa can be any naturally occurring amino acid
MENGKLQSKSAELCLSLYRDSLKSKDMDHDGTHFDGQYPHVFVILGASGDLAKKKIYPTLWWLYRDNVLPVNTIFYGYARSKITLSEVRQKCSPWMDVKPEEKEKYEDFWKLNHYMSGQYTSRTDFELLNKEVEKFEKGPVANRLFYLALPPSVYEDVTVHIKNNCMGQKGWTRIIIEKPFGRDLETSKQLSSHLSQLFTEXQLYRIDHY

SEQ ID NO: 35982 - protein, 194 aa, Diabrotica virgifera
  misc_feature: Coding regions on vcDNA: vcDNA=SeqID_15679; Strand=+; Position=151-732
  misc_feature: Homolog annotation: Hit_ID=XP_308886.1; Match level="QueryCoverage =96%, HitCoverage=70%, E-value=2e-09, Identity=24%"; Hit description =ENSANGP00000013302 [Anopheles gambiae]
  misc_feature (22)..(40): Xaa can be any naturally occurring amino acid
  misc_feature (44)..(61): Xaa can be any naturally occurring amino acid
  misc_feature (71)..(77): Xaa can be any naturally occurring amino acid
  misc_feature (93)..(101): Xaa can be any naturally occurring amino acid
  misc_feature (105)..(111): Xaa can be any naturally occurring amino acid
  misc_feature (122)..(135): Xaa can be any naturally occurring amino acid
  misc_feature (174)..(180): Xaa can be any naturally occurring amino acid
NVDKGKRGRGPKKVLEGLNPPXXXXXXXXXXXXXXXXXXXPPKXXXXXXXXXXXXXXXXXXPPQRESPKIXXXXXXXGGGKGKKKRNFPGGFXXXXXXXXXGEFXXXXXXXKGKFALPPFTXXXXXXXXXXXXXXQTGPKGIPFLGAPGGRTLKNPGPKFKGNGPLQLEIGPFXXXXXXXFKLGNFLFFPGGKN

SEQ ID NO: 35983 - protein, 25 aa, Diabrotica virgifera
  misc_feature: Coding regions on vcDNA: vcDNA=SeqID_15680; Strand=-; Position=3-77
  misc_feature (16)..(25): Xaa can be any naturally occurring amino acid
LKLFQIKITLCYSLKXXXXXXXXXX

SEQ ID NO: 35984 - protein, 261 aa, Diabrotica virgifera
  misc_feature: Coding regions on vcDNA: vcDNA=SeqID_15681; Strand=-; Position=2-784
  misc_feature (1)..(11): Xaa can be any naturally occurring amino acid
  misc_feature (16)..(24): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
  misc_feature (79)..(261): Xaa can be any naturally occurring amino acid
XXXXXXXXXXXGPFVXXXXXXXXXEPNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 35985 - protein, 27 aa, Diabrotica virgifera
  misc_feature: Coding regions on vcDNA: vcDNA=SeqID_15682; Strand=-; Position=1-81
QEYVFCTLPVKSTSEADKEKVSVEGQI

SEQ ID NO: 35986 - protein, 253 aa, Diabrotica virgifera
  misc_feature: Coding regions on vcDNA: vcDNA=SeqID_15683; Strand=+; Position=3-761
  misc_feature (1)..(34): Xaa can be any naturally occurring amino acid
  misc_feature (39)..(63): Xaa can be any naturally occurring amino acid
  misc_feature (66)..(75): Xaa can be any naturally occurring amino acid
  misc_feature (90)..(97): Xaa can be any naturally occurring amino acid
  misc_feature (101)..(107): Xaa can be any naturally occurring amino acid
  misc_feature (109)..(126): Xaa can be any naturally occurring amino acid
  misc_feature (141)..(163): Xaa can be any naturally occurring amino acid
  misc_feature (176)..(184): Xaa can be any naturally occurring amino acid
  misc_feature (189)..(241): Xaa can be any naturally occurring amino acid
  misc_feature (247)..(252): Xaa can be any naturally occurring amino acid
XXXXXXXXXXXXXXXXXXXXXXXXXXXXXXXXXXTLCIXXXXXXXXXXXXXXXXXXXXXXXXXKIXXXXXXXXXXCYSFLNISNFSTNKXXXXXXXXFIIXXXXXXXIXXXXXXXXXXXXXXXXXXHRKLGFKIFTILQYXXXXXXXXXXXXXXXXXXXXXXXLFKSTPADNITIXXXXXXXXXLASIXXXXXXXXXXXXXXXXXXXXXXXXXXXXXXXXXXXXXXXXXXXXXXXXXXXXXDGWMNXXXXXXH

SEQ ID NO: 35987 - protein, 108 aa, Diabrotica virgifera; identical to SEQ ID NO: 27732
  misc_feature: Coding regions on vcDNA: vcDNA=SeqID_15684; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 35988 - protein, 62 aa, Diabrotica virgifera
  misc_feature: Coding regions on vcDNA: vcDNA=SeqID_15685; Strand=-; Position=73-261
  misc_feature (42)..(50): Xaa can be any naturally occurring amino acid
YGCTLGSRPCRTFYQEPPLFVKLTIKGLSELKCLKIMLVILXXXXXXXXXLEGYNCILEYIL

SEQ ID NO: 35989 - protein, 257 aa, Diabrotica virgifera
  misc_feature: Coding regions on vcDNA: vcDNA=SeqID_15686; Strand=+; Position=84-856
  misc_feature: Homolog annotation: Hit_ID=XP_395595.1; Match level="QueryCoverage =96%, HitCoverage=24%, E-value=9e-35, Identity=33%"; Hit description =similar to Kinesin family member 4 [Apis mellifera]
  misc_feature: Gene Ontology Annotation: Molecular function=microtubule motor activity; Cellular component=spindle microtubule; Biological process= anterograde axon cargo transport
  misc_feature: Pfam annotation: Pfam_ID=Kinesin; Match level="Score=69.8, E-value=3e- 19, Copies=1"; Pfam description=Kinesin motor domain
  misc_feature (80)..(80): Xaa can be any naturally occurring amino acid
MESNAEFVNVAIRIKPNKSNSESQCLCIISQEPPVLLLVDRSQTFTFDNIFSEDVSQETVYNKTVKPLVHYVKKGYNSTXFAYGQTGTGKTYTMGTEPNVTDQKNVGLILRTLNQFFEYNDDDDSEVEILLSFIEIYKEKAFDLLQNDTNPLKVKGVKVEGFNKEKVYSLNEAIHFLKMGNKNRHTRGTNQNSQSSRSHAIFTIYCNTKHKKDSPHTSHTKGVLHTINYGSSREIWKVQSVGPKTAQHISLFRDIKG

SEQ ID NO: 35990 - protein, 30 aa, Diabrotica virgifera
  misc_feature: Coding regions on vcDNA: vcDNA=SeqID_15687; Strand=-; Position=0-89
  misc_feature (1)..(27): Xaa can be any naturally occurring amino acid
XXXXXXXXXXXXXXXXXXXXXXXXXXXVSR

SEQ ID NO: 35991 - protein, 226 aa, Diabrotica virgifera
  misc_feature: Coding regions on vcDNA: vcDNA=SeqID_15688; Strand=+; Position=2-679
  misc_feature (1)..(193): Xaa can be any naturally occurring amino acid
  misc_feature (198)..(216): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHFFNXXXXXXXXXXXXXXXXXXXIHYIINSIYS

SEQ ID NO: 35992 - protein, 305 aa, Diabrotica virgifera
  misc_feature: Coding regions on vcDNA: vcDNA=SeqID_15689; Strand=+; Position=9-924
  misc_feature: Homolog annotation: Hit_ID=AAF87759.1; Match level="QueryCoverage =93%, HitCoverage=65%, E-value=1e-107, Identity=73%"; Hit description= cytochrome oxidase subunit I [Diabrotica virgifera virgifera]
  misc_feature: Pfam annotation: Pfam_ID=COX1; Match level="Score=72.2, E-value=1.4e -18, Copies=1"; Pfam description=Cytochrome C and Quinol oxidase polyp
  misc_feature (2)..(15): Xaa can be any naturally occurring amino acid
  misc_feature (23)..(23): Xaa can be any naturally occurring amino acid
  misc_feature (48)..(56): Xaa can be any naturally occurring amino acid
  misc_feature (68)..(68): Xaa can be any naturally occurring amino acid
  misc_feature (82)..(82): Xaa can be any naturally occurring amino acid
  misc_feature (127)..(135): Xaa can be any naturally occurring amino acid
  misc_feature (139)..(145): Xaa can be any naturally occurring amino acid
  misc_feature (156)..(163): Xaa can be any naturally occurring amino acid
  misc_feature (184)..(184): Xaa can be any naturally occurring amino acid
  misc_feature (219)..(219): Xaa can be any naturally occurring amino acid
  misc_feature (236)..(236): Xaa can be any naturally occurring amino acid
  misc_feature (239)..(245): Xaa can be any naturally occurring amino acid
  misc_feature (272)..(278): Xaa can be any naturally occurring amino acid
  misc_feature (291)..(291): Xaa can be any naturally occurring amino acid
LXXXXXXXXXXXXXXERGVGTGXTVYPPLSSNIAHGGPSVDLAIFRLXXXXXXXXXGAINFITTVINXPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYLCVAXXXXXXXIGAVFAIIAGFIXMISLFTGITLIIFI

SEQ ID NO: 35993 - protein, 289 aa, Diabrotica virgifera
  misc_feature: Coding regions on vcDNA: vcDNA=SeqID_15690; Strand=+; Position=3-869
  misc_feature: Homolog annotation: Hit_ID=AAF87759.1; Match level="QueryCoverage =98%, HitCoverage=64%, E-value=1e-112, Identity=75%"; Hit description= cytochrome oxidase subunit I [Diabrotica virgifera virgifera]
  misc_feature: Pfam annotation: Pfam_ID=COX1; Match level="Score=72.7, E-value=1e -18, Copies=1"; Pfam description=Cytochrome C and Quinol oxidase polyp
  misc_feature (12)..(12): Xaa can be any naturally occurring amino acid
  misc_feature (37)..(45): Xaa can be any naturally occurring amino acid
  misc_feature (72)..(72): Xaa can be any naturally occurring amino acid
  misc_feature (117)..(125): Xaa can be any naturally occurring amino acid
  misc_feature (129)..(135): Xaa can be any naturally occurring amino acid
  misc_feature (146)..(153): Xaa can be any naturally occurring amino acid
  misc_feature (174)..(174): Xaa can be any naturally occurring amino acid
  misc_feature (209)..(209): Xaa can be any naturally occurring amino acid
  misc_feature (226)..(226): Xaa can be any naturally occurring amino acid
  misc_feature (229)..(235): Xaa can be any naturally occurring amino acid
  misc_feature (262)..(268): Xaa can be any naturally occurring amino acid
  misc_feature (278)..(278): Xaa can be any naturally occurring amino acid
  misc_feature (282)..(282): Xaa can be any naturally occurring amino acid
QKRSERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAXFIQXFPLFTGI

SEQ ID NO: 35994 - protein, 66 aa, Diabrotica virgifera; identical to SEQ ID NO: 26808
  misc_feature: Coding regions on vcDNA: vcDNA=SeqID_15691; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 35995 - protein, 77 aa, Diabrotica virgifera
  misc_feature: Coding regions on vcDNA: vcDNA=SeqID_15692; Strand=-; Position=1-231
  misc_feature (8)..(22): Xaa can be any naturally occurring amino acid
  misc_feature (26)..(51): Xaa can be any naturally occurring amino acid
  misc_feature (54)..(55): Xaa can be any naturally occurring amino acid
  misc_feature (57)..(57): Xaa can be any naturally occurring amino acid
  misc_feature (59)..(76): Xaa can be any naturally occurring amino acid
SKKWIKKXXXXXXXXXXXXXXXRNKXXXXXXXXXXXXXXXXXXXXXXXXXXKKXXSXLXXXXXXXXXXXXXXXXXXP

SEQ ID NO: 35996 - protein, 127 aa, Diabrotica virgifera
  misc_feature: Coding regions on vcDNA: vcDNA=SeqID_15693; Strand=+; Position=20-403
  misc_feature: Homolog annotation: Hit_ID=AAF90148.1; Match level="QueryCoverage =77%, HitCoverage=33%, E-value=3e-16, Identity=42%"; Hit description =tetraspanin D76 [Manduca sexta]
  misc_feature: Pfam annotation: Pfam_ID=Tetraspannin; Match level="Score=-35.3, E -value=0.0018, Copies=1"; Pfam description=Tetraspanin family
ARQSLLCLLIAVKYEFTSVSDSNNYNLVGLLLISIGYTIKAIYTDFDAFLSSHSYKASDLAIAVGFIILVVALFGCAGAIKESVLLVNLYALLLLVIVILELTVSIIAYKSRSHLEETLSQDMRTKI

SEQ ID NO: 35997 - protein, 32 aa, Diabrotica virgifera
  misc_feature: Coding regions on vcDNA: vcDNA=SeqID_15694; Strand=+; Position=1-96
  misc_feature (2)..(10): Xaa can be any naturally occurring amino acid
  misc_feature (12)..(31): Xaa can be any naturally occurring amino acid
FXXXXXXXXXLXXXXXXXXXXXXXXXXXXXXG

SEQ ID NO: 35998 - protein, 300 aa, Diabrotica virgifera
  misc_feature: Coding regions on vcDNA: vcDNA=SeqID_15695; Strand=-; Position=2-901
  misc_feature (8)..(18): Xaa can be any naturally occurring amino acid
  misc_feature (28)..(35): Xaa can be any naturally occurring amino acid
  misc_feature (38)..(51): Xaa can be any naturally occurring amino acid
  misc_feature (57)..(70): Xaa can be any naturally occurring amino acid
  misc_feature (72)..(288): Xaa can be any naturally occurring amino acid
  misc_feature (291)..(300): Xaa can be any naturally occurring amino acid
FYIFGPFXXXXXXXXXXXTTLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEXXXXXXXXXX

SEQ ID NO: 35999 - protein, 65 aa, Diabrotica virgifera
  misc_feature: Coding regions on vcDNA: vcDNA=SeqID_15696; Strand=-; Position=551-748
ITISILFNEHVMMAITHDDEVCDTSRRRVWLFIRVSNSHLHASRILYFSYDLFIFGLVENIILNY

SEQ ID NO: 36000 - protein, 279 aa, Diabrotica virgifera
  misc_feature: Coding regions on vcDNA: vcDNA=SeqID_15697; Strand=-; Position=1-837
  misc_feature (8)..(51): Xaa can be any naturally occurring amino acid
  misc_feature (61)..(68): Xaa can be any naturally occurring amino acid
  misc_feature (74)..(80): Xaa can be any naturally occurring amino acid
  misc_feature (94)..(184): Xaa can be any naturally occurring amino acid
  misc_feature (188)..(279): Xaa can be any naturally occurring amino acid
KTLLGSCXXXXXXXXXXXXXXXXXXXXXXXXXXXXXXXXXXXXXXXXXXXXVARSKFRAHXXXXXXXXRLLYIXXXXXXXIHRRKKCCRTPLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36001 - protein, 266 aa, Diabrotica virgifera
  misc_feature: Coding regions on vcDNA: vcDNA=SeqID_15698; Strand=+; Position=33-833
  misc_feature: Homolog annotation: Hit_ID=XP_319114.1; Match level="QueryCoverage =98%, HitCoverage=59%, E-value=3e-23, Identity=27%"; Hit description =ENSANGP00000006016 [Anopheles gambiae]
  misc_feature (59)..(66): Xaa can be any naturally occurring amino acid
  misc_feature (114)..(127): Xaa can be any naturally occurring amino acid
  misc_feature (238)..(238): Xaa can be any naturally occurring amino acid
  misc_feature (252)..(252): Xaa can be any naturally occurring amino acid
  misc_feature (264)..(264): Xaa can be any naturally occurring amino acid
MGFFEFGRDERFPTQYDAKRTAVTVDLVDAGLATACIILGISFFISLLTRKLKTNVIVXXXXXXXXLIGTLLLINNFGQEWEVGEIKSVMAYKAGSKHEINGTVSLKIALRGIXXXXXXXXXXXXXXKNETIDYNERFEWIWDQGRFGFGPYAGLLQREFREAQYRGAPLPIIWVVDYFVIDGEGQRFGRFYRTAGWYTHQLMWTAFPCWILSTILFRSVIRYGAYFLGLCGGLQLLXNLIYLVVRNPFPVXIPFEEETLTTHXWV

SEQ ID NO: 36002 - protein, 42 aa, Diabrotica virgifera
  misc_feature: Coding regions on vcDNA: vcDNA=SeqID_15699; Strand=-; Position=1-126
  misc_feature (1)..(41): Xaa can be any naturally occurring amino acid
XXXXXXXXXXXXXXXXXXXXXXXXXXXXXXXXXXXXXXXXXF

SEQ ID NO: 36003 - protein, 134 aa, Diabrotica virgifera
  misc_feature: Coding regions on vcDNA: vcDNA=SeqID_15700; Strand=+; Position=1-402
  misc_feature (1)..(133): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXA

SEQ ID NO: 36004 - protein, 82 aa, Diabrotica virgifera
  misc_feature: Coding regions on vcDNA: vcDNA=SeqID_15701; Strand=+; Position=218-466
HRMHCSILPYEYLRLTTRFIIHHRYRRRCDYLFRGMSEIPRDDAMHSSDTLLLLPGAVDSSPMSARALNIKIPDKYAMIMNE

SEQ ID NO: 36005 - protein, 83 aa, Diabrotica virgifera
  misc_feature: Coding regions on vcDNA: vcDNA=SeqID_15702; Strand=+; Position=406-657
  misc_feature (16)..(23): Xaa can be any naturally occurring amino acid
PPHYLDLILIKKFGEXXXXXXXXGNMATRCNFGLLAYAARISVMPPHELDLIPLEFLTGTETMLVNKIQLHITTSIFVHEFDT

SEQ ID NO: 36006 - protein, 60 aa, Diabrotica virgifera
  misc_feature: Coding regions on vcDNA: vcDNA=SeqID_15703; Strand=-; Position=208-390
  misc_feature (13)..(19): Xaa can be any naturally occurring amino acid
YIFNRSHMLHPIXXXXXXXSIRHFVIIITLVLNLLCPVSLDTVILMLLSSTLVKSLDSLQ

SEQ ID NO: 36007 - protein, 288 aa, Diabrotica virgifera
  misc_feature: Coding regions on vcDNA: vcDNA=SeqID_15704; Strand=+; Position=2-865
  misc_feature (1)..(236): Xaa can be any naturally occurring amino acid
  misc_feature (255)..(266): Xaa can be any naturally occurring amino acid
  misc_feature (273)..(284): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLLKAAMKGSDEKKICLYXXXXXXXXXXXXPKFFSKXXXXXXXXXXXXSSFF

SEQ ID NO: 36008 - protein, 318 aa, Diabrotica virgifera
  misc_feature: Coding regions on vcDNA: vcDNA=SeqID_15705; Strand=+; Position=1-954
  misc_feature: Homolog annotation: Hit_ID=EAA06000.2; Match level="QueryCoverage =97%, HitCoverage=49%, E-value=8e-39, Identity=33%"; Hit description =ENSANGP00000015052 [Anopheles gambiae str. PEST] ref|XP_559563.1| ENSANGP00000015052 [Anopheles gambiae st
  misc_feature: Gene Ontology Annotation: Biological process=reproduction
  misc_feature: Pfam annotation: Pfam_ID=GMC_oxred_N; Match level="Score=-146.3, E -value=0.023, Copies=1"; Pfam description=GMC oxidoreductase
  misc_feature (267)..(267): Xaa can be any naturally occurring amino acid
  misc_feature (276)..(276): Xaa can be any naturally occurring amino acid
  misc_feature (286)..(286): Xaa can be any naturally occurring amino acid
GTLEAPLCIQSGMRANIGKTILGTIRERQNLFVSRHTLVEKIVINPENMEASEVRVRIGLQSLLIKARKEVILSAGTISSPQILMLSGIGPEEHLKQHNISVIKNLAVGENLQDHLFFTGFSVKLDLNALLPRDPIDTVYEYFKHRTGLLSTTGIANFLSFINTKIDSDVPNVSYRHTIFPASDDILLPAVVKAFGMEADMVEAVEKANKYDPVMMILPGIVNPKSRGKVLLRSNKIQDMPLIYPGYMTDNGDEDIQSLLDAIKICXKLLETASLXKHLPELLHLXITNCDEYEFNSPMILECALRHFITTFCDFTST

SEQ ID NO: 36009 - protein, 67 aa, Diabrotica virgifera
  misc_feature: Coding regions on vcDNA: vcDNA=SeqID_15706; Strand=-; Position=358-561
  misc_feature (35)..(44): Xaa can be any naturally occurring amino acid
TVFDSSMGLHSSVYNPFPPIMIRHHLSGKILVRLXXXXXXXXXXVLNLSGAASILLKILGFPKTEVC

SEQ ID NO: 36010 - protein, 63 aa, Diabrotica virgifera
  misc_feature: Coding regions on vcDNA: vcDNA=SeqID_15707; Strand=+; Position=30-218
  misc_feature (19)..(35): Xaa can be any naturally occurring amino acid
  misc_feature (37)..(37): Xaa can be any naturally occurring amino acid
  misc_feature (39)..(39): Xaa can be any naturally occurring amino acid
  misc_feature (45)..(62): Xaa can be any naturally occurring amino acid
RILFLKSQAYIFFTRRETXXXXXXXXXXXXXXXXXYXIXYFNCGXXXXXXXXXXXXXXXXXXP

SEQ ID NO: 36011 - protein, 47 aa, Diabrotica virgifera; identical to SEQ ID NO: 26759
  misc_feature: Coding regions on vcDNA: vcDNA=SeqID_15708; Strand=+; Position=3-146
  misc_feature (1)..(15): Xaa can be any naturally occurring amino acid
  misc_feature (17)..(24): Xaa can be any naturally occurring amino acid

SEQ ID NO: 36012 - protein, 66 aa, Diabrotica virgifera; identical to SEQ ID NO: 26808
  misc_feature: Coding regions on vcDNA: vcDNA=SeqID_15709; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36013 - protein, 156 aa, Diabrotica virgifera
  misc_feature: Coding regions on vcDNA: vcDNA=SeqID_15710; Strand=+; Position=44-514
LKRTLLTWKLGKICIKHGFEEMGILSKCSLVAFELLNEMFAAVGAGFLGVLYLVKKGFNKYDSIRTLTILVVTTASVAYITHKNNKQIKPNKKKVICITGCDSYNFFLVWFNLFDIYETVLSLAVRGDSTDSEGYIPDKNNKQIKTNIKKAICISA

SEQ ID NO: 36014 - protein, 110 aa, Diabrotica virgifera
  misc_feature: Coding regions on vcDNA: vcDNA=SeqID_15711; Strand=+; Position=536-865
  misc_feature (88)..(88): Xaa can be any naturally occurring amino acid
  misc_feature (94)..(94): Xaa can be any naturally occurring amino acid
  misc_feature (104)..(104): Xaa can be any naturally occurring amino acid
SVVEMSHEAQLRRSQRTDFSNPMTPLVSRERSFVRPNKDSQKRRSQTMFAMKGKPTMEIYRPPNVRTDIPLTGKLNVHAKEFTMNHDXQASRSXWNLHLAMAYXARFATT

SEQ ID NO: 36015 - protein, 47 aa, Diabrotica virgifera
  misc_feature: Coding regions on vcDNA: vcDNA=SeqID_15712; Strand=-; Position=1-141
  misc_feature (1)..(47): Xaa can be any naturally occurring amino acid
XXXXXXXXXXXXXXXXXXXXXXXXXXXXXXXXXXXXXXXXXXXXXXX

SEQ ID NO: 36016 - protein, 293 aa, Diabrotica virgifera
  misc_feature: Coding regions on vcDNA: vcDNA=SeqID_15713; Strand=+; Position=30-908
  misc_feature: Homolog annotation: Hit_ID=EAA45449.2; Match level="QueryCoverage =95%, HitCoverage=19%, E-value=2e-78, Identity=50%"; Hit description =ENSANGP00000023755 [Anopheles gambiae str. PEST] ref|XP_565191.1| ENSANGP00000023755 [Anopheles gambiae st
  misc_feature (7)..(7): Xaa can be any naturally occurring amino acid
  misc_feature (282)..(282): Xaa can be any naturally occurring amino acid
GLAVNDXTIPACLPITTDYFPDRRALNLDYVVSLYSLLPDSVNADFVQQRSSYKRPLTTVEVFKELISQRLSQGFQLILMADKNVNLNKMCGPNPKLRTSVVSKSPTENDESYFLSIGRLFHKISLSGNTISVTRYRPRHPYPGFNYQYRYRFHAPWHDTYEESFATFTTEKLEHYNWNYLDHYVCTGGDTEFVLVDALKYWRFRVYLIPFNNPATRKIVEGSEYCDIYQTQTNCEHQQMVDGLNRFIDTAVNKIRRSTISKKPRTIGSSSPFRERLGSNRXTDRPRPRSGSS

SEQ ID NO: 36017 - protein, 78 aa, Diabrotica virgifera
  misc_feature: Coding regions on vcDNA: vcDNA=SeqID_15714; Strand=-; Position=110-346
  misc_feature (4)..(11): Xaa can be any naturally occurring amino acid
  misc_feature (39)..(44): Xaa can be any naturally occurring amino acid
YHNXXXXXXXXAQIEMSFCKISRYICKGVTSRSQKKYFXXXXXXSSFILLASLYSKVRNVSLIIHYSSYARYDQCLSR

SEQ ID NO: 36018 - protein, 247 aa, Diabrotica virgifera
  misc_feature: Coding regions on vcDNA: vcDNA=SeqID_15715; Strand=+; Position=2-745
  misc_feature: Homolog annotation: Hit_ID=NP_650054.2; Match level="QueryCoverage =100%, HitCoverage=56%, E-value=2e-49, Identity=43%"; Hit description= CG17726-PA [Drosophila melanogaster] gb|AAF54614.1| CG17726-PA [Drosophila melanogaster]
  misc_feature: Gene Ontology Annotation: Cellular component=mitochondrion
  misc_feature: Pfam annotation: Pfam_ID=DUF185; Match level="Score=72.6, E-value =1.1e-18, Copies=1"; Pfam description=Uncharacterized ACR, COG1565
  misc_feature (93)..(116): Xaa can be any naturally occurring amino acid
FGEIVAVWLINEWQKMGSPKPLQIVELGPGRGTLASDILRVFNHFKVLEQTRLQLVEISTTLSEIQAKKLCNQNNVIDENQPIYRTGITHEGXXXXXXXXXXXXXXXXXXXXXXXXFDALPIHKFIRTNKGYREVLIDIDPSFVGNGDINEPKFRYVLSRHETPMQKKLIRPNENREHVEISPDSMMVYVEICERIKESGGLALICDYGNLRCATDSFRAFKKHKQVDPLVQPGSADLTADVDFSAI

SEQ ID NO: 36019 - protein, 301 aa, Diabrotica virgifera
  misc_feature: Coding regions on vcDNA: vcDNA=SeqID_15716; Strand=+; Position=1-901
  misc_feature: Homolog annotation: Hit_ID=XP_315426.1; Match level="QueryCoverage =100%, HitCoverage=57%, E-value=1e-103, Identity=63%"; Hit description=ENSANGP00000014217 [Anopheles gambiae]
  misc_feature: Gene Ontology Annotation: Molecular function=ferredoxin-NADP reductase activity; Cellular component=mitochondrion; Biological process=electron transport
  misc_feature: Pfam annotation: Pfam_ID=Pyr_redox; Match level="Score=-69.4, E-value= 0.0087, Copies=1"; Pfam description=Pyridine nucleotide-disulphide oxidor
  misc_feature (43)..(43): Xaa can be any naturally occurring amino acid
  misc_feature (222)..(229): Xaa can be any naturally occurring amino acid
IKPKICIVGAGTAGFYAAQHLLKKLNSPEIDIIEKLPVPFGLXFGVAPDHPEVKNVINTFTKVAESPNVKFLGNLSLGSDVTLDQLRNAYHVVLLTYGADESRKLNIPGESLKNVIEARKIVGWYNGTPWDKNLDIDLSGETATIFGQGNVAIDVARILLSPVDDLKKTDITEYALESLSRSKIKTVYLVGRRGPLQAAFTIKELREMLKLPNCSTMWRSNXXXXXXXXLSNLSRPKKRITELMLKSVSENTIESDKTFRPIFHRSPLELTGSGRVDKVILGNHKLDGSDILTQTAVPTDQ

SEQ ID NO: 36020 - protein, 18 aa, Diabrotica virgifera
  misc_feature: Coding regions on vcDNA: vcDNA=SeqID_15717; Strand=-; Position=2-55
  misc_feature (2)..(2): Xaa can be any naturally occurring amino acid
  misc_feature (7)..(7): Xaa can be any naturally occurring amino acid
  misc_feature (9)..(18): Xaa can be any naturally occurring amino acid
HXQLKIXLXXXXXXXXXX

SEQ ID NO: 36021 - protein, 274 aa, Diabrotica virgifera
  misc_feature: Coding regions on vcDNA: vcDNA=SeqID_15718; Strand=+; Position=42-903
  misc_feature: Homolog annotation: Hit_ID=XP_395705.1; Match level="QueryCoverage =83%, HitCoverage=23%, E-value=1e-100, Identity=80%"; Hit description= similar to CG18497-PA [Apis mellifera]
  misc_feature: Gene Ontology Annotation: Molecular function=transcriptional activator activity; Cellular component=nucleus; Biological process =axon guidance
  misc_feature: Pfam annotation: Pfam_ID=RRM_1; Match level="Score=73.6, E-value=5.3e- 19, Copies=2"; Pfam description=RNA recognition motif. (a.k.a. RRM, R
SRPTVNNSWGYDSSRYNSTGNKETDRTLEQSSKKKTKSRSGSRSPSPSGSASSRSPSRSRSRSSSSSSSSSISRDTSSTSSPKSKRIASDDRRPLAICVKNLPVRSSDTSLKDGLFHEYKKHGKVTWVKVVGKDAERHAIVCFKKPEDVEKALEVSYDKLFFGCKIEVAPYQGYDVEDNDLRPYEAEIDEYHPKATRTLFIGNLEKDVTASDLRKHFDQFGEIIEIDIKKQGAVSSYAFCQYSDIVSVVKAIRKMDGEHLGNNRIKLGFGKSMP

SEQ ID NO: 36022 - protein, 220 aa, Diabrotica virgifera
  misc_feature: Coding regions on vcDNA: vcDNA=SeqID_15719; Strand=+; Position=1-663
  misc_feature (142)..(151): Xaa can be any naturally occurring amino acid
ILCYKMNKLPVFTLLFAIGFQSSAGFRAGFRYNRDVQVMVPAGPVTLEAQPAVQTLEAKLPAVQTLEARPLSVQTLEARPAIATLEARPEVSTLELRPEVSTLELSPEVSTPEHKLTVNDKLAMIKQWVEEQANKPISRLRXXXXXXXXXXWLDDRANKVRQSVVDLENKVLPAIQKLKADASHAIDTIKQKVKGQEAQAERTKRAMKQLNRQTRAIKKH

SEQ ID NO: 36023 - protein, 36 aa, Diabrotica virgifera
  misc_feature: Coding regions on vcDNA: vcDNA=SeqID_15720; Strand=-; Position=1-108
  misc_feature (1)..(35): Xaa can be any naturally occurring amino acid
XXXXXXXXXXXXXXXXXXXXXXXXXXXXXXXXXXXF

SEQ ID NO: 36024 - protein, 129 aa, Diabrotica virgifera
  misc_feature: Coding regions on vcDNA: vcDNA=SeqID_15721; Strand=+; Position=198-587
  misc_feature (13)..(22): Xaa can be any naturally occurring amino acid
  misc_feature (41)..(48): Xaa can be any naturally occurring amino acid
  misc_feature (57)..(112): Xaa can be any naturally occurring amino acid
  misc_feature (118)..(128): Xaa can be any naturally occurring amino acid
VSANYQLIIIHSXXXXXXXXXXPHFYRKINILNTLVCNDNXXXXXXXXNLLRNKLNXXXXXXXXXXXXXXXXXXXXXXXXXXXXXXXXXXXXXXXXXXXXXXXXXXXXXXXXIIFIFXXXXXXXXXXXI

SEQ ID NO: 36025 - protein, 89 aa, Diabrotica virgifera
  misc_feature: Coding regions on vcDNA: vcDNA=SeqID_15722; Strand=-; Position=161-430
  misc_feature (6)..(14): Xaa can be any naturally occurring amino acid
CSFCEXXXXXXXXXFTHFLPRSNRQISEIYTLLHVVKLPCLRVFIYLTISSILRIDFFSGPPSNFPVLRDNIYGRGTSAGYQVSPHMII

SEQ ID NO: 36026 - protein, 83 aa, Diabrotica virgifera
  misc_feature: Coding regions on vcDNA: vcDNA=SeqID_15723; Strand=+; Position=1-252
  misc_feature (1)..(11): Xaa can be any naturally occurring amino acid
XXXXXXXXXXXFSLLWRYSPSRALASPSICLQVSLSLAALLQLFTLNIPLASKNTRFVVKGMIHVSTPYVAIGGMVLVILSML

SEQ ID NO: 36027 - protein, 298 aa, Diabrotica virgifera
  misc_feature: Coding regions on vcDNA: vcDNA=SeqID_15724; Strand=-; Position=1-894
  misc_feature (8)..(31): Xaa can be any naturally occurring amino acid
  misc_feature (33)..(295): Xaa can be any naturally occurring amino acid
AVIPKVIXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAK

SEQ ID NO: 36028 - protein, 289 aa, Diabrotica virgifera
  misc_feature: Coding regions on vcDNA: vcDNA=SeqID_15725; Strand=+; Position=2-871
  misc_feature (253)..(253): Xaa can be any naturally occurring amino acid
KIQQVAANIKNTAENTTNALENLENSIPDPGIIQEKSKDITTLLKSTIEDTNKAFDNIKELLPEFVKIQNKTSSIGDMLKNNESSSDEHPKNTTNRYIDLDFQRTSQEMVETITNATENCNKVLTDIQKVMPDLIRVLEKSTQMVDNLSEATKKSNEIIAKLENTSAKSTEISNKILAGLEEKGRNIINTAVPGASHNKTDAVTKPEEPKPLFPANDPFNFKKNAEEAQKAFKEKGLGGWIATVQKNVQETLXALIKGGEGKKLVEALSSGLRINKNVQEKDCLQSRSK

SEQ ID NO: 36029 - protein, 147 aa, Diabrotica virgifera
  misc_feature: Coding regions on vcDNA: vcDNA=SeqID_15726; Strand=+; Position=3-446
  misc_feature: Homolog annotation: Hit_ID=NP_476739.1; Match level="QueryCoverage =100%, HitCoverage=6%, E-value=5e-71, Identity=87%"; Hit description =CG1977-PA [Drosophila melanogaster] gb|AAF47569.1| CG1977-PA [Drosophila melanogaster]
  misc_feature: Gene Ontology Annotation: Molecular function=actin binding; Cellular component=plasma membrane; Biological process=neuromuscular synaptic transmission
  misc_feature: Pfam annotation: Pfam_ID=efhand; Match level="Score=58.9, E-value =1.5e-14, Copies=2"; Pfam description=EF hand
EFSMMFKHFDKEKSGKLNHQEFKSCLRALGYDLPMVEEGQPDPEFDAILDVVDPNRDGHVSLQEYMAFMISKETENVQSSEEIEKAFRAITAGDRPYVTKEELYANLTKEMADYCVARMKPYVEPKTERPIQGALDYIEFTRTLFQN

SEQ ID NO: 36030 - protein, 59 aa, Diabrotica virgifera
  misc_feature: Coding regions on vcDNA: vcDNA=SeqID_15727; Strand=-; Position=1-177
  misc_feature (8)..(8): Xaa can be any naturally occurring amino acid
  misc_feature (16)..(23): Xaa can be any naturally occurring amino acid
  misc_feature (26)..(33): Xaa can be any naturally occurring amino acid
  misc_feature (45)..(57): Xaa can be any naturally occurring amino acid
NKLKIETXPGFHRLKXXXXXXXXSNXXXXXXXXPIINLIQHRGRXXXXXXXXXXXXXLL

SEQ ID NO: 36031 - protein, 32 aa, Diabrotica virgifera
  misc_feature: Coding regions on vcDNA: vcDNA=SeqID_15728; Strand=-; Position=1-96
  misc_feature (3)..(32): Xaa can be any naturally occurring amino acid
PPXXXXXXXXXXXXXXXXXXXXXXXXXXXXXX

SEQ ID NO: 36032 - protein, 79 aa, Diabrotica virgifera
  misc_feature: Coding regions on vcDNA: vcDNA=SeqID_15729; Strand=-; Position=289-528
  misc_feature (25)..(30): Xaa can be any naturally occurring amino acid
LQGGLLIKELFWQSRVCFISDTYRXXXXXXFYAGAKFISRCMRFEGLGGQEGSSVNGMCGSSCVLFLQIILLCFNYFWI

SEQ ID NO: 36033 - protein, 110 aa, Diabrotica virgifera
  misc_feature: Coding regions on vcDNA: vcDNA=SeqID_15730; Strand=+; Position=627-959
  misc_feature (82)..(89): Xaa can be any naturally occurring amino acid
SVYIINIRHMTEYSIFSEKDPRRTKPTYSDLQTISIPIGNPRLKGKKETFGGSKKKPKKLWVPIHPKQEALFVLDPNYPAEXXXXXXXXFLALKLTLCGVKNFGFREKNN

SEQ ID NO: 36034 - protein, 46 aa, Diabrotica virgifera
  misc_feature: Coding regions on vcDNA: vcDNA=SeqID_15731; Strand=-; Position=1-138
  misc_feature (3)..(10): Xaa can be any naturally occurring amino acid
  misc_feature (13)..(26): Xaa can be any naturally occurring amino acid
  misc_feature (32)..(44): Xaa can be any naturally occurring amino acid
LNXXXXXXXXSNXXXXXXXXXXXXXXHDRGRXXXXXXXXXXXXXLL

SEQ ID NO: 36035 - protein, 217 aa, Diabrotica virgifera
  misc_feature: Coding regions on vcDNA: vcDNA=SeqID_15732; Strand=+; Position=214-864
  misc_feature: Homolog annotation: Hit_ID=XP_321277.1; Match level="QueryCoverage =95%, HitCoverage=28%, E-value=2e-36, Identity=39%"; Hit description =ENSANGP00000008439 [Anopheles gambiae]
  misc_feature: Gene Ontology Annotation: Cellular component=endoplasmic reticulum
  misc_feature (113)..(135): Xaa can be any naturally occurring amino acid
  misc_feature (192)..(192): Xaa can be any naturally occurring amino acid
MTSGVKQTVIKNPTWWKRRTSMERCLTLSTGIALLIGISLLIALATVLYSRDQHISNKPYTAQPLQGKIVTITSQDHEDEKVCLSPGCIHTASRVLEYMDESVDPCDDFYQFXXXXXXXXXXXXXXXXXXXXXXXIGDELQEQLRTMIEEPIQEDEPKPFKLTKKLYKACMNKTLIEEDGMTTITEVLKGVXVGGLVLEGDSRNEDDSDWKNSVYKF

SEQ ID NO: 36036 - protein, 319 aa, Diabrotica virgifera
  misc_feature: Coding regions on vcDNA: vcDNA=SeqID_15733; Strand=+; Position=3-962
  misc_feature (27)..(225): Xaa can be any naturally occurring amino acid
  misc_feature (229)..(275): Xaa can be any naturally occurring amino acid
  misc_feature (282)..(310): Xaa can be any naturally occurring amino acid
RCVSFFKGVVPTLNELIICLQRRMQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNSXXXXXXXXXXXXXXXXXXXXXXXXXXXXXXXXXXXXXXXXXXXXXXXPGMTGLXXXXXXXXXXXXXXXXXXXXXXXXXXXXXTKKTPTRGF

SEQ ID NO: 36037 - protein, 216 aa, Diabrotica virgifera
  misc_feature: Coding regions on vcDNA: vcDNA=SeqID_15734; Strand=+; Position=251-898
  misc_feature: Homolog annotation: Hit_ID=XP_319886.1; Match level="QueryCoverage =99%, HitCoverage=52%, E-value=3e-52, Identity=46%"; Hit description =ENSANGP00000010634 [Anopheles gambiae]
  misc_feature: Gene Ontology Annotation: Molecular function=lipid transporter activity; Cellular component=mitochondrial inner membrane; Biological process=transport
  misc_feature: Pfam annotation: Pfam_ID=Mito_carr; Match level="Score=134.6, E-value= 2.4e-37, Copies=2"; Pfam description=Mitochondrial carrier protein
  misc_feature (132)..(137): Xaa can be any naturally occurring amino acid
  misc_feature (179)..(179): Xaa can be any naturally occurring amino acid
MSLDFIAGCVGGVAGVFVGHPLDTVKVNLQTQCTVNPQYRGTVHCIKSLMAKEGIKGIYRGVTSPAMGVATLNAVVFGVYANVQKYSTNPESLSSHAVAGAAAGFFTSDISSPMELVKSRMHVAGAQAGKSXXXXXXRIYKQRKLLGVFQGYGITVIRDVPAFTTYFVSYEYLARTEEXQVPSSSTILFAVGMTGVISCIIPYPLHVLNAKIQVDT

SEQ ID NO: 36038 - protein, 64 aa, Diabrotica virgifera
  misc_feature: Coding regions on vcDNA: vcDNA=SeqID_15735; Strand=-; Position=169-363
YIYIHNRTYILLAVLASIPFGWRRPSFRPCRVHRNGFAVTSPFLDQDSEENVNSTSFQLFNCFP

SEQ ID NO: 36039 - protein, 57 aa, Diabrotica virgifera; identical to SEQ ID NO: 32497
  misc_feature: Coding regions on vcDNA: vcDNA=SeqID_15736; Strand=-; Position=159-332
  misc_feature (1)..(12): Xaa can be any naturally occurring amino acid
  misc_feature (14)..(38): Xaa can be any naturally occurring amino acid

SEQ ID NO: 36040 - protein, 115 aa, Diabrotica virgifera
  misc_feature: Coding regions on vcDNA: vcDNA=SeqID_15737; Strand=-; Position=1-345
  misc_feature (9)..(15): Xaa can be any naturally occurring amino acid
  misc_feature (42)..(114): Xaa can be any naturally occurring amino acid
KKKKARVPXXXXXXXPTLEGRQFFIIGFEPFPKKLPRYSLRXXXXXXXXXXXXXXXXXXXXXXXXXXXXXXXXXXXXXXXXXXXXXXXXXXXXXXXXXXXXXXXXXXXXXXXXXL

SEQ ID NO: 36041 - protein, 255 aa, Diabrotica virgifera
  misc_feature: Coding regions on vcDNA: vcDNA=SeqID_15738; Strand=-; Position=1-765
  misc_feature (1)..(255): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36042 - protein, 36 aa, Diabrotica virgifera
  misc_feature: Coding regions on vcDNA: vcDNA=SeqID_15739; Strand=-; Position=0-107
  misc_feature (2)..(35): Xaa can be any naturally occurring amino acid
PXXXXXXXXXXXXXXXXXXXXXXXXXXXXXXXXXXA

SEQ ID NO: 36043 - protein, 161 aa, Diabrotica virgifera
  misc_feature: Coding regions on vcDNA: vcDNA=SeqID_15740; Strand=+; Position=117-601
  misc_feature: Homolog annotation: Hit_ID=XP_391934.1; Match level="QueryCoverage =98%, HitCoverage=56%, E-value=1e-31, Identity=45%"; Hit description =similar to ENSANGP00000021554 [Apis mellifera]
  misc_feature: Gene Ontology Annotation: Molecular function=translation factor activity, nucleic acid binding; Cellular component=eukaryotic 48S initiation complex; Biological process=regulation of translational initiation
  misc_feature: Pfam annotation: Pfam_ID=RRM_1; Match level="Score=35.1, E-value=2.1e- 07, Copies=1"; Pfam description=RNA recognition motif. (a.k.a. RRM, RB
  misc_feature (33)..(37): Xaa can be any naturally occurring amino acid
  misc_feature (57)..(57): Xaa can be any naturally occurring amino acid
  misc_feature (133)..(144): Xaa can be any naturally occurring amino acid
MGDNKSFKCSTCNGEYCTTECPRKDTMLVGGEXXXXXEIPAVGGAAVGETDKQGSKXVPQNLRDKRAKKTGGSNVTKRAAKHHAIKIDNLSEKTTRTDLEDLIKQFGLIQKRYLAEDKQTGECKGFAYVHFKXXXXXXXXXXXXHGHSYNNHVLNVDWSIR

SEQ ID NO: 36044 - protein, 61 aa, Diabrotica virgifera
  misc_feature: Coding regions on vcDNA: vcDNA=SeqID_15741; Strand=+; Position=6-191
LFHGWIVRLMLRSYVEWTRNVRLSTQPISKLKYLGHVMRNKHEIWLAKFIFQGKLFRKRGP

SEQ ID NO: 36045 - protein, 122 aa, Diabrotica virgifera
  misc_feature: Coding regions on vcDNA: vcDNA=SeqID_15742; Strand=-; Position=1-366
  misc_feature (2)..(14): Xaa can be any naturally occurring amino acid
  misc_feature (27)..(33): Xaa can be any naturally occurring amino acid
  misc_feature (42)..(53): Xaa can be any naturally occurring amino acid
  misc_feature (57)..(63): Xaa can be any naturally occurring amino acid
  misc_feature (69)..(84): Xaa can be any naturally occurring amino acid
  misc_feature (87)..(94): Xaa can be any naturally occurring amino acid
  misc_feature (96)..(96): Xaa can be any naturally occurring amino acid
  misc_feature (106)..(122): Xaa can be any naturally occurring amino acid
GXXXXXXXXXXXXXKRGAPKSLPPLTXXXXXXXLISCTPPLXXXXXXXXXXXXPKGXXXXXXXGWVLLXXXXXXXXXXXXXXXXEMXXXXXXXXQXFIAASNKKLXXXXXXXXXXXXXXXXX

SEQ ID NO: 36046 - protein, 34 aa, Diabrotica virgifera; identical to SEQ ID NO: 27603
  misc_feature: Coding regions on vcDNA: vcDNA=SeqID_15743; Strand=-; Position=9-113

SEQ ID NO: 36047 - protein, 281 aa, Diabrotica virgifera
  misc_feature: Coding regions on vcDNA: vcDNA=SeqID_15744; Strand=+; Position=40-885
  misc_feature: Homolog annotation: Hit_ID=AAP78935.1; Match level="QueryCoverage =89%, HitCoverage=20%, E-value=3e-20, Identity=28%"; Hit description =At4g01860 [Arabidopsis thaliana] gb|AAL91237.1| unknown protein [Arabidopsis thaliana] ref|NP_849536.1| tr
  misc_feature: Gene Ontology Annotation: Molecular function=molecular_function unknown; Cellular component=cellular_component unknown; Biological process=biological_process unknown
  misc_feature: Pfam annotation: Pfam_ID=WD40; Match level="Score=52.4, E-value=1.3e -12, Copies=3"; Pfam description=WD domain, G-beta repeat
  misc_feature (275)..(275): Xaa can be any naturally occurring amino acid
MLQFQSQLIKTDVTAITRHEYVTLVGIGSSLHVFCNNTDKLINKINIEDTRGELIFGIKPFGHNKLLIFGGPFLLIFSADQQFTHIEEVHRVAHKDWILEAKFINNETQIATVSMQNKLQIWDTALNLLETFECQEKCILYSAHICYNDYDKLVILSGTVFNEVLLWKVRRNEYSKVPVLKRLKKHDGVIFCIHYNEDNGIICSTSDDRSAILWKVENTDLSLELNREHPNIFPICQVYGHLSRVFRCLVLKDCFITAGEDSLINIWKLDGNWLXKWKLTK

SEQ ID NO: 36048 - protein, 277 aa, Diabrotica virgifera
  misc_feature: Coding regions on vcDNA: vcDNA=SeqID_15745; Strand=+; Position=146-975
  misc_feature: Homolog annotation: Hit_ID=NP_651399.2; Match level="QueryCoverage =94%, HitCoverage=52%, E-value=2e-69, Identity=50%"; Hit description =CG5116-PA [Drosophila melanogaster] gb|AAF56472.2| CG5116-PA [Drosophila melanogaster]
  misc_feature: Gene Ontology Annotation: Molecular function=GTP binding
  misc_feature: Pfam annotation: Pfam_ID=MMR_HSR1; Match level="Score=15.3, E-value =1.3e-05, Copies=1"; Pfam description=GTPase of unknown function
  misc_feature (229)..(229): Xaa can be any naturally occurring amino acid
  misc_feature (243)..(243): Xaa can be any naturally occurring amino acid
  misc_feature (249)..(249): Xaa can be any naturally occurring amino acid
MSVKDIHNCVIIQPYVKWGPRKLSVTPEEQLEEAVALVKTLPSWKVVNTITVPLESLDSKSLFKSGNMDKLSKMVRKDPEISAVFVNTSNLKTVTSTILQENFRLPILDRYRIVMQILKIHATSKYAKLQVALAELYFIRRKAESNQVFVTHDRETLKLMFQNREQKLKKAIKGLRDQRKLLRSKRRKLDYPVVAVVGYTNAGKTCLIKALTGEDSLKPRNQLFATLDXTVHSGNLPSGLEVXYVDTVXFFVDIPTDLIECFIATLEDAIFSRFNSA

SEQ ID NO: 36049 - protein, 47 aa, Diabrotica virgifera
  misc_feature: Coding regions on vcDNA: vcDNA=SeqID_15746; Strand=+; Position=1-141
  misc_feature (2)..(12): Xaa can be any naturally occurring amino acid
  misc_feature (16)..(16): Xaa can be any naturally occurring amino acid
  misc_feature (19)..(42): Xaa can be any naturally occurring amino acid
LXXXXXXXXXXXLFIXIIXXXXXXXXXXXXXXXXXXXXXXXXIHFFL

SEQ ID NO: 36050 - protein, 119 aa, Diabrotica virgifera
  misc_feature: Coding regions on vcDNA: vcDNA=SeqID_15747; Strand=+; Position=2-361
  misc_feature (18)..(32): Xaa can be any naturally occurring amino acid
  misc_feature (34)..(40): Xaa can be any naturally occurring amino acid
  misc_feature (62)..(69): Xaa can be any naturally occurring amino acid
  misc_feature (100)..(107): Xaa can be any naturally occurring amino acid
VIYFKTLEYFLPQAKTNXXXXXXXXXXXXXXXLXXXXXXXLHPVYLGLLLNTYIFIIVQYQXXXXXXXXLDNKYYQSCFCNEPVIRVSDISKFSKNTLNXXXXXXXXPPNAYIINIEHY

SEQ ID NO: 36051 - protein, 38 aa, Diabrotica virgifera
  misc_feature: Coding regions on vcDNA: vcDNA=SeqID_15748; Strand=+; Position=1-114
  misc_feature (9)..(36): Xaa can be any naturally occurring amino acid
VTKLTFFYXXXXXXXXXXXXXXXXXXXXXXXXXXXXSP

SEQ ID NO: 36052 - protein, 85 aa, Diabrotica virgifera
  misc_feature: Coding regions on vcDNA: vcDNA=SeqID_15749; Strand=+; Position=66-323
  misc_feature (18)..(26): Xaa can be any naturally occurring amino acid
RYFKFLCNYFIAKRKLKXXXXXXXXXWLPGSFLWFLQFQKWRKLWRMMMLQQHQRMAGMRRPEEYLITEDLISHLHKAYIIIETI

SEQ ID NO: 36053 - protein, 57 aa, Diabrotica virgifera
  misc_feature: Coding regions on vcDNA: vcDNA=SeqID_15750; Strand=+; Position=101-274
  misc_feature (36)..(36): Xaa can be any naturally occurring amino acid
KESTIIWIPEQELKMVHIIMRQSAKTPEITYPNDPXQNDSLYPIGWGHVTREGMYSE

SEQ ID NO: 36054 - protein, 138 aa, Diabrotica virgifera
  misc_feature: Coding regions on vcDNA: vcDNA=SeqID_15751; Strand=+; Position=204-620
  misc_feature (109)..(114): Xaa can be any naturally occurring amino acid
CPTWGIYIALTFGAKCMTKVYILLQSFFFFLLLFISNSACSLIDTYKRLSLHLLRNRPILFLPIGNLSFAILITRFSPILLMCSFRSFFLFSVHCTLHFLLKMSSLLFXXXXXXAVIILSTPISSVSRSHYIGLPLAL

SEQ ID NO: 36055 - protein, 37 aa, Diabrotica virgifera; identical to SEQ ID NO: 28764
  misc_feature: Coding regions on vcDNA: vcDNA=SeqID_15752; Strand=-; Position=1-111
  misc_feature (1)..(37): Xaa can be any naturally occurring amino acid

SEQ ID NO: 36056 - protein, 289 aa, Diabrotica virgifera
  misc_feature: Coding regions on vcDNA: vcDNA=SeqID_15753; Strand=-; Position=1-867
  misc_feature (2)..(286): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELV

SEQ ID NO: 36057 - protein, 74 aa, Diabrotica virgifera
  misc_feature: Coding regions on vcDNA: vcDNA=SeqID_15754; Strand=-; Position=479-703
  misc_feature (27)..(33): Xaa can be any naturally occurring amino acid
YKVYRKFMNQNYTTSHRKILVNRENTXXXXXXXALYIISETSLMFFLDWKVFLFHNLPLLMLNPNNPLLFYCGC

SEQ ID NO: 36058 - protein, 195 aa, Diabrotica virgifera
  misc_feature: Coding regions on vcDNA: vcDNA=SeqID_15755; Strand=+; Position=28-615
  misc_feature: Homolog annotation: Hit_ID=NP_524351.1; Match level="QueryCoverage =100%, HitCoverage=100%, E-value=1e-65, Identity=62%"; Hit description=CG3351-PA [Drosophila melanogaster] gb|AAF55063.1| CG3351-PA [Drosophila melanogaster]
  misc_feature: Gene Ontology Annotation: Molecular function=RNA binding; Cellular component=mitochondrial large ribosomal subunit; Biological process =protein biosynthesis
  misc_feature: Pfam annotation: Pfam_ID=Ribosomal_L11_N; Match level="Score=87.2, E -value=4.2e-23, Copies=1"; Pfam description=Ribosomal protein L11, N -terminal dom
  misc_feature (25)..(31): Xaa can be any naturally occurring amino acid
MSKAAARLKSLKKVTEKIQHGKISXXXXXXXATAGPPLGPMLGQRGINIAAFCKDFNEKTKDIKEGIPLPTRITVNPDRSYELQINRPPVVYFLKQAAGIQRAAMEPGKEIAGRVTLKQVYEIAKIKQSDPYLEIRPLIDICNMIVGIAKSCGIEVVRNLDATEYGEFLKERKLIEEQQKKELQEKKEAKMLRTG

SEQ ID NO: 36059 - protein, 270 aa, Diabrotica virgifera
  misc_feature: Coding regions on vcDNA: vcDNA=SeqID_15756; Strand=+; Position=77-886
  misc_feature: Homolog annotation: Hit_ID=NP_609946.1; Match level="QueryCoverage =95%, HitCoverage=29%, E-value=4e-91, Identity=62%"; Hit description =CG10689-PA [Drosophila melanogaster] gb|AAF53766.1| CG10689-PA [Drosophila melanogaster]
  misc_feature: Gene Ontology Annotation: Biological process=cell cycle
  misc_feature (243)..(243): Xaa can be any naturally occurring amino acid
MDRPSTSKRNVFDSDSDSVDSTEEARRRDLKERDEFANRLKKRDEERTRNVASTSDKRAYEEAAKRLKLDNAEKEKLIPALRVASRRKYLEKRKEDKLQELEADIADDEYLFEEDVLTEREKKDRVHKKELLKLAQEHEKARELERVQRYHMPRDLGKDSTADYIEVDDLEKVPQSEQKKWEKDQMASAVFKFGAKDGIKKEEYELVLEDQIQFIQALQMPGVSDKKEPELTETEKKKLTIEXTKKSLPIYPFKDDLIQAIREHQVLIIE

SEQ ID NO: 36060 - protein, 112 aa, Diabrotica virgifera
  misc_feature: Coding regions on vcDNA: vcDNA=SeqID_15757; Strand=-; Position=1-336
  misc_feature (1)..(112): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36061 - protein, 324 aa, Diabrotica virgifera
  misc_feature: Coding regions on vcDNA: vcDNA=SeqID_15758; Strand=+; Position=2-972
  misc_feature: Homolog annotation: Hit_ID=XP_317878.1; Match level="QueryCoverage =99%, HitCoverage=24%, E-value=3e-63, Identity=39%"; Hit description =ENSANGP00000012139 [Anopheles gambiae]
  misc_feature: Gene Ontology Annotation: Molecular function=ATP-binding cassette (ABC) transporter activity; Cellular component=membrane; Biological process=transport
  misc_feature (29)..(35): Xaa can be any naturally occurring amino acid
  misc_feature (237)..(244): Xaa can be any naturally occurring amino acid
  misc_feature (277)..(277): Xaa can be any naturally occurring amino acid
  misc_feature (298)..(298): Xaa can be any naturally occurring amino acid
  misc_feature (301)..(301): Xaa can be any naturally occurring amino acid
ANKKAKELEAKMKDAKGYREKQLKEAETXXXXXXXKAEKSRNEWKKREQDYETLNLEISELRTGLDTVKDQIEVCKQTIAELQGQYDEMVGGVSELKQAVKALQAEVKQIHAKITENNKDIQKKDKEKEKLLQSNNDIELKIKEWTHELGKLEQNCKIAKEREKEFSKKIDRNNPNLPKAEKMSKKEGHELDSRIKSYDSKKQKLGRVVNTKAQIMFEQEEKQYNELRKREKIVVQXXXXXXXXIQEMDTQKKNSLKLAYDQVSKDFGSIFSTLLPXANARLVPPPRKTILEGLEVKXSLXGVWKDSLTELSGDQRSLLRISLI

SEQ ID NO: 36062 - protein, 270 aa, Diabrotica virgifera
  misc_feature: Coding regions on vcDNA: vcDNA=SeqID_15759; Strand=+; Position=1-813
  misc_feature: Homolog annotation: Hit_ID=CAD61105.1; Match level="QueryCoverage =72%, HitCoverage=62%, E-value=3e-12, Identity=27%"; Hit description =SI:dZ69G10.3 (novel protein similar to human transmembrane protease, serine 3 (TMPRSS3)) [Danio rerio]
  misc_feature: Pfam annotation: Pfam_ID=Trypsin; Match level="Score=35.6, E-value =1.4e-07, Copies=1"; Pfam description=Trypsin
ILYLLVVLVLINFVVLATNNINNNLQQIDFGLEEEQDFPYQVSVHLNYNNQFVCGAVVIAEDQVLTLAHCLYYDWGGLLPPIIISVNSGGKMLNTEEYESFSVSDIRFHKEFNTSEMKYDLAVLDIPVKLMSKNSPIIPIGLQSDSMPSRYDNCIAIGWNNVSANQEVIDVILTDCNIETSTKMCAKHKAQNETLCNMVPGSLLVCSSTLVGIMSVVPECDSTNQISLFESAKHAKDLLISSAASVAVGFPSILIWIYSILTILINTFIR

SEQ ID NO: 36063 - protein, 158 aa, Diabrotica virgifera
  misc_feature: Coding regions on vcDNA: vcDNA=SeqID_15760; Strand=-; Position=0-473
  misc_feature (18)..(38): Xaa can be any naturally occurring amino acid
  misc_feature (46)..(63): Xaa can be any naturally occurring amino acid
  misc_feature (66)..(90): Xaa can be any naturally occurring amino acid
  misc_feature (92)..(107): Xaa can be any naturally occurring amino acid
  misc_feature (109)..(132): Xaa can be any naturally occurring amino acid
  misc_feature (135)..(152): Xaa can be any naturally occurring amino acid
PHPKKKFPLRLHPPPKRXXXXXXXXXXXXXXXXXXXXXEKHHKILXXXXXXXXXXXXXXXXXXPPXXXXXXXXXXXXXXXXXXXXXXXXXRXXXXXXXXXXXXXXXXFXXXXXXXXXXXXXXXXXXXXXXXXFLXXXXXXXXXXXXXXXXXXGYFFPG

SEQ ID NO: 36064 - protein, 337 aa, Diabrotica virgifera
  misc_feature: Coding regions on vcDNA: vcDNA=SeqID_15761; Strand=-; Position=1-1011
  misc_feature (2)..(28): Xaa can be any naturally occurring amino acid
  misc_feature (30)..(332): Xaa can be any naturally occurring amino acid
IXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDASGE

SEQ ID NO: 36065 - protein, 54 aa, Diabrotica virgifera
  misc_feature: Coding regions on vcDNA: vcDNA=SeqID_15762; Strand=+; Position=351-515
MVRRGTSGSLKNHLMTHTEENPLKCDLRVHTVEKPYKCETCLKQFSQAGHLKAH

SEQ ID NO: 36066 - protein, 53 aa, Diabrotica virgifera
  misc_feature: Coding regions on vcDNA: vcDNA=SeqID_15763; Strand=+; Position=353-511
RSIKTPTMVTTNIESFSTDGGLVIVAIEDQLVLTSRLLAHRMLNSAYRKLLSS

SEQ ID NO: 36067 - protein, 184 aa, Diabrotica virgifera
  misc_feature: Coding regions on vcDNA: vcDNA=SeqID_15764; Strand=-; Position=122-676
  misc_feature (29)..(72): Xaa can be any naturally occurring amino acid
  misc_feature (75)..(85): Xaa can be any naturally occurring amino acid
  misc_feature (95)..(102): Xaa can be any naturally occurring amino acid
  misc_feature (105)..(118): Xaa can be any naturally occurring amino acid
  misc_feature (124)..(137): Xaa can be any naturally occurring amino acid
  misc_feature (139)..(178): Xaa can be any naturally occurring amino acid
NAAPGIEFGGPFKKVLPSPPPVRNLGSFXXXXXXXXXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXLFNWGD

SEQ ID NO: 36068 - protein, 104 aa, Diabrotica virgifera
  misc_feature: Coding regions on vcDNA: vcDNA=SeqID_15765; Strand=+; Position=2-316
  misc_feature (6)..(11): Xaa can be any naturally occurring amino acid
TSSRYXXXXXXGHLFNKLLSPQELSLYLLKIFFFFFVLLINNSTCSLTDSYLYERLLLYLSGVSCLLSAPFSFLFSVHTFIHCTLHFLLLPSLLFPINICSFFC

SEQ ID NO: 36069 - protein, 211 aa, Diabrotica virgifera
  misc_feature: Coding regions on vcDNA: vcDNA=SeqID_15766; Strand=+; Position=20-655
  misc_feature: Homolog annotation: Hit_ID=XP_311545.1; Match level="QueryCoverage =94%, HitCoverage=91%, E-value=4e-43, Identity=45%"; Hit description =ENSANGP00000010247 [Anopheles gambiae]
  misc_feature: Gene Ontology Annotation: Molecular function=glutathione peroxidase activity; Cellular component=cellular_component unknown; Biological process=glutathione conjugation reaction
  misc_feature: Pfam annotation: Pfam_ID=GST_N; Match level="Score=82.3, E-value=1.3e- 21, Copies=1"; Pfam description=Glutathione S-transferase, N-terminal
MAPSYKVRYFNTPGRAETIRMILSYGQIPFEDDRVAREDWPKIKPTTPLGQLPILEVDGKPIPQSTAICRYLANVTNLAGKDAKENLAIDIAVETFEDMKKPMGEYMRERDESKKQEKLQKLKETNAFYLGKLEEYENKNGGYIALPRITVADIIFINIYENLVDGLGKDYMNPYPGLQKVKQNVLSQPGIRDWIKNRPKTDKKYDLKQDL

SEQ ID NO: 36070 - protein, 93 aa, Diabrotica virgifera
  misc_feature: Coding regions on vcDNA: vcDNA=SeqID_15767; Strand=+; Position=595-876
  misc_feature (62)..(69): Xaa can be any naturally occurring amino acid
TLMSLLVLLFDYNNFLCYRIFGSGIYYLNIYLFHIFTNNTNYLRNNTSYYIHFYTYIISINXXXXXXXXHLITSVIHHFITSVIICVLRINLI

SEQ ID NO: 36071 - protein, 46 aa, Diabrotica virgifera
  misc_feature: Coding regions on vcDNA: vcDNA=SeqID_15768; Strand=+; Position=144-284
  misc_feature (15)..(21): Xaa can be any naturally occurring amino acid
HQLILLKHEPFITLXXXXXXXLNLINNIFHFHKPLSSKKTNNLTLL

SEQ ID NO: 36072 - protein, 46 aa, Diabrotica virgifera
  misc_feature: Coding regions on vcDNA: vcDNA=SeqID_15769; Strand=+; Position=170-307
  misc_feature (29)..(35): Xaa can be any naturally occurring amino acid
IQPPGLTLYYQFNLPKKIPLFSLRYFILXXXXXXXPLKRTHFSEPG

SEQ ID NO: 36073 - protein, 29 aa, Diabrotica virgifera
  misc_feature: Coding regions on vcDNA: vcDNA=SeqID_15770; Strand=-; Position=1-87
  misc_feature (4)..(26): Xaa can be any naturally occurring amino acid
NNLXXXXXXXXXXXXXXXXXXXXXXXEKN

SEQ ID NO: 36074 - protein, 48 aa, Diabrotica virgifera
  misc_feature: Coding regions on vcDNA: vcDNA=SeqID_15771; Strand=+; Position=210-356
  misc_feature (12)..(19): Xaa can be any naturally occurring amino acid
  misc_feature (39)..(47): Xaa can be any naturally occurring amino acid
IYCIMGVVLKLXXXXXXXXFLYIHFIYVFPVMKVFKKFXXXXXXXXXF

SEQ ID NO: 36075 - protein, 55 aa, Diabrotica virgifera
  misc_feature: Coding regions on vcDNA: vcDNA=SeqID_15772; Strand=-; Position=3-167
  misc_feature (12)..(20): Xaa can be any naturally occurring amino acid
  misc_feature (22)..(35): Xaa can be any naturally occurring amino acid
  misc_feature (42)..(54): Xaa can be any naturally occurring amino acid
IETNPGSHRFKXXXXXXXXXEXXXXXXXXXXXXXXSNIEVAXXXXXXXXXXXXXC

SEQ ID NO: 36076 - protein, 121 aa, Diabrotica virgifera
  misc_feature: Coding regions on vcDNA: vcDNA=SeqID_15773; Strand=+; Position=178-543
  misc_feature (9)..(21): Xaa can be any naturally occurring amino acid
  misc_feature (36)..(51): Xaa can be any naturally occurring amino acid
  misc_feature (65)..(76): Xaa can be any naturally occurring amino acid
  misc_feature (91)..(102): Xaa can be any naturally occurring amino acid
  misc_feature (110)..(116): Xaa can be any naturally occurring amino acid
IFSGLSLNXXXXXXXXXXXXXRSKIFIFYNMLLYPXXXXXXXXXXXXXXXXDSSYINLVLMIILXXXXXXXXXXXXVQYRNSTTFFSPGYXXXXXXXXXXXXPCPLSNLXXXXXXXRAKLP

SEQ ID NO: 36077 - protein, 80 aa, Diabrotica virgifera
  misc_feature: Coding regions on vcDNA: vcDNA=SeqID_15774; Strand=+; Position=2-244
  misc_feature (46)..(52): Xaa can be any naturally occurring amino acid
KVLVILISIEKKKDFVEFLYEAALKTLKMVLKRTIISVIDRPMRGXXXXXXXKYLLYLPTCTQLWRQYLYRNMIKVPVSF

SEQ ID NO: 36078 - protein, 108 aa, Diabrotica virgifera; identical to SEQ ID NO: 27732
  misc_feature: Coding regions on vcDNA: vcDNA=SeqID_15775; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 36079 - protein, 36 aa, Diabrotica virgifera
  misc_feature: Coding regions on vcDNA: vcDNA=SeqID_15776; Strand=-; Position=1-108
  misc_feature (3)..(10): Xaa can be any naturally occurring amino acid
  misc_feature (13)..(13): Xaa can be any naturally occurring amino acid
  misc_feature (29)..(29): Xaa can be any naturally occurring amino acid
RPXXXXXXXXQLXTLIHHRGRNLYYRFDXSNKITLL

SEQ ID NO: 36080 - protein, 68 aa, Diabrotica virgifera
  misc_feature: Coding regions on vcDNA: vcDNA=SeqID_15777; Strand=-; Position=45-251
IRSPMGCIYFSYLSPLASFNPIIILMWCCTLLMFYTDFTRDRGSIHGSSYPSHCCCCTFWNSKSLSFH

SEQ ID NO: 36081 - protein, 22 aa, Diabrotica virgifera
  misc_feature: Coding regions on vcDNA: vcDNA=SeqID_15778; Strand=-; Position=0-65
  misc_feature (1)..(7): Xaa can be any naturally occurring amino acid
  misc_feature (10)..(21): Xaa can be any naturally occurring amino acid
XXXXXXXPPXXXXXXXXXXXXP

SEQ ID NO: 36082 - protein, 225 aa, Diabrotica virgifera
  misc_feature: Coding regions on vcDNA: vcDNA=SeqID_15779; Strand=+; Position=220-893
  misc_feature: Homolog annotation: Hit_ID=EAL29377.1; Match level="QueryCoverage =99%, HitCoverage=46%, E-value=5e-76, Identity=58%"; Hit description =GA10503-PA [Drosophila pseudoobscura]
  misc_feature: Gene Ontology Annotation: Molecular function=carboxy-lyase activity; Cellular component=cellular_component unknown; Biological process =catecholamine metabolism
  misc_feature: Pfam annotation: Pfam_ID=Pyridoxal_deC; Match level="Score=5.8, E -value=3.8e-15, Copies=1"; Pfam description=Pyridoxal-dependent decarboxylase con
  misc_feature (183)..(183): Xaa can be any naturally occurring amino acid
  misc_feature (200)..(200): Xaa can be any naturally occurring amino acid
  misc_feature (205)..(205): Xaa can be any naturally occurring amino acid
LINMDVTEFREFGKAAVDYIADYIETIRERPVLPSVQPGYLGELLPKEAPQTGEHWQDVLQDVDRIIMPGLTHWHSPRFHAFYPTANSFPAVVGEMLSAGFGCVGLSWIASPAYTELEVVMMNWLGKLIDLPEEFLNCSEGPGGGIIQGSASEVTFIGLLAAKEKKVKDLMEKNPNLKEADIXGKLIAYTSDQSNSSVEXSGLLXSMPMRLIPSNERGQLTATAL

SEQ ID NO: 36083 - protein, 166 aa, Diabrotica virgifera
  misc_feature: Coding regions on vcDNA: vcDNA=SeqID_15780; Strand=+; Position=2-502
  misc_feature: Homolog annotation: Hit_ID=AAW31756.1; Match level="QueryCoverage =100%, HitCoverage=34%, E-value=2e-32, Identity=39%"; Hit description= KCR1 [Homo sapiens]
  misc_feature: Gene Ontology Annotation: Molecular function=dolichyl-phosphate -glucose-glycolipid alpha-glucosyltransferase activity; Cellular component=membrane; Biological process=protein modification
EVSSFLAFARKHKIGVFVLTLLGFLIVMLNTQVHPYLLADNRHYLFYIWNRFYQKYVLFKYAIVPVYIFAWYVIIKLLYDKDDITFLFLYLVCTTIVLVTQKLIEIRYFLIPYILFRLRLKSNANNAFNLVLEFVTYLLINYITLQLFFTKVVTWDDYSEFQRIIW

SEQ ID NO: 36084 - protein, 106 aa, Diabrotica virgifera
  misc_feature: Coding regions on vcDNA: vcDNA=SeqID_15781; Strand=+; Position=3-323
KWLISFIKMYKYLLFVSLIGLSTCFPGIIDSGHGLSSWNGGGADWQKALASVGIGASLGHSPGLDDGHGQGSPDGSIGGDFHHGVSVVSTGGGNKGAVFDLTNQGT

SEQ ID NO: 36085 - protein, 249 aa, Diabrotica virgifera
  misc_feature: Coding regions on vcDNA: vcDNA=SeqID_15782; Strand=-; Position=57-799
  misc_feature: Homolog annotation: Hit_ID=AAC46945.1; Match level="QueryCoverage =76%, HitCoverage=59%, E-value=4e-47, Identity=50%"; Hit description =mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=16.4, E -value=9.3e-06, Copies=1"; Pfam description=Transposase
  misc_feature (24)..(24): Xaa can be any naturally occurring amino acid
  misc_feature (39)..(39): Xaa can be any naturally occurring amino acid
  misc_feature (66)..(66): Xaa can be any naturally occurring amino acid
  misc_feature (73)..(73): Xaa can be any naturally occurring amino acid
  misc_feature (84)..(84): Xaa can be any naturally occurring amino acid
  misc_feature (103)..(103): Xaa can be any naturally occurring amino acid
  misc_feature (182)..(182): Xaa can be any naturally occurring amino acid
  misc_feature (189)..(189): Xaa can be any naturally occurring amino acid
MLIILYRVPCLDLMKLNQSDFWRXLVTVDETWIHYYTHXEKRMNARQWTEAGKSAQNVMATLFWDXHLIDNLXKGKTIKSQYYXALLDKLKQELSKKRPHMKXKVLFLQGNGPTHKNVMTMAKIRELGFELLSRTAYSPDLDPSDYYVLPNQMTRKKIHLEIIEETNTYFAEFPESYSSDGXKKFENRXNRCNALKGDYTRKNYSLSIYCPTLISFDLSISVKVNIRYRARIDTHVLSKFHHYRLMPGD

SEQ ID NO: 36086 - protein, 96 aa, Diabrotica virgifera
  misc_feature: Coding regions on vcDNA: vcDNA=SeqID_15783; Strand=+; Position=2-292
  misc_feature: Homolog annotation: Hit_ID=XP_392465.1; Match level="QueryCoverage =86%, HitCoverage=9%, E-value=4e-17, Identity=66%"; Hit description =similar to Bmsqd-2 [Apis mellifera]
  misc_feature: Gene Ontology Annotation: Molecular function=heterogeneous nuclear ribonucleoprotein; Cellular component=nuclear speck; Biological process=RNA-nucleus export
GYGYDGYSQGYDYYGSGYGGYGGYDYSNYGGGGRGGYGNQGNWNQAYGGYGYGQGYGYDGYSQGYDYYGSGYGGYGGYDYSNYGGGNYGKYTHRTH

SEQ ID NO: 36087 - protein, 276 aa, Diabrotica virgifera
  misc_feature: Coding regions on vcDNA: vcDNA=SeqID_15784; Strand=+; Position=75-902
  misc_feature: Homolog annotation: Hit_ID=EAA11972.3; Match level="QueryCoverage =99%, HitCoverage=95%, E-value=1e-106, Identity=68%"; Hit description= ENSANGP00000014263 [Anopheles gambiae str. PEST] ref|XP_556102.1| ENSANGP00000014263 [Anopheles gambiae s
  misc_feature: Gene Ontology Annotation: Molecular function=thiol-disulfide exchange intermediate activity; Cellular component=cytoplasm; Biological process=signal transduction
  misc_feature: Pfam annotation: Pfam_ID=DUF1000; Match level="Score=229.3, E-value =7.1e-66, Copies=1"; Pfam description=Domain of Unknown Function (DUF1000)
  misc_feature (154)..(154): Xaa can be any naturally occurring amino acid
  misc_feature (249)..(249): Xaa can be any naturally occurring amino acid
MGSIRVITDETHFQTELTNAATRLVVVDFTATWCGPCQRIAPIFQQLAAKYPKAVFLKVDVDQCQETAAAQGVSAMPTFIFYRNRTKVDRLQGADPTGLENKIQQYYGSDDSEEGESVAGHMDLSPFITKAECECLNESDEHPFTHCLTSGGGXLQSDCDEQLIISIAFNQSVKIHSLKIKAPADKGPKTIRIFINQPRTLDFDLADSYTSVQDLQFTPEDVEGGNPVNLRYVKFQNVQNIQFFIKDNXLGGGEVTQIDHLAIIGSPISTTNMGDF

SEQ ID NO: 36088 - protein, 84 aa, Diabrotica virgifera
  misc_feature: Coding regions on vcDNA: vcDNA=SeqID_15785; Strand=+; Position=1-255
PQKNKINSLSFSMSDFLLTGLLILYYYDFASRNAVVAIRCSSVRNWSDRRRQCRCSLWFAVCSLQSLSESYLTGEKVMCWIQLY

SEQ ID NO: 36089 - protein, 75 aa, Diabrotica virgifera
  misc_feature: Coding regions on vcDNA: vcDNA=SeqID_15786; Strand=-; Position=1-225
  misc_feature (6)..(23): Xaa can be any naturally occurring amino acid
  misc_feature (34)..(52): Xaa can be any naturally occurring amino acid
  misc_feature (56)..(75): Xaa can be any naturally occurring amino acid
IKKVGXXXXXXXXXXXXXXXXXXGNKIIYDINNXXXXXXXXXXXXXXXXXXXVKKXXXXXXXXXXXXXXXXXXXX

SEQ ID NO: 36090 - protein, 246 aa, Diabrotica virgifera
  misc_feature: Coding regions on vcDNA: vcDNA=SeqID_15787; Strand=+; Position=135-872
  misc_feature: Homolog annotation: Hit_ID=XP_391821.1; Match level="QueryCoverage =76%, HitCoverage=11%, E-value=4e-42, Identity=45%"; Hit description =similar to RIKEN cDNA 2810426N06 [Apis mellifera]
  misc_feature: Pfam annotation: Pfam_ID=IPK; Match level="Score=-14.5, E-value=1.4e -07, Copies=1"; Pfam description=Inositol polyphosphate kinase
MGKSEVQSLPIHRPEPNLICVPAPCKILQNNCVNGLEKLDLGEELENVVEEEDKTVAIPEGYEIYKHQMAGHMDKGDNIGILKEDGMILKPVIKPENGEREITFYQNLSNTLDKTILELRNFVPKYYGTRCLAVNGKTYEFIVLEDLIRDFKEPCVMDIKIGRRTWDPTSTYEKICSEERKYQDCKRDLGFCIPGFQVYKLANSQLVKYDKEFGKGLNKDRAEDAIKTFLNMDGNRVCRSLIVQFL

SEQ ID NO: 36091 - protein, 96 aa, Diabrotica virgifera
  misc_feature: Coding regions on vcDNA: vcDNA=SeqID_15788; Strand=-; Position=1-288
  misc_feature: Homolog annotation: Hit_ID=NP_788855.1; Match level="QueryCoverage =80%, HitCoverage=9%, E-value=2e-22, Identity=59%"; Hit description =CG2930-PD, isoform D [Drosophila melanogaster] gb|AAN09112.2| CG2930- PD, isoform D [Drosophila
  misc_feature: Gene Ontology Annotation: Molecular function=proton-dependent oligopeptide transporter activity; Cellular component=integral to plasma membrane; Biological process=transport
MQKRQKRQLLKVLHKPFAAEIMFSITGLEFSYSQAPASMKSLLQACFLLTTAFGNLIIVIIESMEIFEKKSNDFFLYCGLMVADMLIFSFMAMRYK

SEQ ID NO: 36092 - protein, 214 aa, Diabrotica virgifera
  misc_feature: Coding regions on vcDNA: vcDNA=SeqID_15789; Strand=+; Position=102-743
  misc_feature: Homolog annotation: Hit_ID=XP_320050.1; Match level="QueryCoverage =95%, HitCoverage=35%, E-value=3e-67, Identity=57%"; Hit description =ENSANGP00000012255 [Anopheles gambiae]
  misc_feature: Gene Ontology Annotation: Cellular component=ubiquitin ligase complex; Biological process=regulation of transcription, DNA -dependent
  misc_feature: Pfam annotation: Pfam_ID=zf-CHY; Match level="Score=85.5, E-value =1.4e-22, Copies=1"; Pfam description=CHY zinc finger
  misc_feature (24)..(31): Xaa can be any naturally occurring amino acid
  misc_feature (99)..(121): Xaa can be any naturally occurring amino acid
MEGVSTPSAEGPPEETVKPVGCCXXXXXXXXVTPCCKKVYTCRFCHDENENHKLIRKEVTELICALCETKQRVQSSCQNCGVAFGKYICLECNLFDDEXXXXXXXXXXXXXXXXXXXXXXXCEKCNMCLPNQIESGHKCVENVSRSNCPICLDDIHTSRIACHIPPCGHLLHRPCFESLLSNGLYACPICQTSLMNMQPLWKYWDVENKGPVTI

SEQ ID NO: 36093 - protein, 47 aa, Diabrotica virgifera
  misc_feature: Coding regions on vcDNA: vcDNA=SeqID_15790; Strand=+; Position=2-145
  misc_feature (2)..(15): Xaa can be any naturally occurring amino acid
  misc_feature (17)..(24): Xaa can be any naturally occurring amino acid
IXXXXXXXXXXXXXXRXXXXXXXXDRNQPGSHRFKLRSCKILKVEQT

SEQ ID NO: 36094 - protein, 238 aa, Diabrotica virgifera
  misc_feature: Coding regions on vcDNA: vcDNA=SeqID_15791; Strand=-; Position=1-714
  misc_feature (1)..(8): Xaa can be any naturally occurring amino acid
  misc_feature (10)..(238): Xaa can be any naturally occurring amino acid
XXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36095 - protein, 29 aa, Diabrotica virgifera
  misc_feature: Coding regions on vcDNA: vcDNA=SeqID_15792; Strand=-; Position=1-87
  misc_feature (7)..(29): Xaa can be any naturally occurring amino acid
KNNIITXXXXXXXXXXXXXXXXXXXXXXX

SEQ ID NO: 36096 - protein, 276 aa, Diabrotica virgifera
  misc_feature: Coding regions on vcDNA: vcDNA=SeqID_15793; Strand=-; Position=3-830
  misc_feature: Homolog annotation: Hit_ID=AAF87760.1; Match level="QueryCoverage =100%, HitCoverage=62%, E-value=1e-116, Identity=78%"; Hit description=cytochrome oxidase subunit I [Diabrotica virgifera zeae]
  misc_feature: Pfam annotation: Pfam_ID=COX1; Match level="Score=26.8, E-value=3.9e -12, Copies=1"; Pfam description=Cytochrome C and Quinol oxidase polyp
  misc_feature (10)..(10): Xaa can be any naturally occurring amino acid
  misc_feature (52)..(52): Xaa can be any naturally occurring amino acid
  misc_feature (87)..(87): Xaa can be any naturally occurring amino acid
  misc_feature (104)..(104): Xaa can be any naturally occurring amino acid
  misc_feature (107)..(113): Xaa can be any naturally occurring amino acid
  misc_feature (160)..(160): Xaa can be any naturally occurring amino acid
  misc_feature (167)..(183): Xaa can be any naturally occurring amino acid
  misc_feature (214)..(214): Xaa can be any naturally occurring amino acid
  misc_feature (230)..(237): Xaa can be any naturally occurring amino acid
  misc_feature (258)..(258): Xaa can be any naturally occurring amino acid
FFGHPEVYIXILPGFGLISHIVRQERRKKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 36097 - protein, 75 aa, Diabrotica virgifera
  misc_feature: Coding regions on vcDNA: vcDNA=SeqID_15794; Strand=+; Position=3-230
GPSPRPRTFPGCDKFFRNIKQEFSSMISNEYCSRSLEPYYIRSHCVILVLRGILPCNDLFLIYVVSTSAIVPGFL

SEQ ID NO: 36098 - protein, 62 aa, Diabrotica virgifera
  misc_feature: Coding regions on vcDNA: vcDNA=SeqID_15795; Strand=+; Position=240-428
IRNVFSFHIKNISPLKKFKSNAYVSLKWHFFSVLSKNAFVIKYLQLYIRNDRNLSKDIFTYY

SEQ ID NO: 36099 - protein, 21 aa, Diabrotica virgifera
  misc_feature: Coding regions on vcDNA: vcDNA=SeqID_15796; Strand=-; Position=3-65
  misc_feature (6)..(6): Xaa can be any naturally occurring amino acid
  misc_feature (9)..(20): Xaa can be any naturally occurring amino acid
KLINNXINXXXXXXXXXXXXA

SEQ ID NO: 36100 - protein, 113 aa, Diabrotica virgifera
  misc_feature: Coding regions on vcDNA: vcDNA=SeqID_15797; Strand=-; Position=82-423
  misc_feature (25)..(31): Xaa can be any naturally occurring amino acid
  misc_feature (58)..(64): Xaa can be any naturally occurring amino acid
  misc_feature (93)..(99): Xaa can be any naturally occurring amino acid
EILVIPHMTFPTPKCHNFGVIATFXXXXXXXDFKKSIFSARVDITLGSLDHWEQKRSXXXXXXXQSSSNYKQFKTEKKTKNGRFSRFKNTSKXXXXXXXKVPKFKIRPSIRYL

SEQ ID NO: 36101 - protein, 85 aa, Diabrotica virgifera
  misc_feature: Coding regions on vcDNA: vcDNA=SeqID_15798; Strand=+; Position=670-922
  misc_feature: Homolog annotation: Hit_ID=XP_392535.1; Match level="QueryCoverage =100%, HitCoverage=21%, E-value=3e-35, Identity=87%"; Hit description= similar to ENSANGP00000004989 [Apis mellifera]
  misc_feature: Gene Ontology Annotation: Molecular function=enzyme inhibitor activity; Cellular component=plasma membrane; Biological process =signal transduction
  misc_feature (70)..(70): Xaa can be any naturally occurring amino acid
MDDGGKRQATRVFKKSSPNGKITVYLGKRDFVDHISCVDPIDGVVLIDPDYVKDRRVFGHVLAAFRYGRXEDLDVLGLTFRKDLY

SEQ ID NO: 36102 - protein, 60 aa, Diabrotica virgifera
  misc_feature: Coding regions on vcDNA: vcDNA=SeqID_15799; Strand=+; Position=265-447
IPSRQNEHQTIKLGFSARKNPHIVNLSQHSTLNRQFLTICNLVVKKNSRYFMTCGLPKRY

SEQ ID NO: 36103 - protein, 147 aa, Diabrotica virgifera
  misc_feature: Coding regions on vcDNA: vcDNA=SeqID_15800; Strand=-; Position=2-442
  misc_feature (3)..(3): Xaa can be any naturally occurring amino acid
  misc_feature (5)..(18): Xaa can be any naturally occurring amino acid
  misc_feature (21)..(147): Xaa can be any naturally occurring amino acid
LIXYXXXXXXXXXXXXXXLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36104 - protein, 283 aa, Diabrotica virgifera
  misc_feature: Coding regions on vcDNA: vcDNA=SeqID_15801; Strand=+; Position=43-893
  misc_feature: Homolog annotation: Hit_ID=NP_649847.1; Match level="QueryCoverage =100%, HitCoverage=48%, E-value=1e-106, Identity=68%"; Hit description=CG11964-PA [Drosophila melanogaster] gb|AAF54309.1| CG11964-PA [Drosophila melanogaster]
  misc_feature: Pfam annotation: Pfam_ID=Arm; Match level="Score=18.5, E-value=0.021, Copies=1"; Pfam description=Armadillo/beta-catenin-like repeat
  misc_feature (145)..(151): Xaa can be any naturally occurring amino acid
  misc_feature (259)..(260): Xaa can be any naturally occurring amino acid
  misc_feature (275)..(275): Xaa can be any naturally occurring amino acid
GEIIDETALKKIVLNFEKRSLKNREMRIKFPDSPEKFLESEVELHEILQEMRILATAPDYYPLLIKLQVIPSLLELLSHDNTDIAVATVELLQELTDVDSLNESEEGTEALIESLLDHQIIALLVQNLERLDETVKEEADGVHNXXXXXXXLTELSSEIINEATKQGLLAWLLKRLKLKTPFDPNKLYVCEILSILLQNNEKNRLALGDTDGIDTLLQQLAFYKRHDPTSSEEHELMENLFDCLCSALMVFPNRERFLXXEGLQLMNLMLREKKXSRNGSLKV

SEQ ID NO: 36105 - protein, 21 aa, Diabrotica virgifera
  misc_feature: Coding regions on vcDNA: vcDNA=SeqID_15802; Strand=-; Position=0-62
  misc_feature (1)..(20): Xaa can be any naturally occurring amino acid
XXXXXXXXXXXXXXXXXXXXS

SEQ ID NO: 36106 - protein, 28 aa, Diabrotica virgifera
  misc_feature: Coding regions on vcDNA: vcDNA=SeqID_15803; Strand=-; Position=1-84
  misc_feature (2)..(2): Xaa can be any naturally occurring amino acid
  misc_feature (4)..(27): Xaa can be any naturally occurring amino acid
NXIXXXXXXXXXXXXXXXXXXXXXXXXF

SEQ ID NO: 36107 - protein, 73 aa, Diabrotica virgifera
  misc_feature: Coding regions on vcDNA: vcDNA=SeqID_15804; Strand=+; Position=102-323
DDCRLLMQVTLFYTIHIFPILKFTMAYPLSLLISQPSDKEGADPRSSTSSDTRQNIYKFSILYSDHYTGVLFI

SEQ ID NO: 36108 - protein, 298 aa, Diabrotica virgifera
  misc_feature: Coding regions on vcDNA: vcDNA=SeqID_15805; Strand=+; Position=3-896
  misc_feature: Homolog annotation: Hit_ID=AAH88030.1; Match level="QueryCoverage =99%, HitCoverage=67%, E-value=7e-72, Identity=46%"; Hit description =Unknown (protein for MGC:108285) [Xenopus tropicalis]
  misc_feature: Gene Ontology Annotation: Molecular function=tRNA isopentenyltransferase activity; Cellular component=mitochondrion; Biological process=tRNA modification
  misc_feature: Pfam annotation: Pfam_ID=IPPT; Match level="Score=124.7, E-value=2.2e- 34, Copies=1"; Pfam description=IPP transferase
  misc_feature (253)..(263): Xaa can be any naturally occurring amino acid
  misc_feature (268)..(268): Xaa can be any naturally occurring amino acid
  misc_feature (288)..(288): Xaa can be any naturally occurring amino acid
RPLVIILGATGSGKTKLSLELAKKFCGEIIGADSMQVYKGLDIITAKATKEEQSVAPHHLIDILDPQEMYTVVQYRNRALSVIDSLFNNNKLPVVVGGTNYYIESLLWKILIDDGDFQKVGSQLSNNDHELSSEELHKKLKLLDPLMAKRLHPNHKRKILRSLEILHKKGKKHSELLEEQQSAKDSSKSGGGLRFTNSLVLWLQCDQEVLDQRLNDRVDGMLKQGLLTELLEFHKVYNQQRLLTNDTPDYSKXXXXXXXXXXXHPYLXLSKEEQESDEGKKKLNEGIXQLKMVTRRYA

SEQ ID NO: 36109 - protein, 47 aa, Diabrotica virgifera
  misc_feature: Coding regions on vcDNA: vcDNA=SeqID_15806; Strand=-; Position=159-302
  misc_feature (1)..(28): Xaa can be any naturally occurring amino acid
XXXXXXXXXXXXXXXXXXXXXXXXXXXXIRINYLRDNSVILLESSNR

SEQ ID NO: 36110 - protein, 19 aa, Diabrotica virgifera
  misc_feature: Coding regions on vcDNA: vcDNA=SeqID_15807; Strand=-; Position=0-56
  misc_feature (4)..(17): Xaa can be any naturally occurring amino acid
KKLXXXXXXXXXXXXXXSP

SEQ ID NO: 36111 - protein, 22 aa, Diabrotica virgifera
  misc_feature: Coding regions on vcDNA: vcDNA=SeqID_15808; Strand=-; Position=1-66
  misc_feature (1)..(22): Xaa can be any naturally occurring amino acid
XXXXXXXXXXXXXXXXXXXXXX

SEQ ID NO: 36112 - protein, 153 aa, Diabrotica virgifera
  misc_feature: Coding regions on vcDNA: vcDNA=SeqID_15809; Strand=+; Position=57-518
  misc_feature: Homolog annotation: Hit_ID=NP_523795.2; Match level="QueryCoverage =99%, HitCoverage=34%, E-value=1e-30, Identity=46%"; Hit description =CG9277-PB, isoform B [Drosophila melanogaster] gb|AAF57555.1| CG9277- PB, isoform B [Drosophila
  misc_feature: Gene Ontology Annotation: Molecular function=structural constituent of cytoskeleton; Cellular component=tubulin; Biological process =microtubule-based process
  misc_feature (4)..(4): Xaa can be any naturally occurring amino acid
  misc_feature (6)..(8): Xaa can be any naturally occurring amino acid
  misc_feature (11)..(11): Xaa can be any naturally occurring amino acid
  misc_feature (14)..(15): Xaa can be any naturally occurring amino acid
  misc_feature (18)..(18): Xaa can be any naturally occurring amino acid
  misc_feature (23)..(25): Xaa can be any naturally occurring amino acid
  misc_feature (28)..(28): Xaa can be any naturally occurring amino acid
  misc_feature (30)..(33): Xaa can be any naturally occurring amino acid
  misc_feature (35)..(37): Xaa can be any naturally occurring amino acid
  misc_feature (39)..(44): Xaa can be any naturally occurring amino acid
  misc_feature (47)..(47): Xaa can be any naturally occurring amino acid
  misc_feature (49)..(51): Xaa can be any naturally occurring amino acid
  misc_feature (54)..(56): Xaa can be any naturally occurring amino acid
  misc_feature (59)..(59): Xaa can be any naturally occurring amino acid
  misc_feature (61)..(67): Xaa can be any naturally occurring amino acid
  misc_feature (70)..(70): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (80)..(81): Xaa can be any naturally occurring amino acid
  misc_feature (83)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (94)..(95): Xaa can be any naturally occurring amino acid
  misc_feature (97)..(97): Xaa can be any naturally occurring amino acid
  misc_feature (99)..(100): Xaa can be any naturally occurring amino acid
  misc_feature (102)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (124)..(124): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(139): Xaa can be any naturally occurring amino acid
  misc_feature (143)..(143): Xaa can be any naturally occurring amino acid
  misc_feature (145)..(145): Xaa can be any naturally occurring amino acid
  misc_feature (149)..(151): Xaa can be any naturally occurring amino acid
MREXVXXXVGXWGXXIGXKFWEXXXDEXGXXXXGXXXGXXXXXXERXNXXXNEXXXGKXVXXXXXXXLEXGXMDXVRXGXXGXXXRXEXXVFGXXGXGXXWXKGXXXEGGELVDXVLDVVRKEXEXCDCLXGXXXXXXXGGGXGXGMGXXXIY

SEQ ID NO: 36113 - protein, 270 aa, Diabrotica virgifera
  misc_feature: Coding regions on vcDNA: vcDNA=SeqID_15810; Strand=+; Position=75-884
  misc_feature: Homolog annotation: Hit_ID=XP_311405.1; Match level="QueryCoverage =84%, HitCoverage=32%, E-value=2e-68, Identity=58%"; Hit description =ENSANGP00000016646 [Anopheles gambiae]
  misc_feature: Gene Ontology Annotation: Molecular function=tumor necrosis factor receptor binding; Cellular component=cellular_component unknown; Biological process=biological_process unknown
  misc_feature: Pfam annotation: Pfam_ID=HATPase_c; Match level="Score=41.7, E-value =2.2e-09, Copies=1"; Pfam description=Histidine kinase-, DNA gyrase B- , and
  misc_feature (107)..(116): Xaa can be any naturally occurring amino acid
  misc_feature (265)..(265): Xaa can be any naturally occurring amino acid
  misc_feature (270)..(270): Xaa can be any naturally occurring amino acid
MSLSRFSRLLAFRHLRLVTRNHNFTNINSGRISSCGNQNLRRLLSTQTSPNEDEHHSIIKDTEKPTGESTKYEFKAETKMLLDIVARSLYSEKEVFIRELISNASDXXXXXXXXXXSGDESAKKIQDVDRPLEIHISTDKQNRTITIQDTGIGMTKEDLISHLGIIAKSGSKAFIEQIKEKAAAGDNNIIGQFGVGFYSSFMVADKVDVYSRAVGEETGYKWSSDGSGTYEIQPAEGVQNGTKIVIHFEADCREFADDDTIKNVXHKYSX

SEQ ID NO: 36114 - protein, 95 aa, Diabrotica virgifera
  misc_feature: Coding regions on vcDNA: vcDNA=SeqID_15811; Strand=-; Position=2-286
  misc_feature (69)..(94): Xaa can be any naturally occurring amino acid
NVWLYKYRNIKPYQEKLLKYICFAGGFLCYDSSFEVAYYMLDIILKHIARWHARGTREYLFCLRRYYFXXXXXXXXXXXXXXXXXXXXXXXXXXR

SEQ ID NO: 36115 - protein, 195 aa, Diabrotica virgifera
  misc_feature: Coding regions on vcDNA: vcDNA=SeqID_15812; Strand=-; Position=1-585
  misc_feature (1)..(195): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36116 - protein, 51 aa, Diabrotica virgifera
  misc_feature: Coding regions on vcDNA: vcDNA=SeqID_15813; Strand=-; Position=123-278
HRAYSCWYSLTDLTHHRQYVSSGHIYYLGCVVELLYFLIIFLSTYIFVIFN

SEQ ID NO: 36117 - protein, 103 aa, Diabrotica virgifera
  misc_feature: Coding regions on vcDNA: vcDNA=SeqID_15814; Strand=+; Position=201-509
  misc_feature (63)..(69): Xaa can be any naturally occurring amino acid
SLTNLLKVVLRVKAFIIVGCCGESTFGYGDGEYSWSYSISSNYCIPFCGKSPECINNHLTCVXXXXXXXVTDDPRCEDSWKYAAALWCPHSIPIQCSREKISS

SEQ ID NO: 36118 - protein, 55 aa, Diabrotica virgifera
  misc_feature: Coding regions on vcDNA: vcDNA=SeqID_15815; Strand=-; Position=0-164
  misc_feature (42)..(50): Xaa can be any naturally occurring amino acid
KYHHTSMRTLNVAVDISYINSFIENVLTKQIQCNRFDCKRDXXXXXXXXXGAGEG

SEQ ID NO: 36119 - protein, 93 aa, Diabrotica virgifera; identical to SEQ ID NO: 27329
  misc_feature: Coding regions on vcDNA: vcDNA=SeqID_15816; Strand=+; Position=485-766
  misc_feature (25)..(55): Xaa can be any naturally occurring amino acid

SEQ ID NO: 36120 - protein, 66 aa, Diabrotica virgifera; identical to SEQ ID NO: 26808
  misc_feature: Coding regions on vcDNA: vcDNA=SeqID_15817; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36121 - protein, 251 aa, Diabrotica virgifera
  misc_feature: Coding regions on vcDNA: vcDNA=SeqID_15818; Strand=+; Position=110-865
  misc_feature: Homolog annotation: Hit_ID=XP_317425.1; Match level="QueryCoverage =97%, HitCoverage=31%, E-value=7e-47, Identity=40%"; Hit description =ENSANGP00000011562 [Anopheles gambiae]
  misc_feature: Gene Ontology Annotation: Molecular function=microtubule motor activity; Cellular component=kinesin complex; Biological process =organelle organization and biogenesis
  misc_feature: Pfam annotation: Pfam_ID=Kinesin; Match level="Score=-28.1, E-value =5.6e-13, Copies=1"; Pfam description=Kinesin motor domain
MAFSTPSSTRKRVISSVIFDKTPKSSYATPKNKKVEALPTTPECFNNVQVETPVIKRRTSKDKFDEVSNLTVAVRIRPMVVVGATDVVLVKEKELIIKAQSNTSGMSSNHQFHYDHIFWSCDESNDSYASQEDVFRTLGRPLINSAFKGYNGCLFAYGQTGSGKSFSMMGKDMCEATDMDCQVFSGITPRFCKDIFNRIAQLDKNSICTVEVSYFEIYNEKIHDLLSKVREHPELPYVVDLSVQVVKSTRN

SEQ ID NO: 36122 - protein, 17 aa, Diabrotica virgifera
  misc_feature: Coding regions on vcDNA: vcDNA=SeqID_15819; Strand=-; Position=1-51
  misc_feature (2)..(2): Xaa can be any naturally occurring amino acid
  misc_feature (4)..(17): Xaa can be any naturally occurring amino acid
EXKXXXXXXXXXXXXXX

SEQ ID NO: 36123 - protein, 36 aa, Diabrotica virgifera
  misc_feature: Coding regions on vcDNA: vcDNA=SeqID_15820; Strand=-; Position=1-108
  misc_feature (1)..(27): Xaa can be any naturally occurring amino acid
  misc_feature (30)..(36): Xaa can be any naturally occurring amino acid
XXXXXXXXXXXXXXXXXXXXXXXXXXXVSXXXXXXX

SEQ ID NO: 36124 - protein, 107 aa, Diabrotica virgifera
  misc_feature: Coding regions on vcDNA: vcDNA=SeqID_15821; Strand=+; Position=3-326
  misc_feature (11)..(31): Xaa can be any naturally occurring amino acid
  misc_feature (42)..(50): Xaa can be any naturally occurring amino acid
  misc_feature (55)..(61): Xaa can be any naturally occurring amino acid
RPRVRLVLELXXXXXXXXXXXXXXXXXXXXXLCVSWFFPMYXXXXXXXXXGAPPXXXXXXXKDKTPPGPPRCDPRPGISPKAPLNLNYRGPPIFNTLTPFGAPILYS

SEQ ID NO: 36125 - protein, 150 aa, Diabrotica virgifera
  misc_feature: Coding regions on vcDNA: vcDNA=SeqID_15822; Strand=+; Position=2-454
  misc_feature (1)..(122): Xaa can be any naturally occurring amino acid
  misc_feature (125)..(144): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYXXXXXXXXXXXXXXXXXXXXELYKCL

SEQ ID NO: 36126 - protein, 155 aa, Diabrotica virgifera
  misc_feature: Coding regions on vcDNA: vcDNA=SeqID_15823; Strand=+; Position=48-515
LYCVSLLNKMDAQQLRSILLVIFLIKGMIYLIYYCSRRPKNGPSVTVTTTTQHAQSPQVVPPYPIDTRHPVPASNITGYGNQAPYQQYPFHQTGNVASPMAGATPYPPQPYQQAAHDYSANPPPYDVAVSQPPLQPPPNSKEGYVKQSPYNPGYN

SEQ ID NO: 36127 - protein, 40 aa, Diabrotica virgifera
  misc_feature: Coding regions on vcDNA: vcDNA=SeqID_15824; Strand=-; Position=1-120
  misc_feature (5)..(39): Xaa can be any naturally occurring amino acid
IKKMXXXXXXXXXXXXXXXXXXXXXXXXXXXXXXXXXXXM

SEQ ID NO: 36128 - protein, 108 aa, Diabrotica virgifera
  misc_feature: Coding regions on vcDNA: vcDNA=SeqID_15825; Strand=-; Position=12-338
RPVVGMGMTSCGFLMYLSTSAIIMGGVSRSVTAFIESKKKVSDSVLLRLSKLRGSLTIHVTYERIVQVASVMWEHFMGTSSRSPGVSGIFFGVVFRLISRSGDPASRK

SEQ ID NO: 36129 - protein, 25 aa, Diabrotica virgifera
  misc_feature: Coding regions on vcDNA: vcDNA=SeqID_15826; Strand=+; Position=1-75
  misc_feature (7)..(17): Xaa can be any naturally occurring amino acid
LIYIINXXXXXXXXXXXLFLYHYIT

SEQ ID NO: 36130 - protein, 18 aa, Diabrotica virgifera
  misc_feature: Coding regions on vcDNA: vcDNA=SeqID_15827; Strand=-; Position=1-54
  misc_feature (1)..(11): Xaa can be any naturally occurring amino acid
  misc_feature (13)..(18): Xaa can be any naturally occurring amino acid
XXXXXXXXXXXSXXXXXX

SEQ ID NO: 36131 - protein, 292 aa, Diabrotica virgifera
  misc_feature: Coding regions on vcDNA: vcDNA=SeqID_15828; Strand=+; Position=2-880
  misc_feature (2)..(246): Xaa can be any naturally occurring amino acid
  misc_feature (252)..(270): Xaa can be any naturally occurring amino acid
  misc_feature (275)..(275): Xaa can be any naturally occurring amino acid
  misc_feature (287)..(287): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVITKYXXXXXXXXXXXXXXXXXXXHIRIXYLLGYSVIFIGXSQIDK

SEQ ID NO: 36132 - protein, 287 aa, Diabrotica virgifera
  misc_feature: Coding regions on vcDNA: vcDNA=SeqID_15829; Strand=+; Position=22-882
  misc_feature: Homolog annotation: Hit_ID=NP_727758.1; Match level="QueryCoverage =98%, HitCoverage=94%, E-value=7e-24, Identity=38%"; Hit description =CG32603-PA [Drosophila melanogaster] gb|AAN09580.1| CG32603-PA [Drosophila melanogaster]
  misc_feature: Gene Ontology Annotation: Molecular function=calcium ion binding; Cellular component=plasma membrane; Biological process=invasive growth
  misc_feature: Pfam annotation: Pfam_ID=Extensin_2; Match level="Score=-136.9, E -value=0.051, Copies=1"; Pfam description=Extensin-like region
  misc_feature (35)..(41): Xaa can be any naturally occurring amino acid
  misc_feature (251)..(251): Xaa can be any naturally occurring amino acid
MSFKVLSFAALVAFANAGLLSEAPVSGPVISAYSXXXXXXXPNVINSVAPVVSAYSSPLALPATAPVIPSYSAPVLANAVAPVAYSAPVTYSSPAPVVSAYSSPLVAKSLTPVSYASSAPVVSPVAYSAPAPVVSAYSSPLLAKSLTPVSYASNAPVVSPVGYSAPVPVVSAYSSPLVAKSVTPVSYASSAPVVSPVAYSAPAPVVSAYSSPLVAKSLTPVSYASNAPVVSPVAYSAPAPVVSAYSSPLVXQSLTPVSYASTAPVVSALLAPVVAQGVSPLAIVRLL

SEQ ID NO: 36133 - protein, 31 aa, Diabrotica virgifera
  misc_feature: Coding regions on vcDNA: vcDNA=SeqID_15830; Strand=-; Position=1-93
IAATPIINFNPTSRSAIFIIDLNSPIKFTLL

SEQ ID NO: 36134 - protein, 257 aa, Diabrotica virgifera
  misc_feature: Coding regions on vcDNA: vcDNA=SeqID_15831; Strand=+; Position=57-827
  misc_feature: Homolog annotation: Hit_ID=XP_392929.1; Match level="QueryCoverage =43%, HitCoverage=21%, E-value=5e-23, Identity=49%"; Hit description =similar to ENSANGP00000017553 [Apis mellifera]
  misc_feature: Gene Ontology Annotation: Molecular function=ribosome receptor activity; Cellular component=integral to endoplasmic reticulum membrane; Biological process=signal transduction
  misc_feature (250)..(250): Xaa can be any naturally occurring amino acid
KSKPKEKKSKKANKKPKEKPVQENDVNESENTENKENAHPSKLHVIITEELKLASSKESNKRDDIFKQEPVKEKVVKEKKQTTEVGVTAKNKKNAKTQQTEVGKQEKPAPPPEEKVEEKVIIEVIPAVPQTNGIVANTEFNTKQQLSAERDGLINSVRKAELSKTEIQYLIDLLLNKQLEAPAVIDDWSEGKSDPVQKLKRQLAEKEKALVDEQQALVGAQAKLREIRSEQQAEKSQLQQKLRLLEESMXNKQIEIQ

SEQ ID NO: 36135 - protein, 249 aa, Diabrotica virgifera
  misc_feature: Coding regions on vcDNA: vcDNA=SeqID_15832; Strand=+; Position=139-885
  misc_feature: Homolog annotation: Hit_ID=CAF99184.1; Match level="QueryCoverage =99%, HitCoverage=67%, E-value=3e-39, Identity=41%"; Hit description =unnamed protein product [Tetraodon nigroviridis]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=111.2, E-value =2.5e-30, Copies=4"; Pfam description=Zinc finger, C2H2 type
  misc_feature (138)..(144): Xaa can be any naturally occurring amino acid
  misc_feature (217)..(217): Xaa can be any naturally occurring amino acid
  misc_feature (233)..(233): Xaa can be any naturally occurring amino acid
METKQEPSEEICKIEPDNEAFDGPSDAFKIEIKEEPKTESVYNEFDYLDLNEFPVKAEVEQDEYKFTPFEEEQKPNEAKMKIWETLHSSHNGKHTDQHAVIVATGQRHYNCEICLKQFSKKNNLEIHLRIHTGEKPHXXXXXXXKFSQEGNLNTHLRLHTGEKPHTCKICFKQFSQEGNLNTHLRLHTGGKPHNCEICLHQFTTITSLKIHLRLHTXEKPYQCEICVKQFTTXGHLKIHLRTHTGEKRH

SEQ ID NO: 36136 - protein, 77 aa, Diabrotica virgifera
  misc_feature: Coding regions on vcDNA: vcDNA=SeqID_15833; Strand=-; Position=0-230
KMHATIKDRNRVTLSHFVQIRDSTVCSVNPSGTRFIRRSFIQKSSLTFSTMVLRTGDGYCSLRLRPKRKTSKKVRVA

SEQ ID NO: 36137 - protein, 54 aa, Diabrotica virgifera
  misc_feature: Coding regions on vcDNA: vcDNA=SeqID_15834; Strand=-; Position=0-161
  misc_feature (4)..(53): Xaa can be any naturally occurring amino acid
QKIXXXXXXXXXXXXXXXXXXXXXXXXXXXXXXXXXXXXXXXXXXXXXXXXXXA

SEQ ID NO: 36138 - protein, 267 aa, Diabrotica virgifera
  misc_feature: Coding regions on vcDNA: vcDNA=SeqID_15835; Strand=+; Position=22-826
  misc_feature: Homolog annotation: Hit_ID=XP_397120.1; Match level="QueryCoverage =88%, HitCoverage=97%, E-value=2e-76, Identity=54%"; Hit description =similar to ENSANGP00000018877 [Apis mellifera]
  misc_feature: Pfam annotation: Pfam_ID=CBM_14; Match level="Score=126.5, E-value =6.3e-35, Copies=3"; Pfam description=Chitin binding Peritrophin-A domain
  misc_feature (51)..(51): Xaa can be any naturally occurring amino acid
MKYLQVLLVGAVLAIQVYSQNYRQSVYHNNHQSTSQYSHQLPRGAGSCPEXNGRYPTDMCDGYVECNEGVPEEKVCQDGLLFNAAAGVFAFPCQYPIDVDCSGREQTHPAQPTDECPHQFGYYRMGDQADCGKFKNCVDGRAYIFDCPEGLAFNGETYRCDWPDQVSSCNAEAYLGFTCPQDAKTLGLGLGQEEYRYFRSPNDCQRYFICVEGKPRLYNCGEGRAFNDLINACDGAENVTGCAVPSHNFDTRVDDRRGQTYSNYYRG

SEQ ID NO: 36139 - protein, 106 aa, Diabrotica virgifera
  misc_feature: Coding regions on vcDNA: vcDNA=SeqID_15836; Strand=+; Position=536-856
  misc_feature (87)..(93): Xaa can be any naturally occurring amino acid
  misc_feature (99)..(105): Xaa can be any naturally occurring amino acid
LLRQREVCFVSKHYPIPYFLLLLAAILSYLYTYCAFHLYFTVQVLMTNSDAKFYKKQVLSKHTFFYRITINNLGINIIAILWLSGVXXXXXXXKIPLSXXXXXXXV

SEQ ID NO: 36140 - protein, 21 aa, Diabrotica virgifera
  misc_feature: Coding regions on vcDNA: vcDNA=SeqID_15837; Strand=-; Position=2-64
  misc_feature (3)..(14): Xaa can be any naturally occurring amino acid
  misc_feature (17)..(21): Xaa can be any naturally occurring amino acid
LKXXXXXXXXXXXXLVXXXXX

SEQ ID NO: 36141 - protein, 111 aa, Diabrotica virgifera
  misc_feature: Coding regions on vcDNA: vcDNA=SeqID_15838; Strand=-; Position=2-334
  misc_feature (27)..(33): Xaa can be any naturally occurring amino acid
  misc_feature (58)..(65): Xaa can be any naturally occurring amino acid
  misc_feature (68)..(81): Xaa can be any naturally occurring amino acid
  misc_feature (87)..(100): Xaa can be any naturally occurring amino acid
  misc_feature (102)..(111): Xaa can be any naturally occurring amino acid
LFDSSPRKVLIPYSRHPIILHQLLLSXXXXXXXLAPFVLKYTNNLKIESNLAHSGLNXXXXXXXXSNXXXXXXXXXXXXXXPTSRSXXXXXXXXXXXXXXVXXXXXXXXXX

SEQ ID NO: 36142 - protein, 36 aa, Diabrotica virgifera
  misc_feature: Coding regions on vcDNA: vcDNA=SeqID_15839; Strand=-; Position=1-108
  misc_feature (2)..(34): Xaa can be any naturally occurring amino acid
KXXXXXXXXXXXXXXXXXXXXXXXXXXXXXXXXXSI

SEQ ID NO: 36143 - protein, 69 aa, Diabrotica virgifera
  misc_feature: Coding regions on vcDNA: vcDNA=SeqID_15840; Strand=-; Position=2-208
  misc_feature (2)..(2): Xaa can be any naturally occurring amino acid
  misc_feature (6)..(16): Xaa can be any naturally occurring amino acid
  misc_feature (26)..(33): Xaa can be any naturally occurring amino acid
  misc_feature (36)..(49): Xaa can be any naturally occurring amino acid
  misc_feature (55)..(68): Xaa can be any naturally occurring amino acid
IXGPFXXXXXXXXXXXTNLAHTGLNXXXXXXXXSNXXXXXXXXXXXXXXPTSRSXXXXXXXXXXXXXXV

SEQ ID NO: 36144 - protein, 95 aa, Diabrotica virgifera
  misc_feature: Coding regions on vcDNA: vcDNA=SeqID_15841; Strand=-; Position=534-821
  misc_feature (12)..(19): Xaa can be any naturally occurring amino acid
YKHKLLHPPLSXXXXXXXXTHFSRFCIYFTVIYLHSSYSPSAVTPPHAARSIFNQTKSKHKLKRTSMCILYILYTVYYILHTSTYVLLCVLTQFD

SEQ ID NO: 36145 - protein, 187 aa, Diabrotica virgifera
  misc_feature: Coding regions on vcDNA: vcDNA=SeqID_15842; Strand=+; Position=198-761
MEKVFTEGPNFIDTFPDKYDDRLTKVLDVTRTVLTKIAQALKVVIDKVAEQSNDAGKKLVSCVEQHEADLVNIRVALVEGAGKCVKDSVVALVNTGAPLLKDLTEIHKQARDAAEEIDNCEGDNAAGLLCVFQVAMDILKVDLQIPDAVKGDIQPVIDAGKALHTAGKKCIHDQVPAFYANTGKLFG

SEQ ID NO: 36146 - protein, 31 aa, Diabrotica virgifera
  misc_feature: Coding regions on vcDNA: vcDNA=SeqID_15843; Strand=+; Position=1-93
  misc_feature (5)..(29): Xaa can be any naturally occurring amino acid
NPIEXXXXXXXXXXXXXXXXXXXXXXXXXGG

SEQ ID NO: 36147 - protein, 301 aa, Diabrotica virgifera
  misc_feature: Coding regions on vcDNA: vcDNA=SeqID_15844; Strand=+; Position=68-970
  misc_feature: Homolog annotation: Hit_ID=XP_315648.1; Match level="QueryCoverage =88%, HitCoverage=94%, E-value=3e-96, Identity=67%"; Hit description =ENSANGP00000021658 [Anopheles gambiae]
  misc_feature: Gene Ontology Annotation: Molecular function=soluble NSF attachment protein activity; Cellular component=cytoplasm; Biological process =synaptic vesicle priming
  misc_feature: Pfam annotation: Pfam_ID=TPR_4; Match level="Score=21.4, E-value =0.0029, Copies=2"; Pfam description=Tetratricopeptide repeat
  misc_feature (34)..(39): Xaa can be any naturally occurring amino acid
  misc_feature (258)..(258): Xaa can be any naturally occurring amino acid
MSSNKKIEDGLEHIRNAEKSLKTSLLKWRPDYEXXXXXXNKAATCFRNAKSFDQCRDCLLKVVECHKQNRALFYAAKALDQCVLVSKELGDLRAIPQYAERAANMYHTQGNAESAASALDKAAKIIEQKLPADALKLYQHATEIVMIQDSTRQAAEYASKIARLHVKLMQYDLAADAIRRELGLHQQNESYQATGRLTVALVLVQLARGDVVAAEKAFKEWGNYCEAPELQTLESLLQAYDEEDPEGAKRALNSPVIXHMDVEYAILARDMRLPESSLPQTRVVQEKPSHLLMSYPKHKEM

SEQ ID NO: 36148 - protein, 296 aa, Diabrotica virgifera
  misc_feature: Coding regions on vcDNA: vcDNA=SeqID_15845; Strand=+; Position=2-892
  misc_feature: Homolog annotation: Hit_ID=XP_308813.1; Match level="QueryCoverage =94%, HitCoverage=52%, E-value=2e-82, Identity=51%"; Hit description =ENSANGP00000021666 [Anopheles gambiae]
  misc_feature: Gene Ontology Annotation: Molecular function=molecular_function unknown; Cellular component=mitochondrion; Biological process=lipid metabolism
  misc_feature (286)..(286): Xaa can be any naturally occurring amino acid
YFWGIVFVITTTIVAFLKRETDASNVDHERDLKSAYKSLKSIMGLPAVQTLVVILLTCKIGFSSTDSVMGLKLVEAGIPKERLGLMALPLIPLQLAMPLVIAKYTTGPKPLNIFLKAIPYRLAFGFVAAFVVFITPILVPDASNGLPFYYVILLFACYALHQVCVYCMFVAQMAFFAKISDSAVGGTYMTLLNTLTNLGGNWPTMLALYWVDPLTWKRCEGGAESVDNICRNNVEKVLCEKVGGKCVTVLDGFYIETLICVCIGFLWYLWGAKKVRHLQQLGDNAXKLKNKKSQKS

SEQ ID NO: 36149 - protein, 63 aa, Diabrotica virgifera
  misc_feature: Coding regions on vcDNA: vcDNA=SeqID_15846; Strand=-; Position=342-533
EDSKAKRHISMNLHMLHHQRLLNHFQRHLKFLYYGNIVEFVLRHRFLLIMIRFSCSCTQHLRC

SEQ ID NO: 36150 - protein, 17 aa, Diabrotica virgifera
  misc_feature: Coding regions on vcDNA: vcDNA=SeqID_15847; Strand=-; Position=1-51
  misc_feature (1)..(17): Xaa can be any naturally occurring amino acid
XXXXXXXXXXXXXXXXX

SEQ ID NO: 36151 - protein, 61 aa, Diabrotica virgifera
  misc_feature: Coding regions on vcDNA: vcDNA=SeqID_15848; Strand=+; Position=113-298
LQLKSYISNSRPHGWPYHLLKLDIYLCMSLLSLCMLAGGDYSEPLHSRWYQPSCILIFSDY

SEQ ID NO: 36152 - protein, 175 aa, Diabrotica virgifera
  misc_feature: Coding regions on vcDNA: vcDNA=SeqID_15849; Strand=-; Position=89-616
  misc_feature (44)..(61): Xaa can be any naturally occurring amino acid
YHPWIISPHSTPHLSFFLAQRRGSHIRGQADRRTKLLIPSTIAXXXXXXXXXXXXXXXXXXGAVTFAVGRTDGQTAPVKLLNPSTILGYKLPFDTPLGHFLRGYFVKKKLWGLSVRDFLWGLFVRGLFVGIICEDYLWGFFVLGFLSGDNLWGFFVRDYLSGPLINSYLSSTEIS

SEQ ID NO: 36153 - protein, 68 aa, Diabrotica virgifera
  misc_feature: Coding regions on vcDNA: vcDNA=SeqID_15850; Strand=+; Position=27-233
  misc_feature (19)..(26): Xaa can be any naturally occurring amino acid
  misc_feature (35)..(41): Xaa can be any naturally occurring amino acid
DRFNGFCKINFVIKISQKXXXXXXXXRTENKSESXXXXXXXIEEYCTFHLQFAELKSVNWHCVRNFLE

SEQ ID NO: 36154 - protein, 84 aa, Diabrotica virgifera
  misc_feature: Coding regions on vcDNA: vcDNA=SeqID_15851; Strand=-; Position=1-252
VTNWGVICLIFFCQNKRDQHYPVCNLLIFDARKFFYRNRNKDFLHFKHFKKVVMCFPQECIIIWIFHIEPFHLEFFEYEPIFNQ

SEQ ID NO: 36155 - protein, 58 aa, Diabrotica virgifera
  misc_feature: Coding regions on vcDNA: vcDNA=SeqID_15852; Strand=+; Position=3-176
TMMMNYNILTINLIVVQQICWSTGSRNYYNIDAKNIVNHVDELLKKYIFKLINAHFSN

SEQ ID NO: 36156 - protein, 76 aa, Diabrotica virgifera; identical to SEQ ID NO: 30842
  misc_feature: Coding regions on vcDNA: vcDNA=SeqID_15853; Strand=-; Position=1-228
  misc_feature (1)..(76): Xaa can be any naturally occurring amino acid

SEQ ID NO: 36157 - protein, 40 aa, Diabrotica virgifera
  misc_feature: Coding regions on vcDNA: vcDNA=SeqID_15854; Strand=+; Position=63-185
LRDCDTRFHLYYERLIVIYLLPTQPLSNCIAISNFHTKSR

SEQ ID NO: 36158 - protein, 32 aa, Diabrotica virgifera
  misc_feature: Coding regions on vcDNA: vcDNA=SeqID_15855; Strand=-; Position=1-96
  misc_feature (5)..(20): Xaa can be any naturally occurring amino acid
  misc_feature (22)..(31): Xaa can be any naturally occurring amino acid
IKKIXXXXXXXXXXXXXXXXTXXXXXXXXXXN

SEQ ID NO: 36159 - protein, 229 aa, Diabrotica virgifera
  misc_feature: Coding regions on vcDNA: vcDNA=SeqID_15856; Strand=+; Position=82-771
  misc_feature: Homolog annotation: Hit_ID=AAK50002.1; Match level="QueryCoverage =94%, HitCoverage=38%, E-value=4e-16, Identity=23%"; Hit description =ORF73 [Human herpesvirus 8]
  misc_feature: Gene Ontology Annotation: Molecular function=molecular_function unknown; Cellular component=cellular_component unknown; Biological process=salinity response
  misc_feature (87)..(93): Xaa can be any naturally occurring amino acid
QEAKAKTTKKQKEHSNQENTSDQEDILDTTIMASEQQELSGIDKLLQMMQLQSQRMEQKMDETKQAIDESQKKMDKNQEETSKKMDXXXXXXXDNQKETKQAIEENNKKIEERIEKYEKEIKGCLTTMKNEIEQQEMKIKDHMQEQEIRMKDHMKEQEMIIQNKMEELTNGQKKELENLENKLENAIQVDREEVEKRITEIEKQVTENRTQQNVKIFALFLGKSPTIGN

SEQ ID NO: 36160 - protein, 31 aa, Diabrotica virgifera
  misc_feature: Coding regions on vcDNA: vcDNA=SeqID_15857; Strand=-; Position=1-93
  misc_feature (8)..(8): Xaa can be any naturally occurring amino acid
  misc_feature (23)..(23): Xaa can be any naturally occurring amino acid
NIAATPIXNFIHIEGRNLIYRLXLSNKITLL

SEQ ID NO: 36161 - protein, 238 aa, Diabrotica virgifera
  misc_feature: Coding regions on vcDNA: vcDNA=SeqID_15858; Strand=+; Position=163-875
  misc_feature: Homolog annotation: Hit_ID=XP_314908.1; Match level="QueryCoverage =94%, HitCoverage=78%, E-value=2e-79, Identity=57%"; Hit description =ENSANGP00000012401 [Anopheles gambiae]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-79.7, E-value=6.1e -07, Copies=1"; Pfam description=GNS1/SUR4 family
  misc_feature (209)..(209): Xaa can be any naturally occurring amino acid
MATIVNSTVIPKNSTNFYHFLFTEIADPRTNSWFLIKDPGPGLAILIIWMYFVLNIGPKMMKDREPFDLRKTLIVYNLVQVIISSYIFIRGGIIGWFGKYSYKCQPIDYSDAPEAQEMRHLMYLYFINKLLELLDTVFFVLRKKQNQVTFLHMYHHTVMPMVSWGGIKYVPGGHGTLIGFINCFVHIIMYSYYSLAAFGPKIQKYLWWXKYITAMQLQHNSQLFFRDCGYPHGFFYFL

SEQ ID NO: 36162 - protein, 22 aa, Diabrotica virgifera
  misc_feature: Coding regions on vcDNA: vcDNA=SeqID_15859; Strand=-; Position=1-66
  misc_feature (12)..(19): Xaa can be any naturally occurring amino acid
IKLLLKDKFLMXXXXXXXXHPP

SEQ ID NO: 36163 - protein, 283 aa, Diabrotica virgifera
  misc_feature: Coding regions on vcDNA: vcDNA=SeqID_15860; Strand=+; Position=1-848
  misc_feature: Homolog annotation: Hit_ID=XP_392146.1; Match level="QueryCoverage =98%, HitCoverage=32%, E-value=1e-109, Identity=68%"; Hit description= similar to CG5978-PA [Apis mellifera]
  misc_feature: Gene Ontology Annotation: Molecular function=Rab GTPase activator activity; Cellular component=Golgi apparatus; Biological process =vesicle-mediated transport
  misc_feature: Pfam annotation: Pfam_ID=TBC; Match level="Score=-25.8, E-value=7.9e -06, Copies=1"; Pfam description=TBC domain
  misc_feature (271)..(271): Xaa can be any naturally occurring amino acid
PRVRDVTLGDHPLNINPDSEWQTFFKDNEVLLQIDKDVRRLCPDISFFQQPTEYPCKEIVNMNDVKRLHTRVQRSVLKCANVERKGLGITKIALLSKKANEDYAPMTEGKEAHWEVVERILFLYAKLNPGQGYVQGMNEIVGPIYFSFALDSDISFREHAEADCFFCFTNLMSEIRDFFIKSLDESDKGINGMMNRLLNQLKTSDLDVWLKFQQLDLKPQYYSFRWITLLLSQEFPLPDVLRIWDSLFSDKKRFNFLIFVCCAMIVILRNXLLDGDFPSNPEL

SEQ ID NO: 36164 - protein, 64 aa, Diabrotica virgifera
  misc_feature: Coding regions on vcDNA: vcDNA=SeqID_15861; Strand=+; Position=429-623
  misc_feature (6)..(12): Xaa can be any naturally occurring amino acid
  misc_feature (25)..(32): Xaa can be any naturally occurring amino acid
  misc_feature (44)..(55): Xaa can be any naturally occurring amino acid
KCAKFXXXXXXXFVILFSTGLGKCXXXXXXXXIFVNRFSKKSVXXXXXXXXXXXXSFSNTLFHK

SEQ ID NO: 36165 - protein, 83 aa, Diabrotica virgifera
  misc_feature: Coding regions on vcDNA: vcDNA=SeqID_15862; Strand=+; Position=111-362
IKINIKHITTQAKDILVEIFNACLSGNNGVPSEWKKSITIPIYIYKKCGRKNCNNYRGISPNNTQHSRNVLPKFYQYLNVLDI

SEQ ID NO: 36166 - protein, 314 aa, Diabrotica virgifera
  misc_feature: Coding regions on vcDNA: vcDNA=SeqID_15863; Strand=+; Position=1-943
  misc_feature: Homolog annotation: Hit_ID=XP_394044.1; Match level="QueryCoverage =98%, HitCoverage=41%, E-value=1e-135, Identity=78%"; Hit description= similar to Cullin homolog 1 (CUL-1) [Apis mellifera]
  misc_feature: Gene Ontology Annotation: Molecular function=protein binding; Cellular component=SCF ubiquitin ligase complex; Biological process =apoptosis
  misc_feature: Pfam annotation: Pfam_ID=Cullin; Match level="Score=279.9, E-value =4.1e-81, Copies=1"; Pfam description=Cullin family
  misc_feature (150)..(159): Xaa can be any naturally occurring amino acid
  misc_feature (241)..(248): Xaa can be any naturally occurring amino acid
  misc_feature (277)..(277): Xaa can be any naturally occurring amino acid
  misc_feature (287)..(287): Xaa can be any naturally occurring amino acid
LHASDGETINTRLVSGVINCYVELGLNEEEPGAKGPNLSVYKDSFENVFLEDTERFYMRESTSFLSENPVTEYMKRAEQRLAEEQKRVQNYLHITTSERLAGTCERVLIQKHLELFHSEFQQLLDDDKDADLGRMYSLVARIPDGLGELXXXXXXXXXXQGLAAIEKCGESAVNDPKVYVNTILEVHKKYNALVLVAFSNDSGFVAALDKACGRFINANAVTKQANSSSRSPELLAKYCDXXXXXXXXNAEEAELEDTLNQVMVVFKYIEDKDVFQXFYSKMLAKRXVQHIVASDDAEASMISKLKQLVGLIYV

SEQ ID NO: 36167 - protein, 28 aa, Diabrotica virgifera
  misc_feature: Coding regions on vcDNA: vcDNA=SeqID_15864; Strand=+; Position=2-85
  misc_feature (19)..(26): Xaa can be any naturally occurring amino acid
MNAISEFKNLNLLLFFVIXXXXXXXXDY

SEQ ID NO: 36168 - protein, 44 aa, Diabrotica virgifera
  misc_feature: Coding regions on vcDNA: vcDNA=SeqID_15865; Strand=+; Position=2-136
  misc_feature (5)..(5): Xaa can be any naturally occurring amino acid
  misc_feature (7)..(7): Xaa can be any naturally occurring amino acid
  misc_feature (9)..(10): Xaa can be any naturally occurring amino acid
  misc_feature (22)..(22): Xaa can be any naturally occurring amino acid
FRAPXPXGXXQRKPFYKEREYXKNTTTRPKRKRDKNIILLFISA

SEQ ID NO: 36169 - protein, 45 aa, Diabrotica virgifera
  misc_feature: Coding regions on vcDNA: vcDNA=SeqID_15866; Strand=-; Position=1-135
  misc_feature (6)..(24): Xaa can be any naturally occurring amino acid
  misc_feature (27)..(43): Xaa can be any naturally occurring amino acid
KWDQKXXXXXXXXXXXXXXXXXXXIKXXXXXXXXXXXXXXXXXIK

SEQ ID NO: 36170 - protein, 83 aa, Diabrotica virgifera
  misc_feature: Coding regions on vcDNA: vcDNA=SeqID_15867; Strand=-; Position=0-248
  misc_feature (7)..(15): Xaa can be any naturally occurring amino acid
  misc_feature (18)..(50): Xaa can be any naturally occurring amino acid
  misc_feature (52)..(79): Xaa can be any naturally occurring amino acid
GGGSFFXXXXXXXXXRVXXXXXXXXXXXXXXXXXXXXXXXXXXXXXXXXXKXXXXXXXXXXXXXXXXXXXXXXXXXXXXNHHP

SEQ ID NO: 36171 - protein, 38 aa, Diabrotica virgifera
  misc_feature: Coding regions on vcDNA: vcDNA=SeqID_15868; Strand=-; Position=2-118
HSRCFNQLVITLALILITYPHFIIYNLIQTAPLQLLST

SEQ ID NO: 36172 - protein, 252 aa, Diabrotica virgifera
  misc_feature: Coding regions on vcDNA: vcDNA=SeqID_15869; Strand=-; Position=1-756
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(251): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 36173 - protein, 203 aa, Diabrotica virgifera
  misc_feature: Coding regions on vcDNA: vcDNA=SeqID_15870; Strand=+; Position=2-806
  misc_feature: Homolog annotation: Hit_ID=AAF87759.1; Match level="QueryCoverage =100%, HitCoverage=62%, E-value=2e-80, Identity=63%"; Hit description= cytochrome oxidase subunit I [Diabrotica virgifera virgifera]
  misc_feature: Pfam annotation: Pfam_ID=COX1; Match level="Score=-31.5, E-value=3.7e- 10, Copies=1"; Pfam description=Cytochrome C and Quinol oxidase polyp
  misc_feature (6)..(6): Xaa can be any naturally occurring amino acid
  misc_feature (31)..(39): Xaa can be any naturally occurring amino acid
  misc_feature (66)..(66): Xaa can be any naturally occurring amino acid
  misc_feature (120)..(120): Xaa can be any naturally occurring amino acid
  misc_feature (155)..(155): Xaa can be any naturally occurring amino acid
GVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 36174 - protein, 74 aa, Diabrotica virgifera
  misc_feature: Coding regions on vcDNA: vcDNA=SeqID_15871; Strand=-; Position=41-265
  misc_feature (24)..(31): Xaa can be any naturally occurring amino acid
YRSQLNYLSFRYVIETDEASLNYXXXXXXXXLLCKKHMYSKSLKRAVSQNVLGINIPSSVLSQAYMLQATKTYG

SEQ ID NO: 36175 - protein, 166 aa, Diabrotica virgifera
  misc_feature: Coding regions on vcDNA: vcDNA=SeqID_15872; Strand=+; Position=372-872
  misc_feature: Homolog annotation: Hit_ID=CAA47046.1; Match level="QueryCoverage =37%, HitCoverage=23%, E-value=3e-11, Identity=49%"; Hit description =preprochymotrypsin 1 [Litopenaeus vannamei] pir||S29239 chymotrypsin (EC 3.4.21.1) 1 precursor - penaeid s
MVALAFPQVHGDFTERSNRRVMRKVPYDYSSHYWNFIARFNHRMFKFLACETRGILQDSVVKLFSTVCCNCSYNTHKPINNVPYYGFRVNGKVTVILGGHNIRKKEPSQIRVKSSTVIIHPDWNRFLLRNDVGLVILPSEVELNDDIQTIPLPHENSKASFKGKMH

SEQ ID NO: 36176 - protein, 48 aa, Diabrotica virgifera
  misc_feature: Coding regions on vcDNA: vcDNA=SeqID_15873; Strand=+; Position=157-303
  misc_feature (35)..(41): Xaa can be any naturally occurring amino acid
MAVPFYRIFVFRRRYHLMLKRPCCLLLDKFLYTRXXXXXXXNNKNKLL

SEQ ID NO: 36177 - protein, 111 aa, Diabrotica virgifera
  misc_feature: Coding regions on vcDNA: vcDNA=SeqID_15874; Strand=+; Position=427-762
  misc_feature (44)..(52): Xaa can be any naturally occurring amino acid
HINSNFGSLKTFKERKQIMETDVNFRLTNHYFKPFILQIKYDLXXXXXXXXXGMVYVAYKFDLAVTAVSKLKQSSNEMPYLLCIIKNTLTGHARKVCRYPRISGLLFGYCV

SEQ ID NO: 36178 - protein, 190 aa, Diabrotica virgifera
  misc_feature: Coding regions on vcDNA: vcDNA=SeqID_15875; Strand=+; Position=345-917
  misc_feature (142)..(142): Xaa can be any naturally occurring amino acid
MFKKKPKETGAQPVSEEITDQIQQTSTFLQEEVNKHHDVRPLVEENIVTTQPVINESIVVTTEENLGSPNVTTKTETTKEKFVTTSKDHTDTIKKETKTETTKKIITTQTTSTTQSVTKTTSATIESDIAAATPVVIESTLXPIDGSKGFLKTEVEKYHDVKPIIKSSDHYKRSWLSLLNQYSKKLLMSK

SEQ ID NO: 36179 - protein, 306 aa, Diabrotica virgifera
  misc_feature: Coding regions on vcDNA: vcDNA=SeqID_15876; Strand=+; Position=14-934
  misc_feature: Homolog annotation: Hit_ID=EAA00819.2; Match level="QueryCoverage =94%, HitCoverage=68%, E-value=5e-31, Identity=31%"; Hit description =ENSANGP00000011548 [Anopheles gambiae str. PEST] ref|XP_551263.1| ENSANGP00000011548 [Anopheles gambiae st
  misc_feature: Gene Ontology Annotation: Molecular function=molecular_function unknown
  misc_feature: Pfam annotation: Pfam_ID=DUF227; Match level="Score=74.9, E-value =2.2e-19, Copies=1"; Pfam description=Domain of unknown function (DUF227)
  misc_feature (290)..(290): Xaa can be any naturally occurring amino acid
MEIAKEHRALVDRIARENGFTDYEIITSSGSNKGDNFLGILTAITIKNKEKSLDVILKTSETNKQVRDSTPFRDLYKREIFLYERVFKEFKKLQEEYSIEDPFDSVPKFYLSFTEDDLEGLVMENLKTQQYQLWNKKVPINPGHTKAVLIEYAKFHAASLAMKYKHPELFKELTENGPRNPYEITYQEGIHEEKIEHRKAFLTHSLTDSFKAVEDDPVLTEYLEKYGQKLLPEAFSKLQEPEYKVVITHGDCWCNNFMFQYQDPQRKTKPSSLRIIDWQMSSFGSPCTDXSYFLSGNGSEEILDDF

SEQ ID NO: 36180 - protein, 262 aa, Diabrotica virgifera
  misc_feature: Coding regions on vcDNA: vcDNA=SeqID_15877; Strand=-; Position=1-786
  misc_feature (2)..(262): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36181 - protein, 84 aa, Diabrotica virgifera
  misc_feature: Coding regions on vcDNA: vcDNA=SeqID_15878; Strand=-; Position=205-459
KINSLKFSNQNDPPEDLLASRRWGGIHSAVKAQVGPMSPSFLVVSAKHSPALMKIDEGSTKSEVKTFSDCTNSHFKNFMGGSCD

SEQ ID NO: 36182 - protein, 288 aa, Diabrotica virgifera
  misc_feature: Coding regions on vcDNA: vcDNA=SeqID_15879; Strand=+; Position=73-938
  misc_feature: Homolog annotation: Hit_ID=XP_319685.1; Match level="QueryCoverage =87%, HitCoverage=47%, E-value=2e-48, Identity=39%"; Hit description =ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=25.2, E-value =0.0002, Copies=1"; Pfam description=Major Facilitator Superfamily
  misc_feature (248)..(248): Xaa can be any naturally occurring amino acid
  misc_feature (261)..(261): Xaa can be any naturally occurring amino acid
  misc_feature (267)..(267): Xaa can be any naturally occurring amino acid
MTYQAQNIAEEKAKEALGLLINKDVSIKKGPTIGKRCQQALILHILLLFCFIIRTALTVAIVAMTDSNASSNKDIPTYNWNDKSLIMASFLWGYCIPQIVAGYVSDKYGAKWFLVGSTTVTATAGLLIPSAAIYFDSKGVMVCRFLQGLSQGFLFPSMHAVLGKWIPVPERSRLGTFVYLGAPLGIVSSLLLTGYICSTSYGWPMVFYLFNTIALIMAAIYAYVGSNDPSSHPTITEEEKIYIISSLXTATDRHNLMVPWXGNLTSXAFIAFVITHLCFNFTHWDGYI

SEQ ID NO: 36183 - protein, 306 aa, Diabrotica virgifera
  misc_feature: Coding regions on vcDNA: vcDNA=SeqID_15880; Strand=+; Position=2-919
  misc_feature (266)..(266): Xaa can be any naturally occurring amino acid
  misc_feature (276)..(276): Xaa can be any naturally occurring amino acid
  misc_feature (284)..(284): Xaa can be any naturally occurring amino acid
NVNLRFFIMEFTCSVLVTIFIAAWIEISSGAVTTTSTPTPPPTEFHLGEKNITWHPDYNEKLIITTDEGFKISVGIQYCDIDITDKEFVKIYTDKPEESIIVTGTVAASPKFLYNKDVLNLEFTGSKNSNVTFEFARIGDVITTTTTEPTSSTEFLPTPNITDTYELVVVLTGLAAYQYRNPTVLLDFAQMITNMAIDYCEDQQFELVDNITTNNVEIIGIYTCTTGWPSCSPCVEAKFAVPIHTKNDSETWPGYQLNQYHLQIMXERYSEKYLTXRITTCTLXSMNNWIKYRIILFFSVNCIFFI

SEQ ID NO: 36184 - protein, 104 aa, Diabrotica virgifera
  misc_feature: Coding regions on vcDNA: vcDNA=SeqID_15881; Strand=-; Position=140-454
FSDNNNGASTETGLSSHIKRARIGGEHFKMMLPDECKPKKSKTDEMYVNRVEEGYQTNLISKYMVDNETKFHSFFRVTKNQFHFLLCVIKEDITKSRTRMVERE

SEQ ID NO: 36185 - protein, 287 aa, Diabrotica virgifera
  misc_feature: Coding regions on vcDNA: vcDNA=SeqID_15882; Strand=+; Position=2-865
  misc_feature: Homolog annotation: Hit_ID=XP_311412.1; Match level="QueryCoverage =97%, HitCoverage=69%, E-value=3e-13, Identity=26%"; Hit description =ENSANGP00000016830 [Anopheles gambiae]
KGPNTPPEPPNSPPSSPDAYDPFEPTKSRSPTPEPQLLGIKDSLESIDSRAAIDLLEKSMNPMPETTKSLTPPLADIQPADSQSSVQIITPDSNLGKSPERPQIQTVQQPSKPVAQTIPFSSVPTPIILATPSVATIPTRINILNTTVISPPVASPIPQRIVLPNIIKSGIVKISPTKPTVKTNPIKPIQKTTKSTRKRTTNGSLDDIVLDFDSPYSPGSSDYEDLFEPPSEIVTKPMIKGKTKSHASAFDALFGSPSYSKKKKYTKKANPKTTGGSQIGRKMFERS

SEQ ID NO: 36186 - protein, 138 aa, Diabrotica virgifera
  misc_feature: Coding regions on vcDNA: vcDNA=SeqID_15883; Strand=-; Position=300-716
  misc_feature (1)..(21): Xaa can be any naturally occurring amino acid
  misc_feature (25)..(32): Xaa can be any naturally occurring amino acid
  misc_feature (46)..(53): Xaa can be any naturally occurring amino acid
  misc_feature (56)..(63): Xaa can be any naturally occurring amino acid
  misc_feature (76)..(96): Xaa can be any naturally occurring amino acid
XXXXXXXXXXXXXXXXXXXXXVICXXXXXXXXDQVREMLRQSFINXXXXXXXXNSXXXXXXXXMQLDNRNLGVNKXXXXXXXXXXXXXXXXXXXXXKLLILISMERLSFKKMLLLSSSLKICNTGNIKMSRYRCSVNK

SEQ ID NO: 36187 - protein, 57 aa, Diabrotica virgifera; identical to SEQ ID NO: 32497
  misc_feature: Coding regions on vcDNA: vcDNA=SeqID_15884; Strand=-; Position=205-378
  misc_feature (1)..(12): Xaa can be any naturally occurring amino acid
  misc_feature (14)..(38): Xaa can be any naturally occurring amino acid

SEQ ID NO: 36188 - protein, 288 aa, Diabrotica virgifera
  misc_feature: Coding regions on vcDNA: vcDNA=SeqID_15885; Strand=+; Position=1-864
  misc_feature: Homolog annotation: Hit_ID=NP_524471.2; Match level="QueryCoverage =100%, HitCoverage=16%, E-value=2e-79, Identity=52%"; Hit description= CG5394-PA, isoform A [Drosophila melanogaster] gb|AAF56211.1| CG5394 -PA, isoform A [Drosophila
  misc_feature: Gene Ontology Annotation: Molecular function=glutamine-tRNA ligase activity; Cellular component=soluble fraction; Biological process =protein complex assembly
  misc_feature: Pfam annotation: Pfam_ID=tRNA-synt_1c; Match level="Score=-45.6, E -value=5.9e-11, Copies=1"; Pfam description=tRNA synthetases class I (E and Q), c
  misc_feature (281)..(281): Xaa can be any naturally occurring amino acid
VARTIARSFCPELYGSSALETTEVDNWLTLSLGPLNNRSEVTGVLETLNKVLGSVTYLVAKRITVADFIVFGSLYTNKHWNDLTKSKSAPVNVVRWYDFLHAQEAVMNILNNLPQDVAASLTQAEKQVSQEKNTNIGNRNQEGKFVDLPFAQMGKVIVRFPPEASGYLHIGHAKAALLNQHYQEAFQGKLILRFDDTNPAKENVHFENVILEDVAMLQIKPDIFTYTSDYFELMLELCEKMMKEGNAYVDDTEPEEMKTQREQKIESVNRNNDVQKNLLCXKNEKGTE

SEQ ID NO: 36189 - protein, 128 aa, Diabrotica virgifera
  misc_feature: Coding regions on vcDNA: vcDNA=SeqID_15886; Strand=+; Position=12-398
  misc_feature (3)..(10): Xaa can be any naturally occurring amino acid
  misc_feature (13)..(32): Xaa can be any naturally occurring amino acid
  misc_feature (41)..(59): Xaa can be any naturally occurring amino acid
  misc_feature (73)..(80): Xaa can be any naturally occurring amino acid
  misc_feature (93)..(100): Xaa can be any naturally occurring amino acid
  misc_feature (106)..(113): Xaa can be any naturally occurring amino acid
SIXXXXXXXXLKXXXXXXXXXXXXXXXXXXXXETLFIFKYXXXXXXXXXXXXXXXXXXXLYLILSIPPIFKNXXXXXXXXHHSTSTLNIMINXXXXXXXXIIYSYXXXXXXXXNSLLKYTSKLSKFSN

SEQ ID NO: 36190 - protein, 66 aa, Diabrotica virgifera; identical to SEQ ID NO: 26808
  misc_feature: Coding regions on vcDNA: vcDNA=SeqID_15887; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36191 - protein, 49 aa, Diabrotica virgifera
  misc_feature: Coding regions on vcDNA: vcDNA=SeqID_15888; Strand=+; Position=91-240
LQLILNYFFSSVIFICSSTGIKDVKIKLLTQYHRKRNMFCYAKCVSLRP

SEQ ID NO: 36192 - protein, 81 aa, Diabrotica virgifera
  misc_feature: Coding regions on vcDNA: vcDNA=SeqID_15889; Strand=-; Position=261-506
LKLPIKNNLFFQRGQQLIQQQQIYNKLTINKHYFPMKQQKLILKLTHYCTEQISIKMTEQIRENLTQVCQNDSDNFSMLPN

SEQ ID NO: 36193 - protein, 57 aa, Diabrotica virgifera
  misc_feature: Coding regions on vcDNA: vcDNA=SeqID_15890; Strand=+; Position=763-933
  misc_feature (28)..(36): Xaa can be any naturally occurring amino acid
RNCIFLFFLMAVQALFFNIVFNYRVISXXXXXXXXXPCTAILCLLRIRVPISRKIFK

SEQ ID NO: 36194 - protein, 79 aa, Diabrotica virgifera
  misc_feature: Coding regions on vcDNA: vcDNA=SeqID_15891; Strand=+; Position=466-705
  misc_feature (49)..(56): Xaa can be any naturally occurring amino acid
PKPSYKMIPILAHRNTDKTFNPLTNSETSIQKLYSSLFNTVWNKCIEKXXXXXXXXPSEKNCDLEDDNLDHLLREEDRH

SEQ ID NO: 36195 - protein, 140 aa, Diabrotica virgifera
  misc_feature: Coding regions on vcDNA: vcDNA=SeqID_15892; Strand=+; Position=3-425
MVDHPGRTITIYEVGGCLAYAFPLAFTPSNIESGFRVTGIRPFNSNIFTDEDFMSAYVTDREDPENKSTLSQFYVAQPAIVNNTNAPLLLALFTTPEIIRPHSSSRSISHNRQLRRTLIEDKNQPSTGTFTTPQKLDPIL

SEQ ID NO: 36196 - protein, 221 aa, Diabrotica virgifera
  misc_feature: Coding regions on vcDNA: vcDNA=SeqID_15893; Strand=+; Position=2-667
  misc_feature: Homolog annotation: Hit_ID=XP_392871.1; Match level="QueryCoverage =97%, HitCoverage=38%, E-value=1e-102, Identity=83%"; Hit description= similar to ENSANGP00000007148 [Apis mellifera]
  misc_feature: Gene Ontology Annotation: Molecular function=DNA binding; Cellular component=small nucleolar ribonucleoprotein complex; Biological process=regulation of transcription, DNA-dependent
  misc_feature: Pfam annotation: Pfam_ID=LSM; Match level="Score=78.4, E-value=2e-20, Copies=1"; Pfam description=LSM domain
NTVNKNIFIMTIGKNNKMVQHINFRVRVTLQDSRTFIGTFKAFDKHMNMILGDCEEFRKIKSKLSKVEREEKRVLGFVLLRGESIVSLTIEGPPPPEEGLPRVPIPGAAPGPGIGRAGGRGMPPGMAGVPVGLQGPVRGVGGPSQQVMTPGGRGQVSAPPQMNQGPPRMGGPPPGMMGPPPGMMGMAPQMGMGRGGPPPMGMRGPPPGMMRGGPPGPPRPF

SEQ ID NO: 36197 - protein, 108 aa, Diabrotica virgifera
  misc_feature: Coding regions on vcDNA: vcDNA=SeqID_15894; Strand=+; Position=550-876
VTKIDYILCILKHRKQNKDITIKILYVCSLVLVLHHSSSSSTLHRSIDDTNNEIMPVFFFIFYGFFLSLIHSGKKWSDGGYECIYCGITSVVSVAKRREISLFAGIST

SEQ ID NO: 36198 - protein, 74 aa, Diabrotica virgifera
  misc_feature: Coding regions on vcDNA: vcDNA=SeqID_15895; Strand=+; Position=121-345
HAHAVRDTTRKRYVNVAQTLNHTKTAAVERRYNYTPLEGTYTDGVLGILYKTTIKHILQQNIFSVRYGIPHVSG

SEQ ID NO: 36199 - protein, 203 aa, Diabrotica virgifera
  misc_feature: Coding regions on vcDNA: vcDNA=SeqID_15896; Strand=+; Position=97-708
  misc_feature: Pfam annotation: Pfam_ID=Myb_DNA-binding; Match level="Score=14.3, E -value=0.092, Copies=1"; Pfam description=Myb-like DNA-binding domain
  misc_feature (146)..(154): Xaa can be any naturally occurring amino acid
KDSRISKMASDWTTKEKHQLLIGLKQFGSKNLEALHKFVPTKTPIEIQLFCDDYAKAVLTKDEFEDKVPPIKKWLLVLKRLQHRKPDTVHDLIPRVLKYIALYEKRGGSKSLNLSQCYLALSTMCRGLETQPLDDNSEYFLYECLXXXXXXXXXSECKSYQKYIRSKATANGITSKEADDVLNPLGIPSSFTKGGNNAEVLQK

SEQ ID NO: 36200 - protein, 92 aa, Diabrotica virgifera
  misc_feature: Coding regions on vcDNA: vcDNA=SeqID_15897; Strand=+; Position=276-554
  misc_feature: Homolog annotation: Hit_ID=AAH63251.1; Match level="QueryCoverage =59%, HitCoverage=13%, E-value=3e-10, Identity=41%"; Hit description =Rnf26 protein [Mus musculus] ref|NP_717095.2| ring finger protein 26 [Mus musculus] dbj|BAC39357.1| unname
  misc_feature: Gene Ontology Annotation: Molecular function=molecular_function unknown; Cellular component=cellular_component unknown; Biological process=biological_process unknown
  misc_feature: Pfam annotation: Pfam_ID=zf-C3HC4; Match level="Score=8.2, E-value =0.0054, Copies=1"; Pfam description=Zinc finger, C3HC4 type (RING finger)
MNRRPEVRRSLVSPEIRRSFVGEATPNMPNKNDNIVVDERYCVICQERSKCILVLPCKHVCMCMECNAQLQLYHTTCPICRNDIESTMKIFV

SEQ ID NO: 36201 - protein, 151 aa, Diabrotica virgifera
  misc_feature: Coding regions on vcDNA: vcDNA=SeqID_15898; Strand=+; Position=433-885
MSYYFAMSLSTWSLPAKFTTFVDPIEKYLSHTRHEVGVSLREQIEEDLMTATEKRHSFESSAIDPVSFMYVDPYDVNPLSRSSDLPPATILADIPLKVESSVSQQSQFATGGGVFYVPPRRIKLEMEEFGDLSSFVSPQRIISNAVDELNT

SEQ ID NO: 36202 - protein, 28 aa, Diabrotica virgifera
  misc_feature: Coding regions on vcDNA: vcDNA=SeqID_15899; Strand=-; Position=1-84
  misc_feature (1)..(28): Xaa can be any naturally occurring amino acid
XXXXXXXXXXXXXXXXXXXXXXXXXXXX

SEQ ID NO: 36203 - protein, 299 aa, Diabrotica virgifera
  misc_feature: Coding regions on vcDNA: vcDNA=SeqID_15900; Strand=+; Position=2-900
  misc_feature: Homolog annotation: Hit_ID=XP_317372.1; Match level="QueryCoverage =100%, HitCoverage=25%, E-value=1e-93, Identity=57%"; Hit description= ENSANGP00000011596 [Anopheles gambiae]
  misc_feature: Gene Ontology Annotation: Molecular function=ATPase activity, coupled to transmembrane movement of ions, phosphorylative mechanism; Cellular component=membrane; Biological process=cell organization and biogenesis
  misc_feature (79)..(85): Xaa can be any naturally occurring amino acid
  misc_feature (281)..(281): Xaa can be any naturally occurring amino acid
NAFLRLIMPYITVYARFAPKQKEFVVTQLKHLGYVTLMCGDGTNDVGALKHADVGVAILANAPEKLPDPKVQKEKLEKXXXXXXXELKEAMSAQRPNHVRNMINQRDKLQSKVDKMMKEIEEDQTPIVKLGDASIASPFTSKLSSIMCICHIIKQGRCTLVTTLQMFKILALNALILAYTQSVLYLDGIKLRDAQATLQGLLVAACFLFISRSKPLKVLSKQRPLPNIFNLYTILTVITQFAVHFCCLIYLVQEAKLRSLPEDDPLKIEALDISDEEKEKXVKPNIVNSTVYIISMALK

SEQ ID NO: 36204 - protein, 257 aa, Diabrotica virgifera
  misc_feature: Coding regions on vcDNA: vcDNA=SeqID_15901; Strand=+; Position=45-815
  misc_feature: Homolog annotation: Hit_ID=XP_315228.1; Match level="QueryCoverage =92%, HitCoverage=36%, E-value=9e-91, Identity=71%"; Hit description =ENSANGP00000021580 [Anopheles gambiae]
  misc_feature: Gene Ontology Annotation: Molecular function=pyruvate kinase activity; Cellular component=cellular_component unknown; Biological process=glycolysis
  misc_feature: Pfam annotation: Pfam_ID=PK; Match level="Score=168.2, E-value=1.8e -47, Copies=1"; Pfam description=Pyruvate kinase, barrel domain
  misc_feature (19)..(19): Xaa can be any naturally occurring amino acid
  misc_feature (41)..(41): Xaa can be any naturally occurring amino acid
  misc_feature (49)..(49): Xaa can be any naturally occurring amino acid
  misc_feature (159)..(164): Xaa can be any naturally occurring amino acid
MKAIVRTGRMAQNVLPFQXLDHLCALDINSRASFIRLSGIXCTIVLNLXGPASRDPEILVQMMESGMNCARLNFSHGSHEYHAETIANIRKAVEMYSKKIGMPYPLAIALDTKGPEIRTGLLEGGGSAEVELVKGQTIKLTTDKAYESKGTKDCIYVDXXXXXXVVKAGNRVYVDDGLISLVVDSIQGSFLTCTVENGGTLGSRKGCNLPGVPVDLPAVSEKDKSDLRFGVEQKVDIVFASFIRDGGALTEIRNILG

SEQ ID NO: 36205 - protein, 248 aa, Diabrotica virgifera
  misc_feature: Coding regions on vcDNA: vcDNA=SeqID_15902; Strand=+; Position=1-744
  misc_feature (1)..(26): Xaa can be any naturally occurring amino acid
  misc_feature (28)..(213): Xaa can be any naturally occurring amino acid
  misc_feature (215)..(243): Xaa can be any naturally occurring amino acid
XXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXLFNCD

SEQ ID NO: 36206 - protein, 41 aa, Diabrotica virgifera
  misc_feature: Coding regions on vcDNA: vcDNA=SeqID_15903; Strand=-; Position=0-122
  misc_feature (1)..(40): Xaa can be any naturally occurring amino acid
XXXXXXXXXXXXXXXXXXXXXXXXXXXXXXXXXXXXXXXXP

SEQ ID NO: 36207 - protein, 80 aa, Diabrotica virgifera
  misc_feature: Coding regions on vcDNA: vcDNA=SeqID_15904; Strand=+; Position=376-615
SVFSLKEFDPILIFFIPISIFSFSISAVFLAIQFLIFSLTSLSSISGSSSISCKLMYISDFGRLIDTSSMISTSLLYPLY

SEQ ID NO: 36208 - protein, 79 aa, Diabrotica virgifera
  misc_feature: Coding regions on vcDNA: vcDNA=SeqID_15905; Strand=-; Position=2-238
  misc_feature (2)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
SXXXXXXXXXXXXPFXXXXXXXXXXXTNLAHTGLNXXXXXXXXSNXXXXXXXXXXXXXXPTSRSXXXXXXXXXXXXXXV

SEQ ID NO: 36209 - protein, 280 aa, Diabrotica virgifera
  misc_feature: Coding regions on vcDNA: vcDNA=SeqID_15906; Strand=+; Position=1-840
  misc_feature (1)..(278): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGA

SEQ ID NO: 36210 - protein, 73 aa, Diabrotica virgifera
  misc_feature: Coding regions on vcDNA: vcDNA=SeqID_15907; Strand=+; Position=51-272
CLKRRGLDKNYINIVRNLYWNQPAAVTLNGNITDAQHLSRVVRQGRVLSPLLFNVLCSEDLFTQALEHCTEGI

SEQ ID NO: 36211 - protein, 16 aa, Diabrotica virgifera
  misc_feature: Coding regions on vcDNA: vcDNA=SeqID_15908; Strand=-; Position=3-50
  misc_feature (2)..(12): Xaa can be any naturally occurring amino acid
IXXXXXXXXXXXFRRK

SEQ ID NO: 36212 - protein, 249 aa, Diabrotica virgifera
  misc_feature: Coding regions on vcDNA: vcDNA=SeqID_15909; Strand=+; Position=95-943
  misc_feature: Homolog annotation: Hit_ID=AAH78591.1; Match level="QueryCoverage =89%, HitCoverage=58%, E-value=5e-50, Identity=47%"; Hit description =MGC85519 protein [Xenopus laevis]
  misc_feature: Pfam annotation: Pfam_ID=HpcH_HpaI; Match level="Score=63.0, E-value =8.1e-16, Copies=1"; Pfam description=HpcH/HpaI aldolase/citrate lyase fami
  misc_feature (76)..(76): Xaa can be any naturally occurring amino acid
MASLVKSTYVRKIQLLKENILRTAVRNYKPRRALMYVPGNDLRKISKISSLNVDCIALDCEDGVAFNKKVWQTIKXQTIRDSLAQLVSNSEIKSDIGVRVNSIDSDMCEKDLEVCLSGKVLPHTVLLPKVEESDHLRWFSEKLDKSIQSSNKVNLIIYIESAKAFTNLTEICKTAVELSEKSKFVPNSLVFGSDDFCASIGATRTEDAIEVLYARQMLVLNAKAFNLQAIDMVYINYQDRGGLKRQSEQ

SEQ ID NO: 36213 - protein, 45 aa, Diabrotica virgifera
  misc_feature: Coding regions on vcDNA: vcDNA=SeqID_15910; Strand=-; Position=2-136
  misc_feature (16)..(22): Xaa can be any naturally occurring amino acid
  misc_feature (29)..(35): Xaa can be any naturally occurring amino acid
  misc_feature (40)..(45): Xaa can be any naturally occurring amino acid
RGPKRLVIFIILYRKXXXXXXXPQLNQFXXXXXXXLRQTXXXXXX

SEQ ID NO: 36214 - protein, 294 aa, Diabrotica virgifera
  misc_feature: Coding regions on vcDNA: vcDNA=SeqID_15911; Strand=-; Position=0-881
  misc_feature (2)..(9): Xaa can be any naturally occurring amino acid
  misc_feature (12)..(25): Xaa can be any naturally occurring amino acid
  misc_feature (31)..(44): Xaa can be any naturally occurring amino acid
  misc_feature (46)..(293): Xaa can be any naturally occurring amino acid
KXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 36215 - protein, 143 aa, Diabrotica virgifera
  misc_feature: Coding regions on vcDNA: vcDNA=SeqID_15912; Strand=-; Position=0-428
  misc_feature (55)..(74): Xaa can be any naturally occurring amino acid
  misc_feature (76)..(93): Xaa can be any naturally occurring amino acid
  misc_feature (104)..(112): Xaa can be any naturally occurring amino acid
  misc_feature (117)..(117): Xaa can be any naturally occurring amino acid
  misc_feature (120)..(120): Xaa can be any naturally occurring amino acid
  misc_feature (125)..(125): Xaa can be any naturally occurring amino acid
  misc_feature (129)..(129): Xaa can be any naturally occurring amino acid
  misc_feature (131)..(135): Xaa can be any naturally occurring amino acid
  misc_feature (137)..(137): Xaa can be any naturally occurring amino acid
YIFLVNLQFHPFSLFIIITKYPNNLIINTNNIIIYIQIINYYNLNNIYTKFNKYXXXXXXXXXXXXXXXXXXXXEXXXXXXXXXXXXXXXXXXPKNPTLLVPLXXXXXXXXXLSIKXKKXILSNXPTSXFXXXXXLXRPLEGG

SEQ ID NO: 36216 - protein, 124 aa, Diabrotica virgifera
  misc_feature: Coding regions on vcDNA: vcDNA=SeqID_15913; Strand=-; Position=89-463
  misc_feature (108)..(114): Xaa can be any naturally occurring amino acid
YILFYIIHIFLILDSHLFVFHLPTFIHYHNLSFLYRPYNFIYIPHAPYLLSSSSSKHTLHYLSVSLFYTLYTISLYFFPTIFFIIFFKLFSFTYHPSILSLFSISLFXXXXXXXHINNKLISLF

SEQ ID NO: 36217 - protein, 261 aa, Diabrotica virgifera
  misc_feature: Coding regions on vcDNA: vcDNA=SeqID_15914; Strand=+; Position=1-784
  misc_feature: Homolog annotation: Hit_ID=NP_647816.1; Match level="QueryCoverage =99%, HitCoverage=20%, E-value=3e-58, Identity=41%"; Hit description =CG11513-PA [Drosophila melanogaster] gb|AAF47775.1| CG11513-PA [Drosophila melanogaster]
  misc_feature: Gene Ontology Annotation: Molecular function=magnesium ion binding; Cellular component=intracellular; Biological process=negative regulation of cell cycle
  misc_feature (141)..(145): Xaa can be any naturally occurring amino acid
  misc_feature (248)..(248): Xaa can be any naturally occurring amino acid
KETIPDKLLPYCATAGLAREDTVVSEVNNPNGIQFGSNMSTLGRSRITVATCSCAGTFFQLSIPRGHFTHIVVDEAAQAGEPHVMIPLSFVNKNSGQIILAGDPMQLGPVILSKVATECGLAESYLERIMSRFPYCRDPEXXXXXSGFDPRFVTKLLYNYRALPDILTLYSTLFYHNELIPTIDDETSNEAKLLTSLQDFLPVKRDKLTRILFHGVIGENYQTADSPSWYNPQEVAQVFYYVNQFYRXGVKSGGIGIVPPL

SEQ ID NO: 36218 - protein, 306 aa, Diabrotica virgifera
  misc_feature: Coding regions on vcDNA: vcDNA=SeqID_15915; Strand=-; Position=3-920
  misc_feature (1)..(285): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKMKIFLYLLRRKIILLFGRE

SEQ ID NO: 36219 - protein, 61 aa, Diabrotica virgifera
  misc_feature: Coding regions on vcDNA: vcDNA=SeqID_15916; Strand=-; Position=223-408
ISSDVVVVGAFFPRSPQKCVIHRQCNSKCFLKSIVCSVHPVFKILCIIIICSFSVYHAVLC

SEQ ID NO: 36220 - protein, 299 aa, Diabrotica virgifera
  misc_feature: Coding regions on vcDNA: vcDNA=SeqID_15917; Strand=-; Position=1-897
  misc_feature (18)..(27): Xaa can be any naturally occurring amino acid
  misc_feature (34)..(299): Xaa can be any naturally occurring amino acid
RPPFKIEFIYVKLGLSLXXXXXXXXXXLYRGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36221 - protein, 55 aa, Diabrotica virgifera
  misc_feature: Coding regions on vcDNA: vcDNA=SeqID_15918; Strand=-; Position=428-595
GALKGFVISSYSQQEYLNRIISIRTLVLRTIRPCQVKRVYYLHIVLYYSAYNNNF

SEQ ID NO: 36222 - protein, 173 aa, Diabrotica virgifera
  misc_feature: Coding regions on vcDNA: vcDNA=SeqID_15919; Strand=-; Position=2-520
  misc_feature (7)..(173): Xaa can be any naturally occurring amino acid
MPNSCIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36223 - protein, 50 aa, Diabrotica virgifera
  misc_feature: Coding regions on vcDNA: vcDNA=SeqID_15920; Strand=+; Position=1-150
  misc_feature (1)..(21): Xaa can be any naturally occurring amino acid
  misc_feature (24)..(30): Xaa can be any naturally occurring amino acid
XXXXXXXXXXXXXXXXXXXXXEGXXXXXXXLYSLYQRNFISNATTGQIFF

SEQ ID NO: 36224 - protein, 90 aa, Diabrotica virgifera
  misc_feature: Coding regions on vcDNA: vcDNA=SeqID_15921; Strand=+; Position=2-274
  misc_feature (17)..(22): Xaa can be any naturally occurring amino acid
RVREISRGRTHGGPPIXXXXXXLSRFSGHSPTNSFFHLLSLNLHCVHRMGDNLSLTTRQPYLSSSSSSPKSELSILKRNNPAEIPGLLDL

SEQ ID NO: 36225 - protein, 247 aa, Diabrotica virgifera
  misc_feature: Coding regions on vcDNA: vcDNA=SeqID_15922; Strand=+; Position=51-794
  misc_feature: Homolog annotation: Hit_ID=XP_320214.1; Match level="QueryCoverage =96%, HitCoverage=60%, E-value=6e-65, Identity=50%"; Hit description =ENSANGP00000020041 [Anopheles gambiae]
  misc_feature: Pfam annotation: Pfam_ID=RWD; Match level="Score=104.3, E-value=3e -28, Copies=1"; Pfam description=RWD domain
  misc_feature (124)..(136): Xaa can be any naturally occurring amino acid
MSVNERVQEELEALEAILLDDISIVYDEQGRPELVKSTIFPSTANEVNKQYVRVTLEVRLPEDYPDCMPNVQLRNPRGLDDSTISEIYKSIGDKCAEYVGQPVIFELIELIRESLTESNLPTCXXXXXXXXXXXXXSFTKTECYHYFHSYCLHKHLVTTKRHYQEEQDKLPLWQKSTKGFQATCPVCRESINCDVEELKSALPPKDLENAQKFEVTSDLRILQEHMKELFTYQKSKGGIIDIEAEEK

SEQ ID NO: 36226 - protein, 137 aa, Diabrotica virgifera
  misc_feature: Coding regions on vcDNA: vcDNA=SeqID_15923; Strand=-; Position=0-410
  misc_feature (1)..(105): Xaa can be any naturally occurring amino acid
  misc_feature (107)..(136): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXG

SEQ ID NO: 36227 - protein, 118 aa, Diabrotica virgifera
  misc_feature: Coding regions on vcDNA: vcDNA=SeqID_15924; Strand=-; Position=105-461
  misc_feature (6)..(12): Xaa can be any naturally occurring amino acid
  misc_feature (37)..(46): Xaa can be any naturally occurring amino acid
TITTLXXXXXXXAVEPSIFWHTIMFIFLRLSVCLEYXXXXXXXXXXIDFIIINNIDLVIHSGKINGTPQKWYMPDVSNLPNPLSDLSDLLSIFFFFVCRACLQALAIVVFYIAFVSTL

SEQ ID NO: 36228 - protein, 187 aa, Diabrotica virgifera
  misc_feature: Coding regions on vcDNA: vcDNA=SeqID_15925; Strand=+; Position=10-573
  misc_feature (56)..(62): Xaa can be any naturally occurring amino acid
VKRELKEEGELDDSFIDSIISSEQSHIKNIKPDPDGPCDKIQTHSKGSTIDSGITXXXXXXXGLGKQKQEKEESKNEILNTPIKTEQFRDESNPSPFNKELFQNFTLHSPATKDWVELMEEEVRQNDRKRAVKRVFTEPIKEESSTSSSSSSSGEWKTGSGNSSNEELEVLPPGKKTRNELRTLNAK

SEQ ID NO: 36229 - protein, 130 aa, Diabrotica virgifera
  misc_feature: Coding regions on vcDNA: vcDNA=SeqID_15926; Strand=+; Position=1-393
  misc_feature: Homolog annotation: Hit_ID=XP_308415.1; Match level="QueryCoverage =94%, HitCoverage=25%, E-value=5e-47, Identity=71%"; Hit description =ENSANGP00000019149 [Anopheles gambiae]
  misc_feature: Gene Ontology Annotation: Molecular function=molecular_function unknown; Cellular component=cellular_component unknown; Biological process=biological_process unknown
AIQYCQIDSARIGGVNEILSVYLMAQKLGVKVCPHAGGVGLCEMVQHLQMWDYVSLSGTSEGKWVEYVDQQHEHFVHPTIIENAHYLAPRAPGYNTELKKEALEGYVYPNGKEWESMFAKGIFHDPRKAQ

SEQ ID NO: 36230 - protein, 253 aa, Diabrotica virgifera
  misc_feature: Coding regions on vcDNA: vcDNA=SeqID_15927; Strand=-; Position=1-759
  misc_feature (1)..(11): Xaa can be any naturally occurring amino acid
  misc_feature (15)..(251): Xaa can be any naturally occurring amino acid
XXXXXXXXXXXLHRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEV

SEQ ID NO: 36231 - protein, 237 aa, Diabrotica virgifera
  misc_feature: Coding regions on vcDNA: vcDNA=SeqID_15928; Strand=-; Position=3-713
MGSGAQGKEKISVKSEGRGAVMATRKISEGWFRPEIFDKSNSYGKHLSEGSSSPSPTRLEDKDQKLLPPSNGDFKPASPVFVNSPTDFLQFNYNNIRPNSENYHQNINLAQIHYANQNGNAPNQNVDNEYMRNVSENNHFNQHGYYDAPLRSPSILKTPLQELDFNPMDGLSPIYVNPYGQGLIPKPSFKGIVRTDSLSSNRELIQELRVRQSRFKKPNEKKDAESPYKECQNLEEI

SEQ ID NO: 36232 - protein, 59 aa, Diabrotica virgifera
  misc_feature: Coding regions on vcDNA: vcDNA=SeqID_15929; Strand=+; Position=3-182
  misc_feature (1)..(13): Xaa can be any naturally occurring amino acid
  misc_feature (17)..(30): Xaa can be any naturally occurring amino acid
XXXXXXXXXXXXXVSIXXXXXXXXXXXXXXGIQQRFFLLIIIEMSLCFIYIVSRDDSLI

SEQ ID NO: 36233 - protein, 67 aa, Diabrotica virgifera
  misc_feature: Coding regions on vcDNA: vcDNA=SeqID_15930; Strand=+; Position=142-345
CFFIFTTHPLPMMIYNVPKLLSYCKGHAATHLKPARDPLVVYWDSQHLLVRILLRARQFLLIFKCPW

SEQ ID NO: 36234 - protein, 111 aa, Diabrotica virgifera
  misc_feature: Coding regions on vcDNA: vcDNA=SeqID_15931; Strand=-; Position=1-333
  misc_feature (60)..(66): Xaa can be any naturally occurring amino acid
  misc_feature (79)..(79): Xaa can be any naturally occurring amino acid
  misc_feature (83)..(83): Xaa can be any naturally occurring amino acid
  misc_feature (90)..(92): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(105): Xaa can be any naturally occurring amino acid
  misc_feature (107)..(107): Xaa can be any naturally occurring amino acid
AASLRVVVHFFAFCRLSRGSFCFVLVILARCCPLTVLVYTVRRHSPTCGNSLAGRELTPXXXXXXXYSLSQYLLLFFFXSLSXSFFSSFXXXPPQKNSXFXXSYXRXLGAR

SEQ ID NO: 36235 - protein, 85 aa, Diabrotica virgifera
  misc_feature: Coding regions on vcDNA: vcDNA=SeqID_15932; Strand=+; Position=677-931
  misc_feature: Homolog annotation: Hit_ID=CAB62280.1; Match level="QueryCoverage =89%, HitCoverage=66%, E-value=5e-13, Identity=45%"; Hit description =hydroxyproline-rich glycoprotein DZ-HRGP [Volvox carteri f. nagariensis]
  misc_feature (22)..(22): Xaa can be any naturally occurring amino acid
  misc_feature (51)..(51): Xaa can be any naturally occurring amino acid
VIIHYLDNAGSMPPSPPNPPSXCPTTPPEPPSCPGLAPHPPPPQNPCPANXASPPLHPTSPFPLPINNPSSPSSPPQNPSPHTPH

SEQ ID NO: 36236 - protein, 63 aa, Diabrotica virgifera
  misc_feature: Coding regions on vcDNA: vcDNA=SeqID_15933; Strand=+; Position=601-792
  misc_feature (24)..(31): Xaa can be any naturally occurring amino acid
ILYTYLPSMPLNVTVFCLKLYVSXXXXXXXXNSMYLIMFLSGNCNITMLFPFFHVWGDVCKIN

SEQ ID NO: 36237 - protein, 135 aa, Diabrotica virgifera
  misc_feature: Coding regions on vcDNA: vcDNA=SeqID_15934; Strand=-; Position=2-406
  misc_feature (34)..(69): Xaa can be any naturally occurring amino acid
  misc_feature (73)..(82): Xaa can be any naturally occurring amino acid
  misc_feature (92)..(99): Xaa can be any naturally occurring amino acid
  misc_feature (102)..(115): Xaa can be any naturally occurring amino acid
  misc_feature (121)..(134): Xaa can be any naturally occurring amino acid
FVKTPAREFKILGTLIKNLCLPIHPSLTLVPLEXXXXXXXXXXXXXXXXXXXXXXXXXXXXXXXXXXXXPFVXXXXXXXXXXTNLAHTGLNXXXXXXXXSNXXXXXXXXXXXXXXPTSRSXXXXXXXXXXXXXXV

SEQ ID NO: 36238 - protein, 65 aa, Diabrotica virgifera
  misc_feature: Coding regions on vcDNA: vcDNA=SeqID_15935; Strand=+; Position=387-584
MHALSLCCWLTRGVDHRKSDRYPCWSTMAISFLFLAFLLPCSYSQSPMNRPCNPHTLASSERLFI

SEQ ID NO: 36239 - protein, 222 aa, Diabrotica virgifera
  misc_feature: Coding regions on vcDNA: vcDNA=SeqID_15936; Strand=-; Position=1-666
  misc_feature (22)..(222): Xaa can be any naturally occurring amino acid
GHAHTTPPVQSNQGGRRDFLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36240 - protein, 55 aa, Diabrotica virgifera
  misc_feature: Coding regions on vcDNA: vcDNA=SeqID_15937; Strand=-; Position=3-167
  misc_feature (12)..(20): Xaa can be any naturally occurring amino acid
  misc_feature (22)..(35): Xaa can be any naturally occurring amino acid
  misc_feature (42)..(54): Xaa can be any naturally occurring amino acid
IETNLAHHRFKXXXXXXXXXEXXXXXXXXXXXXXXSNIEVAXXXXXXXXXXXXXC

SEQ ID NO: 36241 - protein, 263 aa, Diabrotica virgifera
  misc_feature: Coding regions on vcDNA: vcDNA=SeqID_15938; Strand=-; Position=32-818
  misc_feature: Homolog annotation: Hit_ID=CAD22154.1; Match level="QueryCoverage =99%, HitCoverage=53%, E-value=2e-52, Identity=43%"; Hit description =pherophorin-dz1 protein [Volvox carteri f. nagariensis]
  misc_feature: Gene Ontology Annotation: Molecular function=protein binding; Cellular component=extracellular space; Biological process=actin filament-based process
  misc_feature (49)..(49): Xaa can be any naturally occurring amino acid
  misc_feature (66)..(66): Xaa can be any naturally occurring amino acid
  misc_feature (100)..(100): Xaa can be any naturally occurring amino acid
  misc_feature (120)..(120): Xaa can be any naturally occurring amino acid
  misc_feature (132)..(132): Xaa can be any naturally occurring amino acid
  misc_feature (148)..(148): Xaa can be any naturally occurring amino acid
  misc_feature (164)..(171): Xaa can be any naturally occurring amino acid
  misc_feature (174)..(181): Xaa can be any naturally occurring amino acid
  misc_feature (184)..(190): Xaa can be any naturally occurring amino acid
  misc_feature (228)..(233): Xaa can be any naturally occurring amino acid
  misc_feature (252)..(258): Xaa can be any naturally occurring amino acid
RPTPPTFPPSLYSQPPPKPPPPRASQSKAPLPPPLPLPSLTPLPPCCPXSPPFPSPPPPPFPPTSXPPDPPPPPPAAQTPPNLLPPPNPPAPFTSLPPSXPSPPPPQPTTPPYPLTTMTXSPPTSSLPLPPXLPPPSPPPRLPPPPPXTNPPSLTPRPGAPRAXXXXXXXXIQXXXXXXXXFSXXXXXXXLLPPYPLAPTPYTPTTPPPLLPPSPSSPPSLPSTPLPXXXXXXSHPPPPHPPSTLPPSPPPXXXXXXXAPPLL

SEQ ID NO: 36242 - protein, 134 aa, Diabrotica virgifera
  misc_feature: Coding regions on vcDNA: vcDNA=SeqID_15939; Strand=+; Position=419-822
  misc_feature: Homolog annotation: Hit_ID=CAA10770.1; Match level="QueryCoverage =82%, HitCoverage=32%, E-value=6e-14, Identity=33%"; Hit description =reverse transcriptase-like [Bos taurus]
  misc_feature (20)..(20): Xaa can be any naturally occurring amino acid
QHLTTCDIISLPLKMRLLKXLLFPVLLYGAEAWTIIETLMKKLEAFEMWVYLRILKISWATHTNIQVLRRMGKQKEISFTIKKRNLKYFGHIMSHDKYRILQLITQGKIESKRGPGRKDTHDLKLTPMIWTKID

SEQ ID NO: 36243 - protein, 90 aa, Diabrotica virgifera
  misc_feature: Coding regions on vcDNA: vcDNA=SeqID_15940; Strand=-; Position=361-633
FMKKLKIINSHNQDISKRIKLYKCWKITINSCRLYKKIYIENKSIQNIMSYKLIQKQNTNAKPSQTKNCDNKRRSCTRQMSPKLFTIHTN

SEQ ID NO: 36244 - protein, 126 aa, Diabrotica virgifera
  misc_feature: Coding regions on vcDNA: vcDNA=SeqID_15941; Strand=-; Position=269-649
LCCKKDLFVINYGSIGSSHIFGNLKLIFVNIQFVMKYAEPVSCTISFSIVTFFDGVYGYLMVVSSIFDERSNCSSGQARSFFLIHKRLFRRDRRGYCRGHLRVVRHRNPISSQHHYFVQHLYLYLH

SEQ ID NO: 36245 - protein, 73 aa, Diabrotica virgifera
  misc_feature: Coding regions on vcDNA: vcDNA=SeqID_15942; Strand=-; Position=91-312
  misc_feature (62)..(68): Xaa can be any naturally occurring amino acid
SASLHLYQPNHLLVSQLNCMNIGSILAIIISKNTNHINEEKERHQKSFFYTLKLLKHNYYLXXXXXXXVVFHS

SEQ ID NO: 36246 - protein, 139 aa, Diabrotica virgifera
  misc_feature: Coding regions on vcDNA: vcDNA=SeqID_15943; Strand=+; Position=21-440
  misc_feature: Homolog annotation: Hit_ID=XP_394244.1; Match level="QueryCoverage =73%, HitCoverage=56%, E-value=4e-29, Identity=61%"; Hit description =similar to Transcription factor 21 (Podocyte-expressed 1) (Pod-1) (Epicardin) (Capsulin) [Apis
  misc_feature: Gene Ontology Annotation: Molecular function=transcription factor activity; Biological process=embryonic development
  misc_feature: Pfam annotation: Pfam_ID=HLH; Match level="Score=74.0, E-value=4e-19, Copies=1"; Pfam description=Helix-loop-helix DNA-binding domain
MPRKRRSQDTDSEDEHDDSRRPQRNAANERERARMRVLSKAFCRLKTTLPWVPADTKLSKLDTLRLATSYIAHLRAILMDEPVSGDNLPKHPLTLTWPFTFQRCPDSTTDVVDERDQHVWAHEGPIQSIIREKDISYFY

SEQ ID NO: 36247 - protein, 85 aa, Diabrotica virgifera
  misc_feature: Coding regions on vcDNA: vcDNA=SeqID_15944; Strand=-; Position=195-452
  misc_feature (60)..(65): Xaa can be any naturally occurring amino acid
KPVMASIGRQMYRHLKKVLKYLVGLKYYPASGATVKYRMLSEPTSGRWWRILFKRHPRSXXXXXXAFSEAGYDIKREINESYQVL

SEQ ID NO: 36248 - protein, 152 aa, Diabrotica virgifera
  misc_feature: Coding regions on vcDNA: vcDNA=SeqID_15945; Strand=-; Position=1-456
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(148): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXRTRR

SEQ ID NO: 36249 - protein, 102 aa, Diabrotica virgifera
  misc_feature: Coding regions on vcDNA: vcDNA=SeqID_15946; Strand=+; Position=2-307
  misc_feature (3)..(38): Xaa can be any naturally occurring amino acid
  misc_feature (40)..(67): Xaa can be any naturally occurring amino acid
  misc_feature (88)..(94): Xaa can be any naturally occurring amino acid
LKXXXXXXXXXXXXXXXXXXXXXXXXXXXXXXXXXXXXGXXXXXXXXXXXXXXXXXXXXXXXXXXXXHKHYLKGKTAEFFFGQASTRXXXXXXXPPRGRAIK

SEQ ID NO: 36250 - protein, 103 aa, Diabrotica virgifera
  misc_feature: Coding regions on vcDNA: vcDNA=SeqID_15947; Strand=+; Position=7-318
TFLHARRKNIIQTVENIYSHNGKLTQFIPVQSGVRQGDSLSPLLFNIIMDEIIEAVRQGHGYRMGNKEIQILCYAGDAALIAETEDDLQRLTHIFNTTATVCR

SEQ ID NO: 36251 - protein, 200 aa, Diabrotica virgifera
  misc_feature: Coding regions on vcDNA: vcDNA=SeqID_15948; Strand=+; Position=3-601
  misc_feature: Homolog annotation: Hit_ID=B47757; Match level="QueryCoverage=98%, HitCoverage=48%, E-value=3e-55, Identity=48%"; Hit description =retrovirus-related reverse transcriptase homolog (clone Pj19) - Japanese beetle
  misc_feature (18)..(18): Xaa can be any naturally occurring amino acid
  misc_feature (169)..(177): Xaa can be any naturally occurring amino acid
SRVRPTREGGLGVLSWSXHVPAILRRRLTKLMISATQTIADILSLPYMSRFWEKLVKWTSNNGGSSASIARELSAKLEIGYSGNGLAQGSCHPESSAWIHNPPPYWSGRDYVFFIQLRGNLLPTKGIPSNPPQERMCRTGCGRSESLSHVLQKCSKAHWQRCRRHDQLXXXXXXXXXRKGWICQVEPRITLGHASLKNPD

SEQ ID NO: 36252 - protein, 220 aa, Diabrotica virgifera
  misc_feature: Coding regions on vcDNA: vcDNA=SeqID_15949; Strand=-; Position=8-670
  misc_feature (37)..(217): Xaa can be any naturally occurring amino acid
NHITRYHKLYTLQHHRGRNLYYRFELCNKITLLCLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTR

SEQ ID NO: 36253 - protein, 70 aa, Diabrotica virgifera
  misc_feature: Coding regions on vcDNA: vcDNA=SeqID_15950; Strand=-; Position=2-211
  misc_feature (56)..(68): Xaa can be any naturally occurring amino acid
AKSFSISSSSYSFPSFSTSSFRIRHTVHNIKEMFINIIYTLSIFIYLFLITKALFXXXXXXXXXXXXXLE

SEQ ID NO: 36254 - protein, 273 aa, Diabrotica virgifera
  misc_feature: Coding regions on vcDNA: vcDNA=SeqID_15951; Strand=-; Position=1-819
  misc_feature (5)..(19): Xaa can be any naturally occurring amino acid
  misc_feature (25)..(232): Xaa can be any naturally occurring amino acid
  misc_feature (235)..(249): Xaa can be any naturally occurring amino acid
  misc_feature (257)..(270): Xaa can be any naturally occurring amino acid
KNLNXXXXXXXXXXXXXXXQFFFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXYELTMLRXXXXXXXXXXXXXXKRN

SEQ ID NO: 36255 - protein, 238 aa, Diabrotica virgifera
  misc_feature: Coding regions on vcDNA: vcDNA=SeqID_15952; Strand=+; Position=69-782
  misc_feature: Homolog annotation: Hit_ID=NP_524654.2; Match level="QueryCoverage =99%, HitCoverage=49%, E-value=3e-62, Identity=47%"; Hit description =CG5836-PA [Drosophila melanogaster] gb|AAF55430.3| CG5836-PA [Drosophila melanogaster]
  misc_feature: Gene Ontology Annotation: Molecular function=RNA binding; Cellular component=nucleoplasm; Biological process=mRNA splicing
  misc_feature (153)..(153): Xaa can be any naturally occurring amino acid
  misc_feature (232)..(232): Xaa can be any naturally occurring amino acid
MGSSRRRDRSRSRDRRDRSRSRDRDRDRRDRKRSRSRDRYRDRDRRRDRSRSRDRDRERRRERERSITPPEPDGDKMIADTLATLAATRNFASLISKEGDGNSNMSTESSDDERRRKRRSRWGGSEHEKIFIPGMPTILPQNLNKEQEEAYLXSPSPEPIYSSDGKRLNTREFRTRKRLEEDRHTLVLRMQSINPEFKPPLDYKPPVTRVSDKVMIPQEEHSEINFVGLFIXPRGNTL

SEQ ID NO: 36256 - protein, 119 aa, Diabrotica virgifera
  misc_feature: Coding regions on vcDNA: vcDNA=SeqID_15953; Strand=-; Position=0-356
  misc_feature (5)..(106): Xaa can be any naturally occurring amino acid
  misc_feature (109)..(118): Xaa can be any naturally occurring amino acid
LPPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPXXXXXXXXXXL

SEQ ID NO: 36257 - protein, 36 aa, Diabrotica virgifera
  misc_feature: Coding regions on vcDNA: vcDNA=SeqID_15954; Strand=-; Position=1-108
QRCSSFFSLVLIVDIATPCGPGSSLVPFLLGSGPGG

SEQ ID NO: 36258 - protein, 81 aa, Diabrotica virgifera
  misc_feature: Coding regions on vcDNA: vcDNA=SeqID_15955; Strand=-; Position=338-583
YLVVPYILYLVGMAVVDKTPVFGYTVFYLRFNLPVITGQKTGCSKNRCSVFFSQSQYPRVYIYIALQCAILHSKGYQSISV

SEQ ID NO: 36259 - protein, 233 aa, Diabrotica virgifera
  misc_feature: Coding regions on vcDNA: vcDNA=SeqID_15956; Strand=-; Position=206-907
  misc_feature (5)..(14): Xaa can be any naturally occurring amino acid
  misc_feature (34)..(214): Xaa can be any naturally occurring amino acid
QSNLXXXXXXXXXXDYVTFARVKIPRPFKFIQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRINYLRDNSVILLESSNR

SEQ ID NO: 36260 - protein, 33 aa, Diabrotica virgifera
  misc_feature: Coding regions on vcDNA: vcDNA=SeqID_15957; Strand=-; Position=3-101
SVKKLMINSTLRRQDRGAFKFIRGQGGDFIFIQ

SEQ ID NO: 36261 - protein, 84 aa, Diabrotica virgifera
  misc_feature: Coding regions on vcDNA: vcDNA=SeqID_15958; Strand=-; Position=1-252
  misc_feature (1)..(84): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36262 - protein, 72 aa, Diabrotica virgifera
  misc_feature: Coding regions on vcDNA: vcDNA=SeqID_15959; Strand=+; Position=15-233
  misc_feature (31)..(37): Xaa can be any naturally occurring amino acid
SCLNGIEMDCGNFVMTALHNYRVSNSYYITXXXXXXXRCLTIKLVKNLDLFIHLHYLILSNRILNLVYHNSL

SEQ ID NO: 36263 - protein, 24 aa, Diabrotica virgifera
  misc_feature: Coding regions on vcDNA: vcDNA=SeqID_15960; Strand=-; Position=0-71
YLMHFGTCITNIKQVHSTFIVRMR

SEQ ID NO: 36264 - protein, 272 aa, Diabrotica virgifera
  misc_feature: Coding regions on vcDNA: vcDNA=SeqID_15961; Strand=-; Position=8-826
  misc_feature (3)..(19): Xaa can be any naturally occurring amino acid
  misc_feature (26)..(32): Xaa can be any naturally occurring amino acid
  misc_feature (52)..(270): Xaa can be any naturally occurring amino acid
FLXXXXXXXXXXXXXXXXXPFIPPSXXXXXXXCLARSKSRGIQINRGQANFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRP

SEQ ID NO: 36265 - protein, 147 aa, Diabrotica virgifera
  misc_feature: Coding regions on vcDNA: vcDNA=SeqID_15962; Strand=-; Position=31-474
  misc_feature: Homolog annotation: Hit_ID=XP_309979.1; Match level="QueryCoverage =90%, HitCoverage=24%, E-value=3e-33, Identity=44%"; Hit description =ENSANGP00000015940 [Anopheles gambiae]
  misc_feature (78)..(83): Xaa can be any naturally occurring amino acid
HGVLYCGKERQKNDCKQHKKHCKPFKVCTDDVLGRHLKATKDLKPGDVIIQENPLIWGPAISTVPVCLGCGQEVNERXXXXXXKCGWPMCSDLCEKAPAHIPECRYTFLRGDKVSIKNFGITHPNYQCITVLRILYQKQFLPDKGKR

SEQ ID NO: 36266 - protein, 213 aa, Diabrotica virgifera
  misc_feature: Coding regions on vcDNA: vcDNA=SeqID_15963; Strand=+; Position=41-683
  misc_feature: Homolog annotation: Hit_ID=CAA10770.1; Match level="QueryCoverage =76%, HitCoverage=48%, E-value=5e-14, Identity=29%"; Hit description =reverse transcriptase-like [Bos taurus]
  misc_feature (56)..(63): Xaa can be any naturally occurring amino acid
  misc_feature (207)..(207): Xaa can be any naturally occurring amino acid
SEKRQRRTANFHIAIARKYTSTDITETATVRPIETFCYARLSDQSSFKPTLFKFYXXXXXXXXFRKCKKMGVQMEEGNLTTLLFADDEVVLAEITEDAAYIVRKLIEEYEDWGLEINTNKTEYMTIGCTGEDLNLEGKIIKNTKGYKYLGVTFTEYGNDETDIQQKLGRGRAMSSQINSLLWSKDIRESTKKQLYKTFIESIVTYGXKSWTIN

SEQ ID NO: 36267 - protein, 61 aa, Diabrotica virgifera
  misc_feature: Coding regions on vcDNA: vcDNA=SeqID_15964; Strand=+; Position=151-336
NGVHLSLSREEQVEETEFVDNLATLKYSDESSEIMADLALYWSKKGYFEKPYVVKSIEKLD

SEQ ID NO: 36268 - protein, 173 aa, Diabrotica virgifera
  misc_feature: Coding regions on vcDNA: vcDNA=SeqID_15965; Strand=+; Position=2-520
  misc_feature (1)..(148): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFYSEINLNDLNLAIDDNIRINTLH

SEQ ID NO: 36269 - protein, 216 aa, Diabrotica virgifera
  misc_feature: Coding regions on vcDNA: vcDNA=SeqID_15966; Strand=+; Position=3-650
  misc_feature (1)..(16): Xaa can be any naturally occurring amino acid
  misc_feature (19)..(198): Xaa can be any naturally occurring amino acid
  misc_feature (213)..(216): Xaa can be any naturally occurring amino acid
XXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLISLFSINTIYIIXXXX

SEQ ID NO: 36270 - protein, 79 aa, Diabrotica virgifera
  misc_feature: Coding regions on vcDNA: vcDNA=SeqID_15967; Strand=-; Position=373-612
MCGGHHMAECLGCPVFRNKGGSNDILSMMGEPDRLSYCSKFCPRSSRKENYFGTNYFNHLTYVCRSKLVSTSFSFVFFP

SEQ ID NO: 36271 - protein, 22 aa, Diabrotica virgifera
  misc_feature: Coding regions on vcDNA: vcDNA=SeqID_15968; Strand=-; Position=1-66
  misc_feature (10)..(16): Xaa can be any naturally occurring amino acid
  misc_feature (18)..(22): Xaa can be any naturally occurring amino acid
INKLNLEKDXXXXXXXSXXXXX

SEQ ID NO: 36272 - protein, 59 aa, Diabrotica virgifera
  misc_feature: Coding regions on vcDNA: vcDNA=SeqID_15969; Strand=-; Position=399-578
LMFAIFKILLFLNLFCIHQCCLPYREHCYHSDKGEEYSRELRANRIKLKNITDVFQYVL

SEQ ID NO: 36273 - protein, 282 aa, Diabrotica virgifera
  misc_feature: Coding regions on vcDNA: vcDNA=SeqID_15970; Strand=+; Position=1-846
  misc_feature (1)..(267): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLQLTYITNLFNRGG

SEQ ID NO: 36274 - protein, 25 aa, Diabrotica virgifera
  misc_feature: Coding regions on vcDNA: vcDNA=SeqID_15971; Strand=-; Position=1-75
  misc_feature (1)..(23): Xaa can be any naturally occurring amino acid
XXXXXXXXXXXXXXXXXXXXXXXLY

SEQ ID NO: 36275 - protein, 193 aa, Diabrotica virgifera
  misc_feature: Coding regions on vcDNA: vcDNA=SeqID_15972; Strand=-; Position=1-579
  misc_feature (13)..(45): Xaa can be any naturally occurring amino acid
  misc_feature (53)..(59): Xaa can be any naturally occurring amino acid
  misc_feature (62)..(107): Xaa can be any naturally occurring amino acid
  misc_feature (110)..(116): Xaa can be any naturally occurring amino acid
  misc_feature (173)..(173): Xaa can be any naturally occurring amino acid
  misc_feature (179)..(187): Xaa can be any naturally occurring amino acid
IYNSLILILSSLXXXXXXXXXXXXXXXXXXXXXXXXXXXXXXXXXNFLILILXXXXXXXRDXXXXXXXXXXXXXXXXXXXXXXXXXXXXXXXXXXXXXXXXXXXXXXQQXXXXXXXYNKLLAFFALFRSALLPLFLFFLVPCFPWSAGWCSSRENSLFSPPSLLLSFPPLFLXWGPTRXXXXXXXXXRGPCRT

SEQ ID NO: 36276 - protein, 235 aa, Diabrotica virgifera
  misc_feature: Coding regions on vcDNA: vcDNA=SeqID_15973; Strand=+; Position=193-900
  misc_feature: Homolog annotation: Hit_ID=AAH41271.1; Match level="QueryCoverage =100%, HitCoverage=84%, E-value=1e-68, Identity=51%"; Hit description= MGC52847 protein [Xenopus laevis]
  misc_feature: Gene Ontology Annotation: Molecular function=molecular_function unknown; Cellular component=exosome (RNase complex); Biological process=rRNA processing
  misc_feature: Pfam annotation: Pfam_ID=RNase_PH; Match level="Score=77.3, E-value =4.2e-20, Copies=1"; Pfam description=3' exoribonuclease family, domain 1
MAQQYKSLHPVKYYRDYLAHEIRPDGREFNKFRPILLNVGTIDTADGSAIAKVGNTTVVCGIKAELCKPKADAPDKGFLVPNLELTPLCSSKFRPGPPSDQAQVLTQLIAEIIDNSKCINLKDLCICNDKLAWCLYVDFVCLDFDGSVVDTCLVSFLGAIKSITLPFIDYDPALDNIQVNLEERKHIEIYNTPVSTTFAVFDDKVILKDPTLEERSLCSGILTIVFKDEEVVLCS

SEQ ID NO: 36277 - protein, 98 aa, Diabrotica virgifera
  misc_feature: Coding regions on vcDNA: vcDNA=SeqID_15974; Strand=+; Position=2-295
HWGRVDKERYEETPPKTHQKNRKSRKTENKRRKHTKKISPEARENPRKKQEAHNQQARTKENTETTDKMEKETRNRQTQERKAKQSETHRPKHKRNKN

SEQ ID NO: 36278 - protein, 349 aa, Diabrotica virgifera
  misc_feature: Coding regions on vcDNA: vcDNA=SeqID_15975; Strand=-; Position=0-1046
  misc_feature (11)..(17): Xaa can be any naturally occurring amino acid
  misc_feature (22)..(41): Xaa can be any naturally occurring amino acid
  misc_feature (43)..(347): Xaa can be any naturally occurring amino acid
KKKSPGAFLLXXXXXXXQKNLXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRG

SEQ ID NO: 36279 - protein, 66 aa, Diabrotica virgifera; identical to SEQ ID NO: 26808
  misc_feature: Coding regions on vcDNA: vcDNA=SeqID_15976; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36280 - protein, 61 aa, Diabrotica virgifera
  misc_feature: Coding regions on vcDNA: vcDNA=SeqID_15977; Strand=+; Position=3-188
  misc_feature (1)..(38): Xaa can be any naturally occurring amino acid
  misc_feature (43)..(53): Xaa can be any naturally occurring amino acid
XXXXXXXXXXXXXXXXXXXXXXXXXXXXXXXXXXXXXXEDPLXXXXXXXXXXXKLIIKQFY

SEQ ID NO: 36281 - protein, 120 aa, Diabrotica virgifera
  misc_feature: Coding regions on vcDNA: vcDNA=SeqID_15978; Strand=-; Position=467-829
  misc_feature (86)..(99): Xaa can be any naturally occurring amino acid
NYVVPRRYITPLIRMKFGHACFPLHLARIKVFDSNLCTECQKVGDLNHTFFEYTKYIPYTYNLIEDLIKCNVFPPFNVSYLLSLNXXXXXXXXXXXXXXHIYTHIYDCLMKFISETKINL

SEQ ID NO: 36282 - protein, 107 aa, Diabrotica virgifera
  misc_feature: Coding regions on vcDNA: vcDNA=SeqID_15979; Strand=-; Position=2-322
  misc_feature (7)..(19): Xaa can be any naturally occurring amino acid
  misc_feature (28)..(38): Xaa can be any naturally occurring amino acid
  misc_feature (42)..(50): Xaa can be any naturally occurring amino acid
  misc_feature (52)..(107): Xaa can be any naturally occurring amino acid
FQKKWLXXXXXXXXXXXXXESFFVAARXXXXXXXXXXXPKKXXXXXXXXXYXXXXXXXXXXXXXXXXXXXXXXXXXXXXXXXXXXXXXXXXXXXXXXXXXXXXXXXX

SEQ ID NO: 36283 - protein, 261 aa, Diabrotica virgifera
  misc_feature: Coding regions on vcDNA: vcDNA=SeqID_15980; Strand=+; Position=51-833
  misc_feature: Homolog annotation: Hit_ID=NP_651887.1; Match level="QueryCoverage =98%, HitCoverage=94%, E-value=5e-86, Identity=55%"; Hit description =CG2245-PA [Drosophila melanogaster] gb|AAF57189.1| CG2245-PA [Drosophila melanogaster]
  misc_feature: Gene Ontology Annotation: Molecular function=molecular_function unknown; Cellular component=cellular_component unknown; Biological process=positive regulation of body size
  misc_feature: Pfam annotation: Pfam_ID=HEAT_PBS; Match level="Score=91.1, E-value =2.9e-24, Copies=5"; Pfam description=PBS lyase HEAT-like repeat
  misc_feature (251)..(251): Xaa can be any naturally occurring amino acid
MVNVNENQIRNIGKVLNDSSRPLKERFRALFTLRNIGGEISIQCIASCFSDSSVLLKHELAYCLGQMQDEKANPILTQILEDVKQEPMVRHEAGEALGAIGSIENIKILEKYKNDPVVEVAETCQLALDRIKWLQSQKQDEKLSANPYNSVDPAPPCQDTDVPALKKVLLDENASLFERYRAMFSLRNLQTTESIDALGTALQHGSALFKHEIAFVLGQLQDERATKYLRQSLEDSLENEMVRHECAEALXAIATEECTEI

SEQ ID NO: 36284 - protein, 159 aa, Diabrotica virgifera
  misc_feature: Coding regions on vcDNA: vcDNA=SeqID_15981; Strand=-; Position=0-476
  misc_feature (1)..(20): Xaa can be any naturally occurring amino acid
  misc_feature (23)..(33): Xaa can be any naturally occurring amino acid
  misc_feature (43)..(50): Xaa can be any naturally occurring amino acid
  misc_feature (53)..(66): Xaa can be any naturally occurring amino acid
  misc_feature (72)..(85): Xaa can be any naturally occurring amino acid
  misc_feature (87)..(143): Xaa can be any naturally occurring amino acid
  misc_feature (145)..(155): Xaa can be any naturally occurring amino acid
XXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXRXXXXXXXXXXXTRGG

SEQ ID NO: 36285 - protein, 100 aa, Diabrotica virgifera
  misc_feature: Coding regions on vcDNA: vcDNA=SeqID_15982; Strand=-; Position=1-300
  misc_feature (5)..(100): Xaa can be any naturally occurring amino acid
KKFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36286 - protein, 77 aa, Diabrotica virgifera
  misc_feature: Coding regions on vcDNA: vcDNA=SeqID_15983; Strand=-; Position=2-232
  misc_feature (63)..(69): Xaa can be any naturally occurring amino acid
KGFHPSTLILWKICKAAPILDPYFSDPIRYRAIDRRSYTEQLDVGRYRIGEIRIQCRCNLIRXXXXXXXTFRVRSIS

SEQ ID NO: 36287 - protein, 177 aa, Diabrotica virgifera
  misc_feature: Coding regions on vcDNA: vcDNA=SeqID_15984; Strand=+; Position=640 -1170
  misc_feature (11)..(27): Xaa can be any naturally occurring amino acid
  misc_feature (29)..(63): Xaa can be any naturally occurring amino acid
  misc_feature (66)..(81): Xaa can be any naturally occurring amino acid
  misc_feature (85)..(170): Xaa can be any naturally occurring amino acid
KKCCRIPLLNXXXXXXXXXXXXXXXXXYXXXXXXXXXXXXXXXXXXXXXXXXXXXXXXXXXXXFYXXXXXXXXXXXXXXXXSSPXXXXXXXXXXXXXXXXXXXXXXXXXXXXXXXXXXXXXXXXXXXXXXXXXXXXXXXXXXXXXXXXXXXXXXXXXXXXXXXXXXXXXXGENPTEG

SEQ ID NO: 36288 - protein, 49 aa, Diabrotica virgifera
  misc_feature: Coding regions on vcDNA: vcDNA=SeqID_15985; Strand=+; Position=1-150
  misc_feature (1)..(46): Xaa can be any naturally occurring amino acid
XXXXXXXXXXXXXXXXXXXXXXXXXXXXXXXXXXXXXXXXXXXXXXSLF

SEQ ID NO: 36289 - protein, 142 aa, Diabrotica virgifera
  misc_feature: Coding regions on vcDNA: vcDNA=SeqID_15986; Strand=+; Position=310-738
  misc_feature (5)..(12): Xaa can be any naturally occurring amino acid
  misc_feature (20)..(34): Xaa can be any naturally occurring amino acid
  misc_feature (45)..(60): Xaa can be any naturally occurring amino acid
  misc_feature (62)..(139): Xaa can be any naturally occurring amino acid
QDIYXXXXXXXXHHIFFRHXXXXXXXXXXXXXXXIRIKNFHILKXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXFFY

SEQ ID NO: 36290 - protein, 114 aa, Diabrotica virgifera
  misc_feature: Coding regions on vcDNA: vcDNA=SeqID_15987; Strand=+; Position=89-436
  misc_feature: Homolog annotation: Hit_ID=XP_395589.1; Match level="QueryCoverage =78%, HitCoverage=34%, E-value=1e-20, Identity=52%"; Hit description =similar to ENSANGP00000010118 [Apis mellifera]
  misc_feature: Gene Ontology Annotation: Molecular function=ubiquitin-protein ligase activity; Biological process=ubiquitin-dependent protein catabolism
  misc_feature (46)..(46): Xaa can be any naturally occurring amino acid
  misc_feature (65)..(65): Xaa can be any naturally occurring amino acid
  misc_feature (89)..(89): Xaa can be any naturally occurring amino acid
MKITILILSTLIYSVHNYNGLIDCPMGSQTQPTPKISQALETSSKXIRNDLPEITLDPPPNCNRXPKGENFYECDSSILDPPVSVYDIXIFLLYIHLSPEYHSIPIYNCYINSL

SEQ ID NO: 36291 - protein, 58 aa, Diabrotica virgifera
  misc_feature: Coding regions on vcDNA: vcDNA=SeqID_15988; Strand=+; Position=200-376
YVYHYHEHFVHPTIIDNVHYLTPRPPGYNTQLKKEALEFYIYPIGKECKSMVAKLILP

SEQ ID NO: 36292 - protein, 148 aa, Diabrotica virgifera
  misc_feature: Coding regions on vcDNA: vcDNA=SeqID_15989; Strand=+; Position=9-452
  misc_feature: Homolog annotation: Hit_ID=NP_503386.1; Match level="QueryCoverage =91%, HitCoverage=89%, E-value=8e-43, Identity=72%"; Hit description =calmodulin (16.8 kD) (cmd-1) [Caenorhabditis elegans] gb|AAB65364.1| Calmodulin protein 1
  misc_feature: Gene Ontology Annotation: Molecular function=calcium ion binding
  misc_feature: Pfam annotation: Pfam_ID=efhand; Match level="Score=47.4, E-value=4e -11, Copies=2"; Pfam description=EF hand
  misc_feature (73)..(73): Xaa can be any naturally occurring amino acid
  misc_feature (78)..(78): Xaa can be any naturally occurring amino acid
  misc_feature (85)..(85): Xaa can be any naturally occurring amino acid
  misc_feature (95)..(95): Xaa can be any naturally occurring amino acid
  misc_feature (100)..(100): Xaa can be any naturally occurring amino acid
  misc_feature (118)..(118): Xaa can be any naturally occurring amino acid
  misc_feature (136)..(136): Xaa can be any naturally occurring amino acid
MTNSHVIKNCNSNEDFSLFDKDGDGTITTNELGTEMMSLGQNPTEVELQDMIIVEDADGNETIDFPEFLKMMXRIMKXDTDSEEXIREVFREIDXKTIKXFISLEELSHVMTKLDEKXTDEEDDEMIRKDDIDGDXVNYYQIVTMVTT

SEQ ID NO: 36293 - protein, 178 aa, Diabrotica virgifera
  misc_feature: Coding regions on vcDNA: vcDNA=SeqID_15990; Strand=+; Position=1-537
  misc_feature (3)..(3): Xaa can be any naturally occurring amino acid
  misc_feature (5)..(165): Xaa can be any naturally occurring amino acid
SLXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNFVLKYTLKSFNT

SEQ ID NO: 36294 - protein, 91 aa, Diabrotica virgifera
  misc_feature: Coding regions on vcDNA: vcDNA=SeqID_15991; Strand=-; Position=2-274
SLCCTLHGHNTAFIPYFSAGLSAHIHYLMLVRHLISLQVKLMMTAFPSYQSYKKNPFSFSVLLLASFPRRLLAVGKKRAIPLRMLINRTLG

SEQ ID NO: 36295 - protein, 89 aa, Diabrotica virgifera
  misc_feature: Coding regions on vcDNA: vcDNA=SeqID_15992; Strand=+; Position=107-376
SMLRETHPPTKIRQRLPLWLQLPHRTSLRLHQRIRQRRLQIQRFTEVYEQSLRRDQKVVAEIVMNTRWLIFSVLPSTPNCTYLPSIPSN

SEQ ID NO: 36296 - protein, 68 aa, Diabrotica virgifera
  misc_feature: Coding regions on vcDNA: vcDNA=SeqID_15993; Strand=+; Position=426-632
  misc_feature (48)..(57): Xaa can be any naturally occurring amino acid
LSSTKNCNFCCCILTVSNREWYVGRKNLSSVCISYKICVQLKSTGQQXXXXXXXXXXQQLLNKYTTTI

SEQ ID NO: 36297 - protein, 163 aa, Diabrotica virgifera
  misc_feature: Coding regions on vcDNA: vcDNA=SeqID_15994; Strand=+; Position=300-791
  misc_feature: Homolog annotation: Hit_ID=EAA46045.1; Match level="QueryCoverage =93%, HitCoverage=88%, E-value=6e-72, Identity=83%"; Hit description =CG40451-PA.3 [Drosophila melanogaster]
  misc_feature: Gene Ontology Annotation: Molecular function=protein transporter activity; Cellular component=mitochondrial inner membrane pre -sequence translocase complex; Biological process=mitochondrial inner membrane protein import
  misc_feature: Pfam annotation: Pfam_ID=Tim17; Match level="Score=207.3, E-value =3.1e-59, Copies=1"; Pfam description=Tim17/Tim22/Tim23 family
MEEYTREPCPWRIVDDCGGAFTMGLIGGGVFQSIKGFRNAPSGINRRLIGSVTAIKQGSPIIAGNFAVWGGMFSTIDCALIHIRKKEDPWNSIISGAATGGILAARNGLPAMAGSAFIGGVLLALIEGVGILFTRLSAEQFQPQLPPMEDPLSFRRTTVEQPG

SEQ ID NO: 36298 - protein, 294 aa, Diabrotica virgifera
  misc_feature: Coding regions on vcDNA: vcDNA=SeqID_15995; Strand=+; Position=3-887
  misc_feature: Homolog annotation: Hit_ID=AAH70553.1; Match level="QueryCoverage =99%, HitCoverage=28%, E-value=1e-109, Identity=62%"; Hit description= MGC79934 protein [Xenopus laevis]
  misc_feature: Gene Ontology Annotation: Molecular function=small GTPase regulatory/interacting protein activity; Cellular component=nucleus; Biological process=EGF receptor signaling pathway
QSVLLQKEGLKVYFALTQYILPLDLISKDAFAQWMEVCRQVVERPVPPAALQPDEDERPDLPWWKCKKWALHILYRMFERYGSPGHVTKEYNEFAEWYLQTFSAGILEVLLRVLDGYRGGNWVPPRVLQQTLNYLNQAVSHGHTWKILKPHMPAIIQDVLFPLMSYSAEDHELWTVDAHEYIRVKFDVFEDFVSPVTAAQTLLHSSCKKRKEMLQKTMVMLTTILTNTATEPAQKDGALHMVGSLADIFLRKKMYRDQLDQLFIKYVFPDFNSDRGHLRARACWVLHYFCRVQL

SEQ ID NO: 36299 - protein, 66 aa, Diabrotica virgifera; identical to SEQ ID NO: 26808
  misc_feature: Coding regions on vcDNA: vcDNA=SeqID_15996; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36300 - protein, 174 aa, Diabrotica virgifera
  misc_feature: Coding regions on vcDNA: vcDNA=SeqID_15997; Strand=-; Position=1-522
  misc_feature (2)..(24): Xaa can be any naturally occurring amino acid
  misc_feature (26)..(36): Xaa can be any naturally occurring amino acid
  misc_feature (46)..(54): Xaa can be any naturally occurring amino acid
  misc_feature (56)..(69): Xaa can be any naturally occurring amino acid
  misc_feature (76)..(88): Xaa can be any naturally occurring amino acid
  misc_feature (90)..(174): Xaa can be any naturally occurring amino acid
LXXXXXXXXXXXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36301 - protein, 71 aa, Diabrotica virgifera
  misc_feature: Coding regions on vcDNA: vcDNA=SeqID_15998; Strand=+; Position=3-218
  misc_feature (3)..(3): Xaa can be any naturally occurring amino acid
LRXRRTFVEWNLPCSSPLCILVHCKGSDEHPELYLRYVFFTKPLFAKTRALMMILSFRREDSSSLTLYVYE

SEQ ID NO: 36302 - protein, 222 aa, Diabrotica virgifera
  misc_feature: Coding regions on vcDNA: vcDNA=SeqID_15999; Strand=+; Position=90-753
  misc_feature: Homolog annotation: Hit_ID=XP_394243.1; Match level="QueryCoverage =96%, HitCoverage=26%, E-value=1e-49, Identity=49%"; Hit description =similar to ENSANGP00000007008 [Apis mellifera]
  misc_feature: Gene Ontology Annotation: Cellular component=cytoplasm; Biological process=intracellular signaling cascade
  misc_feature: Pfam annotation: Pfam_ID=SH3_1; Match level="Score=52.2, E-value=1.5e- 12, Copies=1"; Pfam description=SH3 domain
  misc_feature (205)..(205): Xaa can be any naturally occurring amino acid
MPQQMDISSQHCLARALYDNVPDTPDELQFRKGDTLVVLEQNTANIEGWWLCSLRGKQGICPANRLRLIPGVFEDTGQLIRGISPNQFSDQGDFISLQRQGKRRSWHVLPNQVVTPKKFNDVFLYDMPPSRCSPISVSSGISPGTITRDQNDCYDVPPRPVPVGNESFRNCPRCSPAPSCASPINRDSGDTYDIPQTTFRHSEPXLTPSSSASSLTADSLSS

SEQ ID NO: 36303 - protein, 31 aa, Diabrotica virgifera
  misc_feature: Coding regions on vcDNA: vcDNA=SeqID_16000; Strand=-; Position=1-93
  misc_feature (1)..(13): Xaa can be any naturally occurring amino acid
  misc_feature (15)..(31): Xaa can be any naturally occurring amino acid
XXXXXXXXXXXXXLXXXXXXXXXXXXXXXXX

SEQ ID NO: 36304 - protein, 82 aa, Diabrotica virgifera
  misc_feature: Coding regions on vcDNA: vcDNA=SeqID_16001; Strand=-; Position=322-570
  misc_feature (23)..(29): Xaa can be any naturally occurring amino acid
HNTVSYRDYGGQVTWFACMRIEXXXXXXXQGRSTFGRPKKRWEEEVDEDFRHFLGSRSWKRTAVNRNDWRSLLKEAKARFGL

SEQ ID NO: 36305 - protein, 47 aa, Diabrotica virgifera
  misc_feature: Coding regions on vcDNA: vcDNA=SeqID_16002; Strand=-; Position=1-141
  misc_feature (26)..(46): Xaa can be any naturally occurring amino acid
LLVFPSLQYIYSVICKVISYYTQQKXXXXXXXXXXXXXXXXXXXXXS

SEQ ID NO: 36306 - protein, 30 aa, Diabrotica virgifera
  misc_feature: Coding regions on vcDNA: vcDNA=SeqID_16003; Strand=-; Position=2-91
  misc_feature (16)..(16): Xaa can be any naturally occurring amino acid
  misc_feature (22)..(22): Xaa can be any naturally occurring amino acid
SDFSTAFAINSGSVDXDERRLXVNKTSRVI

SEQ ID NO: 36307 - protein, 97 aa, Diabrotica virgifera
  misc_feature: Coding regions on vcDNA: vcDNA=SeqID_16004; Strand=+; Position=509-802
  misc_feature (2)..(9): Xaa can be any naturally occurring amino acid
  misc_feature (17)..(26): Xaa can be any naturally occurring amino acid
  misc_feature (28)..(34): Xaa can be any naturally occurring amino acid
VXXXXXXXXEVVFNPNXXXXXXXXXXYXXXXXXXILMVSVALFSIVSLPFFYKSSLIVSHLVFVRIFIFLKSFLLSKIQSICYMYYYVIFLRFTALK

SEQ ID NO: 36308 - protein, 108 aa, Diabrotica virgifera
  misc_feature: Coding regions on vcDNA: vcDNA=SeqID_16005; Strand=+; Position=168-494
TRGKIEEPTIARICLIMTIGTYHEMYYPSRHGGYTWSSTALVIAVLSSDIIQAELYVFIWTVPMINLLACSYANKFTDCPLTAVCSDGAVSLQKKSPDTSIDASEQRL

SEQ ID NO: 36309 - protein, 86 aa, Diabrotica virgifera
  misc_feature: Coding regions on vcDNA: vcDNA=SeqID_16006; Strand=+; Position=236-496
RSTRKESNTRPHLVNTIRIRNTSYVGHTTRHTEFYQLQVILEGNVEGNRSIEKKEKSRPRNIRDRTHTTGNSLIHSSAETEKISPS

SEQ ID NO: 36310 - protein, 302 aa, Diabrotica virgifera
  misc_feature: Coding regions on vcDNA: vcDNA=SeqID_16007; Strand=+; Position=1-906
  misc_feature: Homolog annotation: Hit_ID=XP_393750.1; Match level="QueryCoverage =82%, HitCoverage=18%, E-value=7e-56, Identity=46%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=33.8, E-value =1.5e-08, Copies=1"; Pfam description=ABC transporter
LFVSNVKENILFGKPFLKNRYHDVVKVCSLERDFKQFPFGDRSLVGERGTSLSGGQRARINLARAVYTEADIYLFDDPLSAVDTKVARHLFDECISKYLYGKTRILVTHQLQFMKKADLIIIINNGQIEKIAKFNELSENDLNALQQEPEADDKEKEKVPETGDKIRKNSTVPHFQSMSSLASSVFSDDPNEEDELIEKGAISNATYVEYWKSGGGVLFLFFTIFIFLVAQMITNASDLWLTHWTNNEAKRYHLSDSLHNATSNKTLERPLLMSTLSDEMSTSATLLTDSTPSADSSLLSLS

SEQ ID NO: 36311 - protein, 119 aa, Diabrotica virgifera
  misc_feature: Coding regions on vcDNA: vcDNA=SeqID_16008; Strand=+; Position=1-360
  misc_feature (28)..(37): Xaa can be any naturally occurring amino acid
VYYTTNAYQLKVSITNPFKNKDVSKLVXXXXXXXXXXKDSTMSVNNIESLCSQRVGYNKKIIKTDTSSLVPEGENYGGEMVKLNLVGQDENSNQSEEIHGVAEIIPPSEIYQEIFNIQR

SEQ ID NO: 36312 - protein, 263 aa, Diabrotica virgifera
  misc_feature: Coding regions on vcDNA: vcDNA=SeqID_16009; Strand=-; Position=1-789
  misc_feature (3)..(206): Xaa can be any naturally occurring amino acid
  misc_feature (209)..(246): Xaa can be any naturally occurring amino acid
  misc_feature (249)..(263): Xaa can be any naturally occurring amino acid
INXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXX

SEQ ID NO: 36313 - protein, 274 aa, Diabrotica virgifera
  misc_feature: Coding regions on vcDNA: vcDNA=SeqID_16010; Strand=+; Position=89-910
  misc_feature: Homolog annotation: Hit_ID=XP_393465.1; Match level="QueryCoverage =92%, HitCoverage=88%, E-value=8e-35, Identity=38%"; Hit description =similar to CG32521-PA [Apis mellifera]
  misc_feature: Gene Ontology Annotation: Molecular function=molecular_function unknown; Cellular component=extracellular matrix; Biological process= heart development
  misc_feature: Pfam annotation: Pfam_ID=Collagen; Match level="Score=-40.4, E-value =0.034, Copies=1"; Pfam description=Collagen triple helix repeat (20 copi
  misc_feature (230)..(230): Xaa can be any naturally occurring amino acid
  misc_feature (239)..(239): Xaa can be any naturally occurring amino acid
  misc_feature (255)..(255): Xaa can be any naturally occurring amino acid
MNLFQFAIFLGYFSIGYCYTKYGRTCKDIGCPSTQECVMATDPCSYYHRQGECGSYPTCQRVSNAPRTCSTYVCPPTKVCRMDGDTPKCFDDVGKVGHVGYETSGNTNHLSQSGHNGNLYPNLPKGETTPRPNINRPVSSGGYQGGQVGSGYPGGQVNSGYPGGQVGSGYPGGQVGSGYPGGQVGSGYPGGQVGSGYPGYTQQGGYPRQGYPQQGYPQQGYPQQGNYPQXYPQQGYPQXRYPQSGYPQTSNYPRXTVYPQQSGYPQQGAYPGYN

SEQ ID NO: 36314 - protein, 271 aa, Diabrotica virgifera
  misc_feature: Coding regions on vcDNA: vcDNA=SeqID_16011; Strand=+; Position=1-812
  misc_feature: Homolog annotation: Hit_ID=XP_314347.1; Match level="QueryCoverage =100%, HitCoverage=51%, E-value=1e-47, Identity=32%"; Hit description= ENSANGP00000012643 [Anopheles gambiae]
  misc_feature: Gene Ontology Annotation: Molecular function=receptor activity; Cellular component=plasma membrane; Biological process=apoptosis
  misc_feature: Pfam annotation: Pfam_ID=CD36; Match level="Score=-102.4, E-value =4.6e-09, Copies=1"; Pfam description=CD36 family
  misc_feature (251)..(251): Xaa can be any naturally occurring amino acid
  misc_feature (257)..(257): Xaa can be any naturally occurring amino acid
  misc_feature (261)..(261): Xaa can be any naturally occurring amino acid
EEVGPYAYEEHLERVDLEFPTDNSISYKEKRNYVFKPELTKGRQNDQLIVPNMAVLSGAAFTKPNNYFQRLAFSGLLSTMNEEPFLTKAADSFITGYKDRLYDIAKTFMPDNIPQQMGVLAPKLGQTPYRITINNGKDDIDHLGIVEKFNGETELNYFAGGQCNSIESTDGAIHPPRKVQKKEPLHYLFPEGCRRFPLIFNTETTVIDGKVPVYQYIHPEDLFDSADEKPENGCFCSMDSAQCPLKGVYTXTACNYXSPVXVSHPHFSQSD

SEQ ID NO: 36315 - protein, 126 aa, Diabrotica virgifera
  misc_feature: Coding regions on vcDNA: vcDNA=SeqID_16012; Strand=+; Position=223-603
  misc_feature: Homolog annotation: Hit_ID=EAL38601.1; Match level="QueryCoverage =97%, HitCoverage=98%, E-value=2e-12, Identity=30%"; Hit description =ENSANGP00000026529 [Anopheles gambiae str. PEST] ref|XP_551404.1| ENSANGP00000026529 [Anopheles gambiae st
MPKKNMIAKICPTCKQQVPVACKSCPCGHFFYNARRIAREFAIEADYRRRTARVRREKPNYYDALEYEKHIKKMKQRLSECDNDEEEDNRKDNGKLTKITPELQQHCQFILEQLNFKLQMVTWKPT

SEQ ID NO: 36316 - protein, 278 aa, Diabrotica virgifera
  misc_feature: Coding regions on vcDNA: vcDNA=SeqID_16013; Strand=-; Position=1-834
  misc_feature (4)..(255): Xaa can be any naturally occurring amino acid
  misc_feature (257)..(278): Xaa can be any naturally occurring amino acid
INNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXX

SEQ ID NO: 36317 - protein, 192 aa, Diabrotica virgifera
  misc_feature: Coding regions on vcDNA: vcDNA=SeqID_16014; Strand=-; Position=1-576
  misc_feature (5)..(156): Xaa can be any naturally occurring amino acid
  misc_feature (159)..(171): Xaa can be any naturally occurring amino acid
  misc_feature (175)..(189): Xaa can be any naturally occurring amino acid
AEIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXLSRXXXXXXXXXXXXXXXERE

SEQ ID NO: 36318 - protein, 58 aa, Diabrotica virgifera
  misc_feature: Coding regions on vcDNA: vcDNA=SeqID_16015; Strand=+; Position=291-467
  misc_feature (2)..(8): Xaa can be any naturally occurring amino acid
  misc_feature (45)..(50): Xaa can be any naturally occurring amino acid
VXXXXXXXDYMSERELRIFYYKFELYSKFYARFTIVIMNLRCILXXXXXXYHLCIRCL

SEQ ID NO: 36319 - protein, 71 aa, Diabrotica virgifera
  misc_feature: Coding regions on vcDNA: vcDNA=SeqID_16016; Strand=-; Position=195-410
GLSDVRRVGSVFTKSYARHIVLCISACFVCVIWDEGSLVIPWILYDPRDRCFVIDWSLPVVECVNSRRDRL

SEQ ID NO: 36320 - protein, 152 aa, Diabrotica virgifera
  misc_feature: Coding regions on vcDNA: vcDNA=SeqID_16017; Strand=+; Position=430-888
  misc_feature (35)..(74): Xaa can be any naturally occurring amino acid
  misc_feature (84)..(141): Xaa can be any naturally occurring amino acid
  misc_feature (143)..(152): Xaa can be any naturally occurring amino acid
KFKDSKIFHLSQNNRLSHLIFIIIYLFFIFLKFFXXXXXXXXXXXXXXXXXXXXXXXXXXXXXXXXXXXXXXXXPRLLKTSSFXXXXXXXXXXXXXXXXXXXXXXXXXXXXXXXXXXXXXXXXXXXXXXXXXXXXXXXXXXKXXXXXXXXXX

SEQ ID NO: 36321 - protein, 145 aa, Diabrotica virgifera
  misc_feature: Coding regions on vcDNA: vcDNA=SeqID_16018; Strand=-; Position=90-527
TWSCVALGVRISLISNARLSGLMPPCFVHLFLRVLIRAYLCVECGFLRLASHGSRSLMFSPDGNGVACALGPEFSVIRGVLGVRIWHVGKVWVRYLHAEVGSWSCSHSRMTSFSMDLHYCVWLVRIICSSLLPGRASWLIKKNSC

SEQ ID NO: 36322 - protein, 70 aa, Diabrotica virgifera
  misc_feature: Coding regions on vcDNA: vcDNA=SeqID_16019; Strand=+; Position=684-896
  misc_feature (57)..(57): Xaa can be any naturally occurring amino acid
  misc_feature (65)..(66): Xaa can be any naturally occurring amino acid
FNYICIVIYYSFPKLILKPHTEITNKQISNLIQANNLCRSTCQNTYHGEHNYFHIMXAFSKYFFXXKPDF

SEQ ID NO: 36323 - protein, 63 aa, Diabrotica virgifera
  misc_feature: Coding regions on vcDNA: vcDNA=SeqID_16020; Strand=-; Position=57-248
  misc_feature (22)..(29): Xaa can be any naturally occurring amino acid
YSFEKVRYIFIRIPFHYYNHVXXXXXXXXRIISIVFIVALNQMTKENLNELLGSFPASVLFPE

SEQ ID NO: 36324 - protein, 64 aa, Diabrotica virgifera
  misc_feature: Coding regions on vcDNA: vcDNA=SeqID_16021; Strand=-; Position=1-192
  misc_feature (5)..(12): Xaa can be any naturally occurring amino acid
  misc_feature (14)..(55): Xaa can be any naturally occurring amino acid
ANDYXXXXXXXXRXXXXXXXXXXXXXXXXXXXXXXXXXXXXXXXXXXXXXXXXXXVNLIILILS

SEQ ID NO: 36325 - protein, 263 aa, Diabrotica virgifera
  misc_feature: Coding regions on vcDNA: vcDNA=SeqID_16022; Strand=-; Position=1-789
  misc_feature (4)..(200): Xaa can be any naturally occurring amino acid
  misc_feature (203)..(240): Xaa can be any naturally occurring amino acid
  misc_feature (243)..(263): Xaa can be any naturally occurring amino acid
KLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXXXXXXXX

SEQ ID NO: 36326 - protein, 222 aa, Diabrotica virgifera
  misc_feature: Coding regions on vcDNA: vcDNA=SeqID_16023; Strand=-; Position=239-909
  misc_feature: Homolog annotation: Hit_ID=BAC82595.1; Match level="QueryCoverage =95%, HitCoverage=17%, E-value=1e-33, Identity=34%"; Hit description =reverse transcriptase [Anopheles gambiae]
  misc_feature (6)..(7): Xaa can be any naturally occurring amino acid
  misc_feature (15)..(15): Xaa can be any naturally occurring amino acid
  misc_feature (30)..(30): Xaa can be any naturally occurring amino acid
  misc_feature (136)..(136): Xaa can be any naturally occurring amino acid
  misc_feature (157)..(157): Xaa can be any naturally occurring amino acid
QDQVIXXRNYLKYIXRPSGQNERCRYGCQXQETIQHLTGGCQAFSATEYKEWHDAVGKILHQEITIKLGLLQTDHLPYYQYVPESMLEDGNYKLYWDHNVLTDQTVAHNRPDLVLVNKLTRQTTLIDAAIPNNNNXRSKFTEKIAKYRDLEIQIRRXWIIQSTQTIPIIMSTTRVIPKNLLESIKKLGLDEHLYNTMQKAVLLATIRCVRKFLGDTPAYQVT

SEQ ID NO: 36327 - protein, 62 aa, Diabrotica virgifera
  misc_feature: Coding regions on vcDNA: vcDNA=SeqID_16024; Strand=+; Position=626-811
  misc_feature (26)..(33): Xaa can be any naturally occurring amino acid
  misc_feature (44)..(55): Xaa can be any naturally occurring amino acid
LYKGSIIICLLIEGWYEWLDEKYTFXXXXXXXXFLVKRLRFYCXXXXXXXXXXXXYITFLVF

SEQ ID NO: 36328 - protein, 276 aa, Diabrotica virgifera
  misc_feature: Coding regions on vcDNA: vcDNA=SeqID_16025; Strand=-; Position=0-827
  misc_feature (1)..(275): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 36329 - protein, 230 aa, Diabrotica virgifera
  misc_feature: Coding regions on vcDNA: vcDNA=SeqID_16026; Strand=-; Position=2-691
  misc_feature (2)..(2): Xaa can be any naturally occurring amino acid
  misc_feature (6)..(230): Xaa can be any naturally occurring amino acid
NXSFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36330 - protein, 239 aa, Diabrotica virgifera
  misc_feature: Coding regions on vcDNA: vcDNA=SeqID_16027; Strand=+; Position=183-899
  misc_feature: Homolog annotation: Hit_ID=AAO21504.1; Match level="QueryCoverage =97%, HitCoverage=30%, E-value=7e-49, Identity=41%"; Hit description =zinc metalloprotease [Manduca sexta]
  misc_feature: Gene Ontology Annotation: Molecular function=zinc ion binding; Cellular component=endoplasmic reticulum; Biological process=cell -cell signaling
  misc_feature (118)..(140): Xaa can be any naturally occurring amino acid
  misc_feature (204)..(204): Xaa can be any naturally occurring amino acid
  misc_feature (209)..(209): Xaa can be any naturally occurring amino acid
  misc_feature (214)..(214): Xaa can be any naturally occurring amino acid
MSKDSRYTPVNTNPDKNPTWWKRRTSMERCLTLSTGIALLIGISLLIALATVLYSRDQHVSNKPYTAQPLQGKIVTITSQDHEDEKVCLSPGCIHTASRVLEYMDESVDPCDDFYQFXXXXXXXXXXXXXXXXXXXXXXXIGDELQEQLRTMIEEPIQEDEPKPFKLTKKLYKACMNKTLIEEDGMTTITEVLKELGGWPVLEXDSWKXDDFDXKNSVYKFRKVGYGVDYFIDFFCCGD

SEQ ID NO: 36331 - protein, 152 aa, Diabrotica virgifera
  misc_feature: Coding regions on vcDNA: vcDNA=SeqID_16028; Strand=+; Position=52-510
  misc_feature (34)..(52): Xaa can be any naturally occurring amino acid
  misc_feature (57)..(73): Xaa can be any naturally occurring amino acid
  misc_feature (81)..(88): Xaa can be any naturally occurring amino acid
  misc_feature (91)..(148): Xaa can be any naturally occurring amino acid
FFIIFQNIGYLIFILSHHYPSFSLSHQIFSLKYXXXXXXXXXXXXXXXXXXXRIILXXXXXXXXXXXXXXXXXVYKNTSFXXXXXXXXAHXXXXXXXXXXXXXXXXXXXXXXXXXXXXXXXXXXXXXXXXXXXXXXXXXXXXXXXXXXYRVS

SEQ ID NO: 36332 - protein, 259 aa, Diabrotica virgifera
  misc_feature: Coding regions on vcDNA: vcDNA=SeqID_16029; Strand=-; Position=1-777
  misc_feature (1)..(259): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36333 - protein, 277 aa, Diabrotica virgifera
  misc_feature: Coding regions on vcDNA: vcDNA=SeqID_16030; Strand=+; Position=89-923
  misc_feature: Homolog annotation: Hit_ID=XP_394218.1; Match level="QueryCoverage =93%, HitCoverage=44%, E-value=1e-36, Identity=33%"; Hit description =similar to ENSANGP00000024305 [Apis mellifera]
  misc_feature: Gene Ontology Annotation: Biological process=reproduction
  misc_feature: Pfam annotation: Pfam_ID=GMC_oxred_N; Match level="Score=62.5, E -value=1.2e-15, Copies=1"; Pfam description=GMC oxidoreductase
  misc_feature (217)..(218): Xaa can be any naturally occurring amino acid
  misc_feature (254)..(254): Xaa can be any naturally occurring amino acid
  misc_feature (256)..(257): Xaa can be any naturally occurring amino acid
MFLSKEWFLPLYTICVTFFGLLLYLSYHTDIFCLSCDETDNSNIVFDYIVVGCGSAGAIAARRLAENTKIKVLVLEAGKHGNFLLDVPVFGLLLQQSAYDWQYQSIPQTNSCFGLQNNVSMWPMGKIMGGTGMLNNMIYVRGYPEDFNHWFKDKEGYEFFKDILPYFKRLEEWDYKGKTTASTYVSNLTFTTKLADSILNAAKELGYPLLDETENCXXGFGLPKINVKNGQRWTPAHTLLEQKMTNIILRTNRXVXXILLHHFEAYGVNTLYKGQST

SEQ ID NO: 36334 - protein, 66 aa, Diabrotica virgifera
  misc_feature: Coding regions on vcDNA: vcDNA=SeqID_16031; Strand=-; Position=2-199
  misc_feature (3)..(13): Xaa can be any naturally occurring amino acid
  misc_feature (23)..(30): Xaa can be any naturally occurring amino acid
  misc_feature (33)..(47): Xaa can be any naturally occurring amino acid
  misc_feature (52)..(65): Xaa can be any naturally occurring amino acid
PFXXXXXXXXXXXTNWAHTGLNXXXXXXXXSNXXXXXXXXXXXXXXXTSRSXXXXXXXXXXXXXXV

SEQ ID NO: 36335 - protein, 281 aa, Diabrotica virgifera
  misc_feature: Coding regions on vcDNA: vcDNA=SeqID_16032; Strand=+; Position=2-847
  misc_feature: Homolog annotation: Hit_ID=XP_394934.1; Match level="QueryCoverage =96%, HitCoverage=19%, E-value=2e-94, Identity=61%"; Hit description =similar to ENSANGP00000018415 [Apis mellifera]
  misc_feature: Gene Ontology Annotation: Molecular function=chaperone activity; Cellular component=integral to membrane; Biological process=negative regulation of cholesterol biosynthesis
  misc_feature: Pfam annotation: Pfam_ID=WD40; Match level="Score=70.4, E-value=4.9e -18, Copies=3"; Pfam description=WD domain, G-beta repeat
  misc_feature (245)..(245): Xaa can be any naturally occurring amino acid
NHLKIVGAKVIAVRLCGLIELLQLQTYNQGRPIDWNFTCAYRRMHVRTASAGSISEQDLKKPGNNEDDLRVIKIHSSKAHQQPITCLDCEGGRILTGSQDHTLKVLRLEDGNPVYTLHGHCGPITCLFIDRVNPATSGSGSQDGMLCVWDLLTGACMYSIQAHDGSITSLTYSESYVISLGTDERLCVWERFQGHLLNTIHVSQTFSSQVLMLAQHLVVTARSGGLIIWDVRTGDCVRTITLGRXPFVFINQLVLLRDAVLCDYGKQLMIVRFPLMTHKFD

SEQ ID NO: 36336 - protein, 256 aa, Diabrotica virgifera
  misc_feature: Coding regions on vcDNA: vcDNA=SeqID_16033; Strand=+; Position=157-924
  misc_feature (133)..(138): Xaa can be any naturally occurring amino acid
  misc_feature (142)..(148): Xaa can be any naturally occurring amino acid
  misc_feature (205)..(205): Xaa can be any naturally occurring amino acid
  misc_feature (211)..(211): Xaa can be any naturally occurring amino acid
  misc_feature (229)..(229): Xaa can be any naturally occurring amino acid
  misc_feature (250)..(250): Xaa can be any naturally occurring amino acid
CSLKTIMETDEEVEDGVFTLITNLCEQFYTSQNDIKSARTKCYEILLKKRFTDSKKDCKDDTIVRDSYCNFLTWEFKLIHEFDMKDHAHELKSCVDNLHQSLKEDQEYFNRILTFLMELKNIPRKNKDLLDLXXXXXXKEFXXXXXXXQLPDSFKEVFNAEENLNTIESYQNVTHNEISKDDNTLIPNTKFSEIFKDEGYHSPPXSPENIXELASKLKYNRRKTWENFXYPEPDKELPFLSELGPLSSLXGENLDL

SEQ ID NO: 36337 - protein, 25 aa, Diabrotica virgifera
  misc_feature: Coding regions on vcDNA: vcDNA=SeqID_16034; Strand=+; Position=1-75
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
FXDXIXFDIRIITLGIQRIFMESQS

SEQ ID NO: 36338 - protein, 43 aa, Diabrotica virgifera
  misc_feature: Coding regions on vcDNA: vcDNA=SeqID_16035; Strand=+; Position=2-133
  misc_feature (2)..(15): Xaa can be any naturally occurring amino acid
  misc_feature (22)..(22): Xaa can be any naturally occurring amino acid
  misc_feature (27)..(34): Xaa can be any naturally occurring amino acid
  misc_feature (39)..(39): Xaa can be any naturally occurring amino acid
NXXXXXXXXXXXXXXRPRCWIXVYNWXXXXXXXXVRPLXFYMI

SEQ ID NO: 36339 - protein, 105 aa, Diabrotica virgifera
  misc_feature: Coding regions on vcDNA: vcDNA=SeqID_16036; Strand=-; Position=15-332
  misc_feature (15)..(22): Xaa can be any naturally occurring amino acid
  misc_feature (40)..(49): Xaa can be any naturally occurring amino acid
  misc_feature (54)..(75): Xaa can be any naturally occurring amino acid
  misc_feature (77)..(91): Xaa can be any naturally occurring amino acid
RYLIISVLLINKFNXXXXXXXXYKYECHSITKRLYGISIXXXXXXXXXXRRFEXXXXXXXXXXXXXXXXXXXXXXVXXXXXXXXXXXXXXXIKFFFTCTKRYFII

SEQ ID NO: 36340 - protein, 209 aa, Diabrotica virgifera
  misc_feature: Coding regions on vcDNA: vcDNA=SeqID_16037; Strand=-; Position=1-627
  misc_feature (5)..(28): Xaa can be any naturally occurring amino acid
  misc_feature (31)..(168): Xaa can be any naturally occurring amino acid
  misc_feature (171)..(209): Xaa can be any naturally occurring amino acid
PSIPXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFXXXXXXXXXXXXXXXXXXXXXXXXXXXXXXXXXXXXXXX

SEQ ID NO: 36341 - protein, 157 aa, Diabrotica virgifera
  misc_feature: Coding regions on vcDNA: vcDNA=SeqID_16038; Strand=+; Position=3-473
  misc_feature (53)..(62): Xaa can be any naturally occurring amino acid
  misc_feature (70)..(85): Xaa can be any naturally occurring amino acid
  misc_feature (95)..(102): Xaa can be any naturally occurring amino acid
  misc_feature (105)..(154): Xaa can be any naturally occurring amino acid
SQNFNSSQIKNSRIQIILHLFQNIGYPSSSLSHLSTSLFSSNFFSKISNLNSXXXXXXXXXXLKNSYHLXXXXXXXXXXXXXXXXHPLLKTRLFXXXXXXXXPTXXXXXXXXXXXXXXXXXXXXXXXXXXXXXXXXXXXXXXXXXXXXXXXXXXIFF

SEQ ID NO: 36342 - protein, 150 aa, Diabrotica virgifera
  misc_feature: Coding regions on vcDNA: vcDNA=SeqID_16039; Strand=-; Position=1-450
  misc_feature (19)..(46): Xaa can be any naturally occurring amino acid
  misc_feature (48)..(110): Xaa can be any naturally occurring amino acid
  misc_feature (114)..(150): Xaa can be any naturally occurring amino acid
PYIFYINIQFLNPNIIIIXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXPFHXXXXXXXXXXXXXXXXXXXXXXXXXXXXXXXXXXXXX

SEQ ID NO: 36343 - protein, 41 aa, Diabrotica virgifera
  misc_feature: Coding regions on vcDNA: vcDNA=SeqID_16040; Strand=+; Position=285-410
MNGLMRQIGIERAREAVAVCRMPEMKGCITRKDYETIKKAR

SEQ ID NO: 36344 - protein, 70 aa, Diabrotica virgifera
  misc_feature: Coding regions on vcDNA: vcDNA=SeqID_16041; Strand=-; Position=242-454
KILLKQFGFYTNEFSTLKIFLLQSTILIIIINVIVIVKLLSVTHPVDAIQTYRKNTISVECTYNFTFRKY

SEQ ID NO: 36345 - protein, 184 aa, Diabrotica virgifera
  misc_feature: Coding regions on vcDNA: vcDNA=SeqID_16042; Strand=-; Position=1-552
  misc_feature (1)..(121): Xaa can be any naturally occurring amino acid
  misc_feature (124)..(162): Xaa can be any naturally occurring amino acid
  misc_feature (164)..(184): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXGXXXXXXXXXXXXXXXXXXXXX

SEQ ID NO: 36346 - protein, 163 aa, Diabrotica virgifera
  misc_feature: Coding regions on vcDNA: vcDNA=SeqID_16043; Strand=-; Position=1-489
  misc_feature (3)..(12): Xaa can be any naturally occurring amino acid
  misc_feature (18)..(18): Xaa can be any naturally occurring amino acid
  misc_feature (22)..(29): Xaa can be any naturally occurring amino acid
  misc_feature (32)..(45): Xaa can be any naturally occurring amino acid
  misc_feature (51)..(64): Xaa can be any naturally occurring amino acid
  misc_feature (66)..(163): Xaa can be any naturally occurring amino acid
PFXXXXXXXXXXHHLGSXRLNXXXXXXXXSTXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36347 - protein, 57 aa, Diabrotica virgifera
  misc_feature: Coding regions on vcDNA: vcDNA=SeqID_16044; Strand=-; Position=171-344
  misc_feature (30)..(38): Xaa can be any naturally occurring amino acid
LNYYILFQHINIFYKYNSYLFSNIYSIFYXXXXXXXXXLSLHFYFNTFLYLLLFFTS

SEQ ID NO: 36348 - protein, 51 aa, Diabrotica virgifera
  misc_feature: Coding regions on vcDNA: vcDNA=SeqID_16045; Strand=+; Position=425-580
TLLQCKDAYNQFGCIYLNAELSAYKHSYTSLSISRYCVVIDEYFFHSVVYH

SEQ ID NO: 36349 - protein, 63 aa, Diabrotica virgifera
  misc_feature: Coding regions on vcDNA: vcDNA=SeqID_16046; Strand=+; Position=50-241
NERKKGEHEDTANIFTAAPSQCPFLLGLFLQAAKPDGNYQRIDDQPSRGNEGITLMILLMFSH

SEQ ID NO: 36350 - protein, 84 aa, Diabrotica virgifera
  misc_feature: Coding regions on vcDNA: vcDNA=SeqID_16047; Strand=-; Position=1-252
  misc_feature (25)..(42): Xaa can be any naturally occurring amino acid
  misc_feature (47)..(64): Xaa can be any naturally occurring amino acid
  misc_feature (67)..(75): Xaa can be any naturally occurring amino acid
  misc_feature (77)..(83): Xaa can be any naturally occurring amino acid
FFKQIFHLLLNNSFVNKSAPVYSSXXXXXXXXXXXXXXXXXXDIQSXXXXXXXXXXXXXXXXXXITXXXXXXXXXDXXXXXXXL

SEQ ID NO: 36351 - protein, 304 aa, Diabrotica virgifera
  misc_feature: Coding regions on vcDNA: vcDNA=SeqID_16048; Strand=-; Position=1-912
  misc_feature (1)..(6): Xaa can be any naturally occurring amino acid
  misc_feature (8)..(304): Xaa can be any naturally occurring amino acid
XXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36352 - protein, 146 aa, Diabrotica virgifera
  misc_feature: Coding regions on vcDNA: vcDNA=SeqID_16049; Strand=+; Position=103-543
  misc_feature: Homolog annotation: Hit_ID=XP_307144.1; Match level="QueryCoverage =92%, HitCoverage=36%, E-value=1e-12, Identity=37%"; Hit description =ENSANGP00000024852 [Anopheles gambiae]
  misc_feature (57)..(57): Xaa can be any naturally occurring amino acid
  misc_feature (109)..(109): Xaa can be any naturally occurring amino acid
QYGVKRCGRHIYMPGSLLTKNNVSEKIKRRMVLANKSDYSLRRQVDSKLPRKIKLMXKTIIRPVLTYRDQTWSLHRMAKSCKCFIREYMWEYKIIRRILGTKRAGFRAXNATELYRSFREANVVKFIKVAHFRWRERGATVRKVCD

SEQ ID NO: 36353 - protein, 132 aa, Diabrotica virgifera
  misc_feature: Coding regions on vcDNA: vcDNA=SeqID_16050; Strand=+; Position=87-485
  misc_feature (22)..(29): Xaa can be any naturally occurring amino acid
  misc_feature (100)..(108): Xaa can be any naturally occurring amino acid
PVFRVLPGTKYTVLCPCVSIWXXXXXXXXRKKVILHKMLCLVQNLRFNHQISNFFNIRGMSKSLNFTQGSFIFHNIENCCYEKLLGIKNYIPVCNYILLXXXXXXXXXLCITLFSVLSIQFINNFAKRGDSQ

SEQ ID NO: 36354 - protein, 23 aa, Diabrotica virgifera
  misc_feature: Coding regions on vcDNA: vcDNA=SeqID_16051; Strand=-; Position=2-70
  misc_feature (2)..(7): Xaa can be any naturally occurring amino acid
DXXXXXXITYFKKNRLDQRSRRA

SEQ ID NO: 36355 - protein, 104 aa, Diabrotica virgifera
  misc_feature: Coding regions on vcDNA: vcDNA=SeqID_16052; Strand=+; Position=242-553
ENKIPHDLLEKAKVKQRSSYQNSFQLCDRHGLTPKCAHEQPETSQHEICAKLNAKNLNEKKRQNLSVLNKNTDTHRPTPINTTTLQTRPPQQHPPDPPAHAAPA

SEQ ID NO: 36356 - protein, 155 aa, Diabrotica virgifera
  misc_feature: Coding regions on vcDNA: vcDNA=SeqID_16053; Strand=+; Position=3-466
  misc_feature: Homolog annotation: Hit_ID=EAA11692.2; Match level="QueryCoverage =99%, HitCoverage=85%, E-value=7e-18, Identity=36%"; Hit description =ENSANGP00000010844 [Anopheles gambiae str. PEST] ref|XP_556624.1| ENSANGP00000010844 [Anopheles gambiae st
  misc_feature: Gene Ontology Annotation: Molecular function=pre-mRNA splicing factor activity; Cellular component=extracellular space; Biological process =cell proliferation
  misc_feature (30)..(30): Xaa can be any naturally occurring amino acid
  misc_feature (73)..(73): Xaa can be any naturally occurring amino acid
RTQKRPKQPKEPTAKKKRQTTPPQGKATRXQTHRTAQETNQTHPPPTHPQPKTPTPTTPNTPRDEPKNKTPPXTQPPNKNQDQKPPHPKTRQHPPPHTTTPTPQKPSTKTQTQTTPSQERTTTPARPNRTGRPPPPRPRQPPRPHTPPPPTKNTA

SEQ ID NO: 36357 - protein, 87 aa, Diabrotica virgifera
  misc_feature: Coding regions on vcDNA: vcDNA=SeqID_16054; Strand=-; Position=680-943
  misc_feature (51)..(57): Xaa can be any naturally occurring amino acid
ICPDSGGMGLALCHLFNLWEDSLFPLFISNRGVGMSSFNNSFFLQQPAFLXXXXXXXLQYFTNLIMLFNLNYSSMYTIYNIHIYKIL

SEQ ID NO: 36358 - protein, 87 aa, Diabrotica virgifera
  misc_feature: Coding regions on vcDNA: vcDNA=SeqID_16055; Strand=-; Position=86-349
  misc_feature (27)..(65): Xaa can be any naturally occurring amino acid
QEMKFGGPLKKIMRSQPPVVNLGSFEXXXXXXXXXXXXXXXXXXXXXXXXXXXXXXXXXXXXXXXQQFYFNSKFGIKYCYTILILRI

SEQ ID NO: 36359 - protein, 48 aa, Diabrotica virgifera
  misc_feature: Coding regions on vcDNA: vcDNA=SeqID_16056; Strand=-; Position=24-170
LSKDSFIFLSGTQASVQLNSSFLTIIFSLSAKYRVLNNEFFDYFSEKF

SEQ ID NO: 36360 - protein, 133 aa, Diabrotica virgifera
  misc_feature: Coding regions on vcDNA: vcDNA=SeqID_16057; Strand=+; Position=450-851
  misc_feature (125)..(125): Xaa can be any naturally occurring amino acid
FWRLPRICGLYSSAIYDLEQQKTTKHMKVYIYFLFLYKLLNLLWLIYLYWFSCCEYRIRYSVVVILSFLILSVAVLTVRSKRIILHCQEEKMDTKAQNICVVTSGLAPPITIPKPNAVPDAADEXIKPSLVYM

SEQ ID NO: 36361 - protein, 126 aa, Diabrotica virgifera
  misc_feature: Coding regions on vcDNA: vcDNA=SeqID_16058; Strand=+; Position=72-452
TQLYRDDSMGEEVLAGLLDKTRAVNTSNVTIPDQDMSTPNIFTEEEEDDVYLRRTMNIFTLTEKIGALPMELLNSMEKKDKKTFVDEIKKFKIYRPDPADPENLQKGFIDMEKLSTFKNALKSYSR

SEQ ID NO: 36362 - protein, 191 aa, Diabrotica virgifera
  misc_feature: Coding regions on vcDNA: vcDNA=SeqID_16059; Strand=-; Position=0-572
  misc_feature (37)..(48): Xaa can be any naturally occurring amino acid
  misc_feature (59)..(69): Xaa can be any naturally occurring amino acid
  misc_feature (74)..(84): Xaa can be any naturally occurring amino acid
  misc_feature (92)..(98): Xaa can be any naturally occurring amino acid
  misc_feature (119)..(127): Xaa can be any naturally occurring amino acid
  misc_feature (137)..(151): Xaa can be any naturally occurring amino acid
  misc_feature (154)..(165): Xaa can be any naturally occurring amino acid
  misc_feature (169)..(184): Xaa can be any naturally occurring amino acid
SLVFITRSIFCSRFPFLILFFFANYAFFYCSSYLLYXXXXXXXXXXXXYFCILHHNIIXXXXXXXXXXXPFLIXXXXXXXXXXXLFFLISFXXXXXXXILKIFISTYIVILSLSFISFXXXXXXXXXTFLYLSLLSXXXXXXXXXXXXXXXHSXXXXXXXXXXXXFYPXXXXXXXXXXXXXXXXLSFFPFS

SEQ ID NO: 36363 - protein, 45 aa, Diabrotica virgifera
  misc_feature: Coding regions on vcDNA: vcDNA=SeqID_16060; Strand=+; Position=3-137
  misc_feature (1)..(21): Xaa can be any naturally occurring amino acid
  misc_feature (29)..(35): Xaa can be any naturally occurring amino acid
XXXXXXXXXXXXXXXXXXXXXREKPIRSXXXXXXXVLLSHKFYQN

SEQ ID NO: 36364 - protein, 39 aa, Diabrotica virgifera
  misc_feature: Coding regions on vcDNA: vcDNA=SeqID_16061; Strand=-; Position=1-117
  misc_feature (21)..(39): Xaa can be any naturally occurring amino acid
LKIYYKVVKTDVWSLAAVLSXXXXXXXXXXXXXXXXXXX

SEQ ID NO: 36365 - protein, 93 aa, Diabrotica virgifera
  misc_feature: Coding regions on vcDNA: vcDNA=SeqID_16062; Strand=+; Position=298-579
HLSVLTLVSVVRFMLMEVQVSILAFTYLSHVISLFGQLHKYLKYYTNSIVCPNHYWCLCNTNFIYGHQFCLLEHNIWIYFVIEKLYQFSRNFI

SEQ ID NO: 36366 - protein, 23 aa, Diabrotica virgifera
  misc_feature: Coding regions on vcDNA: vcDNA=SeqID_16063; Strand=+; Position=1-69
  misc_feature (1)..(21): Xaa can be any naturally occurring amino acid
XXXXXXXXXXXXXXXXXXXXXTS

SEQ ID NO: 36367 - protein, 43 aa, Diabrotica virgifera; identical to SEQ ID NO: 31922
  misc_feature: Coding regions on vcDNA: vcDNA=SeqID_16064; Strand=-; Position=1-129
  misc_feature (1)..(43): Xaa can be any naturally occurring amino acid

SEQ ID NO: 36368 - protein, 72 aa, Diabrotica virgifera
  misc_feature: Coding regions on vcDNA: vcDNA=SeqID_16065; Strand=+; Position=491-706
PLEYIFLNSNCTFLVMSELLFECYEVPGISYGVDALFFLSLYPTRAFKRCVISKSRISDMSYYSSDKQLPCF

SEQ ID NO: 36369 - protein, 108 aa, Diabrotica virgifera; identical to SEQ ID NO: 27732
  misc_feature: Coding regions on vcDNA: vcDNA=SeqID_16066; Strand=+; Position=227-553
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 36370 - protein, 283 aa, Diabrotica virgifera
  misc_feature: Coding regions on vcDNA: vcDNA=SeqID_16067; Strand=+; Position=2-850
  misc_feature: Homolog annotation: Hit_ID=AAG23133.1; Match level="QueryCoverage =99%, HitCoverage=58%, E-value=1e-147, Identity=85%"; Hit description= alpha-amylase [Diabrotica virgifera virgifera]
  misc_feature: Pfam annotation: Pfam_ID=Alpha-amylase; Match level="Score=3.5, E -value=5.5e-10, Copies=1"; Pfam description=Alpha amylase, catalytic domain
HFHSRCDVNNYQDATNIRKCWLSGLPDLDQIHDFVRKKIVEYLNHLVDLGVAGFRVDAAKHMWPTDLKAIYSSVKDLTGPGLSGRPFFYQEVIDLGGEAVRKTEYNSFGAVLEFKYGAELGNAFQGHNDLHWLKSWGTEWGLLAGTDAVAFIDNHDNQRGGSPAILTYKSPKPYKMAIAFMLAHPYGTTRIMSSFAFDNFDQGPPIQQPGFNADDTCTNGWVCEHRWRQIYNMVGFRNAVAGTGINNWWSNGKNKIAFGRGDKGFIAFTLEGDIDQNLQTSLP

SEQ ID NO: 36371 - protein, 58 aa, Diabrotica virgifera
  misc_feature: Coding regions on vcDNA: vcDNA=SeqID_16068; Strand=-; Position=113-289
SLPCRNSLPCLLTLFLVVLSFQLNFLLFELLSVRLLFISASFSFPSGAHDPVTNFLKK

SEQ ID NO: 36372 - protein, 110 aa, Diabrotica virgifera
  misc_feature: Coding regions on vcDNA: vcDNA=SeqID_16069; Strand=+; Position=144-476
YPYPYERPPMRSPMDRTQAVKQTGVQKWLHVKHCKEQREETHVQIYARMCTRMTRRQLRQTFLETFTESSTLSSHLYTRVYTSDYCSRTFSLTFAFLYDLLFLPPSRPPS

SEQ ID NO: 36373 - protein, 27 aa, Diabrotica virgifera
  misc_feature: Coding regions on vcDNA: vcDNA=SeqID_16070; Strand=+; Position=2-82
  misc_feature (2)..(8): Xaa can be any naturally occurring amino acid
RXXXXXXXKDRNHPGSHRLNSDHVKFK

SEQ ID NO: 36374 - protein, 157 aa, Diabrotica virgifera
  misc_feature: Coding regions on vcDNA: vcDNA=SeqID_16071; Strand=+; Position=289-762
  misc_feature (2)..(9): Xaa can be any naturally occurring amino acid
  misc_feature (103)..(109): Xaa can be any naturally occurring amino acid
  misc_feature (127)..(136): Xaa can be any naturally occurring amino acid
VXXXXXXXXLSIKSKLCSKYCWFLLFFGKKNHEKHPLISISNRINRCRFAGCFAYLFFIRSVSLSGSKCLILKRLLKWLERVTNPECMQTSNSHSITNFCIRXXXXXXXIQKSKTYILLLFEIFGVXXXXXXXXXXAFFSQNKHVVSMKLADRINTT

SEQ ID NO: 36375 - protein, 56 aa, Diabrotica virgifera
  misc_feature: Coding regions on vcDNA: vcDNA=SeqID_16072; Strand=-; Position=1-168
  misc_feature (2)..(12): Xaa can be any naturally occurring amino acid
  misc_feature (14)..(56): Xaa can be any naturally occurring amino acid
NXXXXXXXXXXXEXXXXXXXXXXXXXXXXXXXXXXXXXXXXXXXXXXXXXXXXXXX

SEQ ID NO: 36376 - protein, 29 aa, Diabrotica virgifera
  misc_feature: Coding regions on vcDNA: vcDNA=SeqID_16073; Strand=-; Position=1-87
  misc_feature (1)..(10): Xaa can be any naturally occurring amino acid
  misc_feature (18)..(29): Xaa can be any naturally occurring amino acid
XXXXXXXXXXKNHLFNKXXXXXXXXXXXX

SEQ ID NO: 36377 - protein, 87 aa, Diabrotica virgifera
  misc_feature: Coding regions on vcDNA: vcDNA=SeqID_16074; Strand=+; Position=581-841
  misc_feature (15)..(15): Xaa can be any naturally occurring amino acid
  misc_feature (75)..(75): Xaa can be any naturally occurring amino acid
FGIYIKYMRIKVLFXMDVIYNLINVKRFFKYSYDEKLELKCKGRPLPDIKIEKEGSSRGKNYKRQFNCDIYTRNXWICGCNRKNALF

SEQ ID NO: 36378 - protein, 191 aa, Diabrotica virgifera
  misc_feature: Coding regions on vcDNA: vcDNA=SeqID_16075; Strand=+; Position=54-627
  misc_feature: Homolog annotation: Hit_ID=AAT01074.1; Match level="QueryCoverage =92%, HitCoverage=49%, E-value=1e-47, Identity=56%"; Hit description =putative arginine kinase [Homalodisca coagulata]
  misc_feature (107)..(107): Xaa can be any naturally occurring amino acid
  misc_feature (136)..(137): Xaa can be any naturally occurring amino acid
IQGGRGEGKKSLEKGERGEKNLETNTKTPRKKHRTQETDDNRKTKKTPTNESTRRDGSQTGREKHDAGGENDAPEAEAHTDNADTDEPNTEDDHVFFYKNDKHPPKXWGDLSVFGDLDPTDEFVVRTRARCGGYMXXYPFNPCLTEQQYKEMQQNVTSNLSGVEGELKGTFYSLTGMSKEVQQKLLCSGNL

SEQ ID NO: 36379 - protein, 94 aa, Diabrotica virgifera
  misc_feature: Coding regions on vcDNA: vcDNA=SeqID_16076; Strand=+; Position=3-287
NRIAFRMCVWGLAACCLKCDRVLQRTSGKLLGSKYMYGMFGCVREMSRMSSFSFFILILYCHFADLLMTVVGKLRMVRISVSLNIISSNLHTLF

SEQ ID NO: 36380 - protein, 65 aa, Diabrotica virgifera
  misc_feature: Coding regions on vcDNA: vcDNA=SeqID_16077; Strand=+; Position=27-224
SWRCYYFEEDMWQRNKNVSGRTSYGRDMCCKFFPDRRILLNHMNYHYVESGFQCKLCFKPIRIKV

SEQ ID NO: 36381 - protein, 278 aa, Diabrotica virgifera
  misc_feature: Coding regions on vcDNA: vcDNA=SeqID_16078; Strand=-; Position=1-834
  misc_feature (4)..(16): Xaa can be any naturally occurring amino acid
  misc_feature (18)..(44): Xaa can be any naturally occurring amino acid
  misc_feature (46)..(273): Xaa can be any naturally occurring amino acid
KFNXXXXXXXXXXXXXIXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGHVKE

SEQ ID NO: 36382 - protein, 277 aa, Diabrotica virgifera
  misc_feature: Coding regions on vcDNA: vcDNA=SeqID_16079; Strand=+; Position=83-913
  misc_feature: Homolog annotation: Hit_ID=NP_650565.2; Match level="QueryCoverage =97%, HitCoverage=96%, E-value=2e-67, Identity=49%"; Hit description =CG10340-PA [Drosophila melanogaster] gb|AAF55341.3| CG10340-PA [Drosophila melanogaster]
  misc_feature: Gene Ontology Annotation: Molecular function=chaperone activity; Cellular component=mitochondrial matrix; Biological process=protein complex assembly
  misc_feature: Pfam annotation: Pfam_ID=ATP11; Match level="Score=259.3, E-value =6.8e-75, Copies=1"; Pfam description=ATP11 protein
  misc_feature (257)..(257): Xaa can be any naturally occurring amino acid
MHLTSLMHTVLYRGSFRICTKSIMTTPRNLQEVVDDLKGNPYYDKYAEKIAKLHKEDPNEFKARIEKANQKTKKFDPPKQPERQYSQLLTPKEKLAETGQFKQESLDKIMKTNLIKDKNAEEIKSIWEEYHKHKEYCIAATIPSGDFVKLNENSKKYPTFLFALPRTQGYEFIMCQFAQNTVHFTPLLYYQVHKENAPECLHITHYDEFEGDKGIVLMRGEYDKNVMNAQEAQCLANQLQMYYVQEDSEKKKLLEQXTNEPDKFKHGDLIKQIENFD

SEQ ID NO: 36383 - protein, 129 aa, Diabrotica virgifera
  misc_feature: Coding regions on vcDNA: vcDNA=SeqID_16080; Strand=+; Position=198-587
  misc_feature: Homolog annotation: Hit_ID=XP_394762.1; Match level="QueryCoverage =38%, HitCoverage=5%, E-value=6e-10, Identity=62%"; Hit description =similar to CG32498-PO [Apis mellifera]
STNSCQDRIERIPPSSEELFENIPWMNIMADLTVKSAIAEYEFKRMLNKKLSHFSDSKKSVIQISLYICSTFLDISYINCIYPPILMNYLSYSLYPLNEKIESEYRILPWLINQVLIECLFSQTNTFIV

SEQ ID NO: 36384 - protein, 56 aa, Diabrotica virgifera
  misc_feature: Coding regions on vcDNA: vcDNA=SeqID_16081; Strand=-; Position=2-169
  misc_feature (4)..(4): Xaa can be any naturally occurring amino acid
  misc_feature (13)..(20): Xaa can be any naturally occurring amino acid
  misc_feature (23)..(30): Xaa can be any naturally occurring amino acid
  misc_feature (35)..(35): Xaa can be any naturally occurring amino acid
  misc_feature (42)..(55): Xaa can be any naturally occurring amino acid
KDRXQPGSHRFKXXXXXXXXSNXXXXXXXXPIINXNPTSRSXXXXXXXXXXXXXXV

SEQ ID NO: 36385 - protein, 77 aa, Diabrotica virgifera
  misc_feature: Coding regions on vcDNA: vcDNA=SeqID_16082; Strand=+; Position=255-488
SIFENLKVYEVTLRLMLIEIMVQFLRIDKQHIQCIYVTWNHMANFFQNVRPKSMPHPVFQKFLFINCTRKSFVWCKT

SEQ ID NO: 36386 - protein, 226 aa, Diabrotica virgifera
  misc_feature: Coding regions on vcDNA: vcDNA=SeqID_16083; Strand=+; Position=61-738
  misc_feature (1)..(6): Xaa can be any naturally occurring amino acid
XXXXXXKLSETSRKTTGTSLRKQLHVKERLCCKCGFKTRFRYYMDSHRDFVHGNGPTSKGAGNIIKDDENIVLLHYVRKLQLYKYYESVDTIQKELTNKLMDVMRIFKKEGCNRGSVELEKFFLNMRYDSMWRFKSYYIQKSAARPTKEDYILANLFPKFYESVGFDMSQLMADAKTYSTEIVEYLGPVEDQERPSILEDTSSLCHLNDVEPQPNLKRPCSEEDER

SEQ ID NO: 36387 - protein, 23 aa, Diabrotica virgifera
  misc_feature: Coding regions on vcDNA: vcDNA=SeqID_16084; Strand=-; Position=2-70
  misc_feature (15)..(15): Xaa can be any naturally occurring amino acid
TLIHHRGRNLYYRFXLSNKNYAV

SEQ ID NO: 36388 - protein, 288 aa, Diabrotica virgifera
  misc_feature: Coding regions on vcDNA: vcDNA=SeqID_16085; Strand=-; Position=0-863
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(283): Xaa can be any naturally occurring amino acid
SFXXXXXXXXXXXNQPGSHRFKXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGKAT

SEQ ID NO: 36389 - protein, 243 aa, Diabrotica virgifera
  misc_feature: Coding regions on vcDNA: vcDNA=SeqID_16086; Strand=-; Position=31-762
  misc_feature (30)..(37): Xaa can be any naturally occurring amino acid
  misc_feature (64)..(74): Xaa can be any naturally occurring amino acid
  misc_feature (100)..(106): Xaa can be any naturally occurring amino acid
  misc_feature (116)..(127): Xaa can be any naturally occurring amino acid
  misc_feature (132)..(139): Xaa can be any naturally occurring amino acid
  misc_feature (155)..(206): Xaa can be any naturally occurring amino acid
  misc_feature (232)..(235): Xaa can be any naturally occurring amino acid
TTFISSNKTSLHLPLLLHSSIFLLFSNKLXXXXXXXXLKLISLFTFYYTNHSFLLPYICIIIFXXXXXXXXXXXLYSIFYLLFFDTFIILLNPYYSFHLXXXXXXXIIFFILLPLXXXXXXXXXXXXILQFXXXXXXXXSLSFFPFSFYFLSSFXXXXXXXXXXXXXXXXXXXXXXXXXXXXXXXXXXXXXXXXXXXXXXXXXXXXLGLLFPLKEIFSSNTFSLSCSFLSLXXXXSPLVTTIT

SEQ ID NO: 36390 - protein, 288 aa, Diabrotica virgifera
  misc_feature: Coding regions on vcDNA: vcDNA=SeqID_16087; Strand=-; Position=0-863
  misc_feature (3)..(286): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 36391 - protein, 254 aa, Diabrotica virgifera
  misc_feature: Coding regions on vcDNA: vcDNA=SeqID_16088; Strand=+; Position=2-766
  misc_feature: Homolog annotation: Hit_ID=AAD49730.1; Match level="QueryCoverage =93%, HitCoverage=42%, E-value=4e-42, Identity=39%"; Hit description =chrysoptin precursor [Chrysops sp.]
  misc_feature: Gene Ontology Annotation: Cellular component=integral to membrane
  misc_feature: Pfam annotation: Pfam_ID=5_nucleotid_C; Match level="Score=97.3, E -value=4e-26, Copies=1"; Pfam description=5'-nucleotidase, C-terminal domain
  misc_feature (54)..(61): Xaa can be any naturally occurring amino acid
  misc_feature (82)..(86): Xaa can be any naturally occurring amino acid
GRVGFLANNLPQDPQINKDLQPWKEEVDKQGNKVLGSTLVDLSFEGCYTHECTXXXXXXXXSVFAFTKSPPEGAWTEASIGXXXXXGLRTTIRTGNITYADIKTSQPFSNTIDFGQLYGKYLKETFERCTLEYHAGRTEASTTLLQVSGIIVEYDFAKPEGERVISLKARCHNCTVPVYEDVEMDKLYNLAMNSYMAEGGDGFDIIGKNLINKKKGLVDVDVFVDYIAHRSPIFEEEGGRIILHNAENSYVIRR

SEQ ID NO: 36392 - protein, 107 aa, Diabrotica virgifera
  misc_feature: Coding regions on vcDNA: vcDNA=SeqID_16089; Strand=-; Position=45-368
  misc_feature (46)..(54): Xaa can be any naturally occurring amino acid
NNSSIFYPIYIYNFHTTIITSIFILILFSFNYLLLTFPLFYSFSCXXXXXXXXXTISTNILKSSFLRLSSVPPPSTNVNPRLSKENRTQQGLVCLILIIMRFFLFHF

SEQ ID NO: 36393 - protein, 289 aa, Diabrotica virgifera
  misc_feature: Coding regions on vcDNA: vcDNA=SeqID_16090; Strand=-; Position=6-875
  misc_feature (1)..(32): Xaa can be any naturally occurring amino acid
  misc_feature (35)..(42): Xaa can be any naturally occurring amino acid
  misc_feature (48)..(56): Xaa can be any naturally occurring amino acid
  misc_feature (82)..(88): Xaa can be any naturally occurring amino acid
  misc_feature (120)..(132): Xaa can be any naturally occurring amino acid
  misc_feature (145)..(153): Xaa can be any naturally occurring amino acid
  misc_feature (162)..(178): Xaa can be any naturally occurring amino acid
  misc_feature (180)..(203): Xaa can be any naturally occurring amino acid
  misc_feature (209)..(272): Xaa can be any naturally occurring amino acid
  misc_feature (278)..(279): Xaa can be any naturally occurring amino acid
XXXXXXXXXXXXXXXXXXXXXXXXXXXXXXXXCSXXXXXXXXLLFLRXXXXXXXXXLSPFFPIRYLFFLSPLFVSFLFSIFXXXXXXXSLIFLLFSFSLLLYFFFLSNSLLSLYFLPLVXXXXXXXXXXXXXLSPISSLSPYLLXXXXXXXXXFLLYFFFSXXXXXXXXXXXXXXXXXSXXXXXXXXXXXXXXXXXXXXXXXXFFSPSXXXXXXXXXXXXXXXXXXXXXXXXXXXXXXXXXXXXXXXXXXXXXXXXXXXXXXXXXXXXXXXXCSFLWXXRKGEKFLRTY

SEQ ID NO: 36394 - protein, 245 aa, Diabrotica virgifera
  misc_feature: Coding regions on vcDNA: vcDNA=SeqID_16091; Strand=-; Position=1-735
  misc_feature (3)..(188): Xaa can be any naturally occurring amino acid
  misc_feature (191)..(228): Xaa can be any naturally occurring amino acid
  misc_feature (231)..(245): Xaa can be any naturally occurring amino acid
AFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXX

SEQ ID NO: 36395 - protein, 260 aa, Diabrotica virgifera
  misc_feature: Coding regions on vcDNA: vcDNA=SeqID_16092; Strand=+; Position=3-782
  misc_feature (7)..(34): Xaa can be any naturally occurring amino acid
  misc_feature (42)..(92): Xaa can be any naturally occurring amino acid
  misc_feature (95)..(111): Xaa can be any naturally occurring amino acid
  misc_feature (114)..(129): Xaa can be any naturally occurring amino acid
  misc_feature (162)..(171): Xaa can be any naturally occurring amino acid
  misc_feature (173)..(204): Xaa can be any naturally occurring amino acid
  misc_feature (210)..(226): Xaa can be any naturally occurring amino acid
  misc_feature (240)..(259): Xaa can be any naturally occurring amino acid
PPPPGKXXXXXXXXXXXXXXXXXXXXXXXXXXXXPPPGGGGXXXXXXXXXXXXXXXXXXXXXXXXXXXXXXXXXXXXXXXXXXXXXXXXXXXPQXXXXXXXXXXXXXXXXXPTXXXXXXXXXXXXXXXXSGAGRGGEEGPHTAPSSTTYSLRHSTTNPPTTXXXXXXXXXXRXXXXXXXXXXXXXXXXXXXXXXXXXXXXXXXXPSALPXXXXXXXXXXXXXXXXXPYHQLLEELQLITXXXXXXXXXXXXXXXXXXXXL

SEQ ID NO: 36396 - protein, 217 aa, Diabrotica virgifera
  misc_feature: Coding regions on vcDNA: vcDNA=SeqID_16093; Strand=+; Position=260-911
  misc_feature: Homolog annotation: Hit_ID=AAQ11974.1; Match level="QueryCoverage =92%, HitCoverage=62%, E-value=9e-37, Identity=39%"; Hit description =putative gut cathepsin L-like cysteine protease [Callosobruchus maculatus]
  misc_feature: Gene Ontology Annotation: Cellular component=extracellular space
  misc_feature: Pfam annotation: Pfam_ID=Peptidase_C1; Match level="Score=-31.6, E -value=8.6e-09, Copies=1"; Pfam description=Papain family cysteine protease
  misc_feature (39)..(45): Xaa can be any naturally occurring amino acid
  misc_feature (165)..(165): Xaa can be any naturally occurring amino acid
  misc_feature (201)..(201): Xaa can be any naturally occurring amino acid
  misc_feature (203)..(203): Xaa can be any naturally occurring amino acid
MKTVLIAIVICCWLFNEALCGVEDDWNDFKIKYKKTYEXXXXXXXFSDFKDNLKEIRHHNNRYEKGLESYKKGITVFADLSRIEFESKYQLDRPMMMTRYSQSWKNRYIDKNLTKVDVDWRKEGAVTPVKNQGICGSCWIFSAVGVLESYHFRKTGKLISLSEQXVVDCFSSNSCLGGLPEDALTFIQKNGVSTEAEYPYXDXQMACNPHLIKHASI

SEQ ID NO: 36397 - protein, 54 aa, Diabrotica virgifera
  misc_feature: Coding regions on vcDNA: vcDNA=SeqID_16094; Strand=+; Position=3-167
LYKIFNKVDNKNKYEVSTPQLSNKCYQFMPKYHLRSITVVIRTNMLRNPLIQIK

SEQ ID NO: 36398 - protein, 243 aa, Diabrotica virgifera
  misc_feature: Coding regions on vcDNA: vcDNA=SeqID_16095; Strand=-; Position=0-728
  misc_feature (6)..(209): Xaa can be any naturally occurring amino acid
  misc_feature (211)..(241): Xaa can be any naturally occurring amino acid
IQPFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXRG

SEQ ID NO: 36399 - protein, 60 aa, Diabrotica virgifera
  misc_feature: Coding regions on vcDNA: vcDNA=SeqID_16096; Strand=+; Position=1-183
  misc_feature (3)..(17): Xaa can be any naturally occurring amino acid
  misc_feature (22)..(32): Xaa can be any naturally occurring amino acid
RPXXXXXXXXXXXXXXXHYFIXXXXXXXXXXXLIYMSGLLLKSTYLYNIMLPHSCLIHYF

SEQ ID NO: 36400 - protein, 266 aa, Diabrotica virgifera
  misc_feature: Coding regions on vcDNA: vcDNA=SeqID_16097; Strand=+; Position=5-806
  misc_feature: Homolog annotation: Hit_ID=XP_316723.1; Match level="QueryCoverage =92%, HitCoverage=90%, E-value=3e-56, Identity=46%"; Hit description =ENSANGP00000021004 [Anopheles gambiae]
  misc_feature: Pfam annotation: Pfam_ID=NUDIX; Match level="Score=5.8, E-value =0.062, Copies=1"; Pfam description=NUDIX domain
  misc_feature (198)..(198): Xaa can be any naturally occurring amino acid
MIKKCFELLQNQNNIKQIIRTTRTQPVSSEKWDLFAAVCLERKPVITPPLNDLQKDYKQLMSDIEFERSLKSNFELRHETDVKNLEILKKGGEIADIDVNLKQTAQDLKDMWTAEAAQFKFADTVTEADKKNDQKSLNRRLDKHLIYVLNQKVGDKKFYLLPQAIRQDGETLRQSAERILKESIGPDVKAQIYSNAPXGFYKYKYPANIRNDKNIVGAKVFIYFARYLKGQPPAKGLDFKWLDRNELRKALPPQYNDSVKQFLIDE

SEQ ID NO: 36401 - protein, 320 aa, Diabrotica virgifera
  misc_feature: Coding regions on vcDNA: vcDNA=SeqID_16098; Strand=+; Position=1-960
  misc_feature: Homolog annotation: Hit_ID=AAF87760.1; Match level="QueryCoverage =99%, HitCoverage=72%, E-value=1e-118, Identity=71%"; Hit description= cytochrome oxidase subunit I [Diabrotica virgifera zeae]
  misc_feature: Pfam annotation: Pfam_ID=COX1; Match level="Score=47.9, E-value=7.5e -13, Copies=1"; Pfam description=Cytochrome C and Quinol oxidase polyp
  misc_feature (39)..(47): Xaa can be any naturally occurring amino acid
  misc_feature (51)..(57): Xaa can be any naturally occurring amino acid
  misc_feature (68)..(75): Xaa can be any naturally occurring amino acid
  misc_feature (96)..(96): Xaa can be any naturally occurring amino acid
  misc_feature (131)..(131): Xaa can be any naturally occurring amino acid
  misc_feature (148)..(148): Xaa can be any naturally occurring amino acid
  misc_feature (151)..(157): Xaa can be any naturally occurring amino acid
  misc_feature (184)..(190): Xaa can be any naturally occurring amino acid
  misc_feature (204)..(204): Xaa can be any naturally occurring amino acid
  misc_feature (212)..(228): Xaa can be any naturally occurring amino acid
  misc_feature (258)..(258): Xaa can be any naturally occurring amino acid
  misc_feature (274)..(281): Xaa can be any naturally occurring amino acid
  misc_feature (291)..(292): Xaa can be any naturally occurring amino acid
  misc_feature (302)..(302): Xaa can be any naturally occurring amino acid
ILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRXXPLRITSSIEXLQFNPPAEHRYSGLPLYH

SEQ ID NO: 36402 - protein, 59 aa, Diabrotica virgifera
  misc_feature: Coding regions on vcDNA: vcDNA=SeqID_16099; Strand=+; Position=663-842
  misc_feature (12)..(12): Xaa can be any naturally occurring amino acid
  misc_feature (53)..(53): Xaa can be any naturally occurring amino acid
TQTQLARYFSRXIFLFFANFAELCKITNYLVIINYLVIIFWQSYYNWQNYRLXYLESCV

SEQ ID NO: 36403 - protein, 248 aa, Diabrotica virgifera
  misc_feature: Coding regions on vcDNA: vcDNA=SeqID_16100; Strand=-; Position=1-744
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(244): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAEE

SEQ ID NO: 36404 - protein, 47 aa, Diabrotica virgifera
  misc_feature: Coding regions on vcDNA: vcDNA=SeqID_16101; Strand=-; Position=1-141
  misc_feature (14)..(21): Xaa can be any naturally occurring amino acid
  misc_feature (26)..(37): Xaa can be any naturally occurring amino acid
  misc_feature (43)..(47): Xaa can be any naturally occurring amino acid
HFLTYFLFTIFNFXXXXXXXXFIYSXXXXXXXXXXXXFFSRFXXXXX

SEQ ID NO: 36405 - protein, 194 aa, Diabrotica virgifera
  misc_feature: Coding regions on vcDNA: vcDNA=SeqID_16102; Strand=-; Position=1-582
  misc_feature (30)..(37): Xaa can be any naturally occurring amino acid
  misc_feature (75)..(82): Xaa can be any naturally occurring amino acid
  misc_feature (91)..(99): Xaa can be any naturally occurring amino acid
  misc_feature (110)..(122): Xaa can be any naturally occurring amino acid
  misc_feature (134)..(151): Xaa can be any naturally occurring amino acid
  misc_feature (168)..(191): Xaa can be any naturally occurring amino acid
SCALLFSRVLLPFSPCCLFSLRLSFSLLPXXXXXXXXLVSFVLFFLWCRCARPFSSSSFRAVGLVAFLSLFFPSXXXXXXXXVPPPACPVXXXXXXXXXSPSRFFVSFWXXXXXXXXXXXXXSPPVGAGGGFFXXXXXXXXXXXXXXXXXXHRSVITIHYIYILYHQXXXXXXXXXXXXXXXXXXXXXXXXSRP

SEQ ID NO: 36406 - protein, 287 aa, Diabrotica virgifera
  misc_feature: Coding regions on vcDNA: vcDNA=SeqID_16103; Strand=-; Position=1-861
FKQKSRPVLDDYKHEDSENNKSAEFKTPEFSYVFQNNTILQDIPKSQSPKVFVDQKMTKDNEKSNSVIGYNSLKLKTLLHQNNYDDLKQRADVVEDYKIKNFETTVKHYEEPSVFLPSQIESCVIEFKSKNIETTDVKQLSDAEHILHATVENPNQTYINLPRTLNATQRSSGNKEGIPSEKSTTARKSEPLSNLLKNACLKKIYTSTKNSISKEIDMAPKEHRTENVTSEPSNDASHSSPDDDIFLMLTKEYEKHKKRQQLIDSEADSNEERFLKCLQKTSLPTRP

SEQ ID NO: 36407 - protein, 97 aa, Diabrotica virgifera
  misc_feature: Coding regions on vcDNA: vcDNA=SeqID_16104; Strand=+; Position=1-294
LAFCAQWTIHYTTEGARLTTHNSEAAALAAIPRGYFSNTLIPRKEPFISPQAIQVKIFSNLFSLPCPLLAPSGRITQDRNETILGLSMPLFDLLPLL

SEQ ID NO: 36408 - protein, 121 aa, Diabrotica virgifera; identical to SEQ ID NO: 21246
  misc_feature: Coding regions on vcDNA: vcDNA=SeqID_16105; Strand=+; Position=97-462
  misc_feature: Homolog annotation: Hit_ID=EAA44035.2; Match level="QueryCoverage =96%, HitCoverage=92%, E-value=8e-53, Identity=92%"; Hit description =ENSANGP00000024961 [Anopheles gambiae str. PEST] ref|XP_556142.1| ENSANGP00000024961 [Anopheles gambiae st
  misc_feature: Gene Ontology Annotation: Molecular function=v-SNARE activity; Cellular component=integral to membrane; Biological process =nonselective vesicle transport
  misc_feature: Pfam annotation: Pfam_ID=Synaptobrevin; Match level="Score=140.1, E -value=5.3e-39, Copies=1"; Pfam description=Synaptobrevin

SEQ ID NO: 36409 - protein, 265 aa, Diabrotica virgifera
  misc_feature: Coding regions on vcDNA: vcDNA=SeqID_16106; Strand=-; Position=3-797
  misc_feature (2)..(12): Xaa can be any naturally occurring amino acid
  misc_feature (28)..(28): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(261): Xaa can be any naturally occurring amino acid
FXXXXXXXXXXXNQPGSHRFKLRSCKIXKVEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLG

SEQ ID NO: 36410 - protein, 86 aa, Diabrotica virgifera
  misc_feature: Coding regions on vcDNA: vcDNA=SeqID_16107; Strand=-; Position=391-651
  misc_feature (2)..(12): Xaa can be any naturally occurring amino acid
HXXXXXXXXXXXYFFMCPVDGDGSTGWYWQPEVGSPKFLASFTLVDVIILNGLEWKCGKPLKYKIPLHMMKVGGLAVTTIPACRDT

SEQ ID NO: 36411 - protein, 116 aa, Diabrotica virgifera
  misc_feature: Coding regions on vcDNA: vcDNA=SeqID_16108; Strand=-; Position=414-764
  misc_feature (36)..(61): Xaa can be any naturally occurring amino acid
  misc_feature (65)..(74): Xaa can be any naturally occurring amino acid
  misc_feature (76)..(109): Xaa can be any naturally occurring amino acid
TAHFFYHTNLPFQLSIKTLMVTLLYLGQNTPFIQIXXXXXXXXXXXXXXXXXXXXXXXXXXYPIXXXXXXXXXXNXXXXXXXXXXXXXXXXXXXXXXXXXXXXXXXXXXIISYSKI

SEQ ID NO: 36412 - protein, 240 aa, Diabrotica virgifera
  misc_feature: Coding regions on vcDNA: vcDNA=SeqID_16109; Strand=-; Position=0-719
  misc_feature (2)..(10): Xaa can be any naturally occurring amino acid
  misc_feature (12)..(166): Xaa can be any naturally occurring amino acid
  misc_feature (170)..(207): Xaa can be any naturally occurring amino acid
  misc_feature (210)..(239): Xaa can be any naturally occurring amino acid
PXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISXXXXXXXXXXXXXXXXXXXXXXXXXXXXXXXXXXXXXXEVXXXXXXXXXXXXXXXXXXXXXXXXXXXXXXG

SEQ ID NO: 36413 - protein, 70 aa, Diabrotica virgifera
  misc_feature: Coding regions on vcDNA: vcDNA=SeqID_16110; Strand=+; Position=3-215
  misc_feature (2)..(2): Xaa can be any naturally occurring amino acid
  misc_feature (11)..(18): Xaa can be any naturally occurring amino acid
LXVRCLNTNNXXXXXXXXQARTRPSKEKHETEWEKNLIFFNIIVPCVPCVLTESFINYIFMIYEITRAII

SEQ ID NO: 36414 - protein, 91 aa, Diabrotica virgifera
  misc_feature: Coding regions on vcDNA: vcDNA=SeqID_16111; Strand=-; Position=249-524
ILMKFLMNDADTYNFGKYFQQNYCNNFQQWDYCYRTVYGINTNNMAIEKSVVIVYLRNKTVERIIKLKKGKPVESSIMSRYRTVLACYFTR

SEQ ID NO: 36415 - protein, 278 aa, Diabrotica virgifera
  misc_feature: Coding regions on vcDNA: vcDNA=SeqID_16112; Strand=-; Position=16-852
  misc_feature (3)..(3): Xaa can be any naturally occurring amino acid
  misc_feature (8)..(8): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(193): Xaa can be any naturally occurring amino acid
  misc_feature (197)..(234): Xaa can be any naturally occurring amino acid
  misc_feature (237)..(256): Xaa can be any naturally occurring amino acid
  misc_feature (259)..(273): Xaa can be any naturally occurring amino acid
RLXKNLSXYXKNXILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFHXXXXXXXXXXXXXXXXXXXXXXXXXXXXXXXXXXXXXXRYXXXXXXXXXXXXXXXXXXXXVKXXXXXXXXXXXXXXXNGRKI

SEQ ID NO: 36416 - protein, 31 aa, Diabrotica virgifera
  misc_feature: Coding regions on vcDNA: vcDNA=SeqID_16113; Strand=+; Position=55-147
RVFLHITDYFLQIVFYNSIFLNRVLVFVLIR

SEQ ID NO: 36417 - protein, 86 aa, Diabrotica virgifera
  misc_feature: Coding regions on vcDNA: vcDNA=SeqID_16114; Strand=+; Position=193-453
  misc_feature (36)..(43): Xaa can be any naturally occurring amino acid
  misc_feature (46)..(52): Xaa can be any naturally occurring amino acid
VFNVRFIGLFGDGEMVFLDYYLDDVLNYISKFNGLXXXXXXXXIIXXXXXXXEGADRVSVLAASPSIRSTFIQNGLKFVMIIIVMH

SEQ ID NO: 36418 - protein, 256 aa, Diabrotica virgifera
  misc_feature: Coding regions on vcDNA: vcDNA=SeqID_16115; Strand=-; Position=0-767
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(249): Xaa can be any naturally occurring amino acid
  misc_feature (251)..(255): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 36419 - protein, 267 aa, Diabrotica virgifera
  misc_feature: Coding regions on vcDNA: vcDNA=SeqID_16116; Strand=-; Position=2-805
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(241): Xaa can be any naturally occurring amino acid
  misc_feature (243)..(265): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXDA

SEQ ID NO: 36420 - protein, 127 aa, Diabrotica virgifera
  misc_feature: Coding regions on vcDNA: vcDNA=SeqID_16117; Strand=+; Position=492-872
  misc_feature (100)..(101): Xaa can be any naturally occurring amino acid
  misc_feature (120)..(125): Xaa can be any naturally occurring amino acid
KEHFLENLFRFSTLLNTTSSYFRPESRNSVKVSENSIRKTPFNFVFVRLAIFGKTGLDSAKMDLGKGTSKVFQNIRKQASRQETSVSKLTESETGKLQLXXSDSKTAHSKLHLQFSRFKXXXXXXQV

SEQ ID NO: 36421 - protein, 36 aa, Diabrotica virgifera
  misc_feature: Coding regions on vcDNA: vcDNA=SeqID_16118; Strand=-; Position=3-110
  misc_feature (2)..(13): Xaa can be any naturally occurring amino acid
  misc_feature (24)..(31): Xaa can be any naturally occurring amino acid
LXXXXXXXXXXXXPTGVSQVGFYXXXXXXXXSFRTK

SEQ ID NO: 36422 - protein, 90 aa, Diabrotica virgifera
  misc_feature: Coding regions on vcDNA: vcDNA=SeqID_16119; Strand=+; Position=431-703
  misc_feature (3)..(14): Xaa can be any naturally occurring amino acid
  misc_feature (71)..(71): Xaa can be any naturally occurring amino acid
  misc_feature (86)..(87): Xaa can be any naturally occurring amino acid
RHXXXXXXXXXXXXLNNPQVLFFKIAFYPFNLTPPLSRENVLKLCIKNAELTIPPLNPSCIFTFFRITLIXKNNGGVIRGYACSSXXSFG

SEQ ID NO: 36423 - protein, 195 aa, Diabrotica virgifera
  misc_feature: Coding regions on vcDNA: vcDNA=SeqID_16120; Strand=-; Position=3-590
  misc_feature (16)..(148): Xaa can be any naturally occurring amino acid
  misc_feature (150)..(159): Xaa can be any naturally occurring amino acid
  misc_feature (162)..(162): Xaa can be any naturally occurring amino acid
  misc_feature (188)..(194): Xaa can be any naturally occurring amino acid
TNIFVLNIQVINSNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXLYXFFSLPLPFLAFPSLSLSSYRGELIKXXXXXXXQ

SEQ ID NO: 36424 - protein, 201 aa, Diabrotica virgifera
  misc_feature: Coding regions on vcDNA: vcDNA=SeqID_16121; Strand=+; Position=61-663
  misc_feature: Homolog annotation: Hit_ID=XP_312087.1; Match level="QueryCoverage =75%, HitCoverage=26%, E-value=5e-33, Identity=43%"; Hit description =ENSANGP00000016873 [Anopheles gambiae]
  misc_feature: Gene Ontology Annotation: Cellular component=synaptic vesicle; Biological process=calcium ion homeostasis
MTAKISDDLETLTYIPESENGEGNVKLKPDLAARGSETLFLFQHVTKETAPTTFEEAAKLIGFGKFNILLISLTVFGIFSHMFEAGSVSYILAAAQCDLNLSLQQKGYLNSIIFAGMISGCFFWGFLLDVYGRQKLMTIGYLLAAGFNFLGSLSQSFDMLLFCKFFGGFIISCPFGAMSAYCKEFHSSDYRNKDQLINATL

SEQ ID NO: 36425 - protein, 278 aa, Diabrotica virgifera
  misc_feature: Coding regions on vcDNA: vcDNA=SeqID_16122; Strand=-; Position=1-834
  misc_feature (2)..(2): Xaa can be any naturally occurring amino acid
  misc_feature (6)..(277): Xaa can be any naturally occurring amino acid
KXNLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 36426 - protein, 40 aa, Diabrotica virgifera
  misc_feature: Coding regions on vcDNA: vcDNA=SeqID_16123; Strand=+; Position=12-131
  misc_feature (1)..(1): Xaa can be any naturally occurring amino acid
  misc_feature (10)..(10): Xaa can be any naturally occurring amino acid
  misc_feature (20)..(20): Xaa can be any naturally occurring amino acid
  misc_feature (23)..(31): Xaa can be any naturally occurring amino acid
  misc_feature (34)..(40): Xaa can be any naturally occurring amino acid
XYRRVQIDNXDCDLDVGLKXIIXXXXXXXXXVDXXXXXXX

SEQ ID NO: 36427 - protein, 269 aa, Diabrotica virgifera
  misc_feature: Coding regions on vcDNA: vcDNA=SeqID_16124; Strand=-; Position=1-807
  misc_feature (3)..(45): Xaa can be any naturally occurring amino acid
  misc_feature (47)..(252): Xaa can be any naturally occurring amino acid
  misc_feature (255)..(269): Xaa can be any naturally occurring amino acid
IYXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 36428 - protein, 195 aa, Diabrotica virgifera
  misc_feature: Coding regions on vcDNA: vcDNA=SeqID_16125; Strand=-; Position=1-585
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(182): Xaa can be any naturally occurring amino acid
  misc_feature (185)..(195): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGXXXXXXXXXXX

SEQ ID NO: 36429 - protein, 315 aa, Diabrotica virgifera
  misc_feature: Coding regions on vcDNA: vcDNA=SeqID_16126; Strand=-; Position=2-946
  misc_feature (6)..(6): Xaa can be any naturally occurring amino acid
  misc_feature (18)..(19): Xaa can be any naturally occurring amino acid
  misc_feature (25)..(33): Xaa can be any naturally occurring amino acid
  misc_feature (36)..(36): Xaa can be any naturally occurring amino acid
  misc_feature (41)..(310): Xaa can be any naturally occurring amino acid
YKLYPXIEVAIFIIDLTXXIKLRCXXXXXXXXXQKXLDQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGPHAS

SEQ ID NO: 36430 - protein, 265 aa, Diabrotica virgifera
  misc_feature: Coding regions on vcDNA: vcDNA=SeqID_16127; Strand=+; Position=99-893
  misc_feature: Homolog annotation: Hit_ID=XP_393741.1; Match level="QueryCoverage =58%, HitCoverage=80%, E-value=1e-33, Identity=50%"; Hit description =similar to ENSANGP00000016906 [Apis mellifera]
MSTAQVQMLNPPAVKTGHKNPVKPPNPSNQNKRKNKHDRSSRKRSKSFSGCGIIINQKPVLPSKFLLGGNIKDPLNLNSLQDEEINRAMNAVTPKSSPVPTPPRKKGQLEVIIPKNIHDPLNLIDCDDDAEYEQQLCSPIKKSKKKRLKKRRTMSGTMDVSDVTADISSTTEAKTPESSADSAKIPEIPEPEEQVMPSLEVPSISNPNPDVPVDIPISDPCVGTSTMLSTIVPAPIKKDKSKRKLEDAHHLVKKLKNNSDGSVCE

SEQ ID NO: 36431 - protein, 64 aa, Diabrotica virgifera
  misc_feature: Coding regions on vcDNA: vcDNA=SeqID_16128; Strand=+; Position=1-192
  misc_feature (1)..(21): Xaa can be any naturally occurring amino acid
  misc_feature (24)..(61): Xaa can be any naturally occurring amino acid
XXXXXXXXXXXXXXXXXXXXXYLXXXXXXXXXXXXXXXXXXXXXXXXXXXXXXXXXXXXXXEIV

SEQ ID NO: 36432 - protein, 153 aa, Diabrotica virgifera
  misc_feature: Coding regions on vcDNA: vcDNA=SeqID_16129; Strand=+; Position=274-732
  misc_feature (17)..(25): Xaa can be any naturally occurring amino acid
  misc_feature (27)..(34): Xaa can be any naturally occurring amino acid
  misc_feature (40)..(51): Xaa can be any naturally occurring amino acid
  misc_feature (64)..(113): Xaa can be any naturally occurring amino acid
  misc_feature (119)..(152): Xaa can be any naturally occurring amino acid
ISLSKQYHFSIKISFLXXXXXXXXXGXXXXXXXXLKFQFXXXXXXXXXXXXHFKICYSFIFIYXXXXXXXXXXXXXXXXXXXXXXXXXXXXXXXXXXXXXXXXXXXXXXXXXXVIKTGXXXXXXXXXXXXXXXXXXXXXXXXXXXXXXXXXXK

SEQ ID NO: 36433 - protein, 110 aa, Diabrotica virgifera
  misc_feature: Coding regions on vcDNA: vcDNA=SeqID_16130; Strand=-; Position=126-458
  misc_feature (15)..(39): Xaa can be any naturally occurring amino acid
  misc_feature (47)..(53): Xaa can be any naturally occurring amino acid
  misc_feature (59)..(66): Xaa can be any naturally occurring amino acid
  misc_feature (82)..(102): Xaa can be any naturally occurring amino acid
YVKSEMNNRYFEKMXXXXXXXXXXXXXXXXXXXXXXXXXRIFSINSXXXXXXXDILLVXXXXXXXXEIRYYLETSNVSITEXXXXXXXXXXXXXXXXXXXXXRVEKYVNY

SEQ ID NO: 36434 - protein, 32 aa, Diabrotica virgifera
  misc_feature: Coding regions on vcDNA: vcDNA=SeqID_16131; Strand=-; Position=1-96
  misc_feature (3)..(26): Xaa can be any naturally occurring amino acid
  misc_feature (29)..(29): Xaa can be any naturally occurring amino acid
SKXXXXXXXXXXXXXXXXXXXXXXXXNYXIIN

SEQ ID NO: 36435 - protein, 69 aa, Diabrotica virgifera
  misc_feature: Coding regions on vcDNA: vcDNA=SeqID_16132; Strand=-; Position=200-409
  misc_feature (24)..(31): Xaa can be any naturally occurring amino acid
GPFVVTYINKLKIELYLAHPGLIXXXXXXXXSIRLNHIAATPIINFRSTSRSHISVIDSNPAIKIRCSP

SEQ ID NO: 36436 - protein, 275 aa, Diabrotica virgifera
  misc_feature: Coding regions on vcDNA: vcDNA=SeqID_16133; Strand=+; Position=1-825
  misc_feature (1)..(6): Xaa can be any naturally occurring amino acid
  misc_feature (10)..(21): Xaa can be any naturally occurring amino acid
  misc_feature (24)..(61): Xaa can be any naturally occurring amino acid
  misc_feature (64)..(274): Xaa can be any naturally occurring amino acid
XXXXXXVREXXXXXXXXXXXXYLXXXXXXXXXXXXXXXXXXXXXXXXXXXXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 36437 - protein, 79 aa, Diabrotica virgifera; identical to SEQ ID NO: 27306
  misc_feature: Coding regions on vcDNA: vcDNA=SeqID_16134; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 36438 - protein, 70 aa, Diabrotica virgifera
  misc_feature: Coding regions on vcDNA: vcDNA=SeqID_16135; Strand=+; Position=317-529
  misc_feature (62)..(69): Xaa can be any naturally occurring amino acid
LSIFLFYHLLFKNNTVDKIPSVAEKGLIIKIFLFSQWCEHCQLNRNVWPYFYTHTNCGKCIXXXXXXXXI

SEQ ID NO: 36439 - protein, 83 aa, Diabrotica virgifera
  misc_feature: Coding regions on vcDNA: vcDNA=SeqID_16136; Strand=-; Position=550-801
ISELLCWIIRMYLLGLPMSQEIQEFETMYELNGVIYKLPFHNNFHFCSWGVFHVFANHFEKCDSCRIHIKVYHSEESLAITHR

SEQ ID NO: 36440 - protein, 143 aa, Diabrotica virgifera
  misc_feature: Coding regions on vcDNA: vcDNA=SeqID_16137; Strand=+; Position=2-433
  misc_feature: Homolog annotation: Hit_ID=DAA02571.1; Match level="QueryCoverage =38%, HitCoverage=8%, E-value=1e-18, Identity=70%"; Hit description =TPA: HDC06910 [Drosophila melanogaster]
DMKSVGSFYYENFAFPGMVPYKRTAGDKSGVPVYQPASATYQQLLQPFVPVSCEYRSSSAAFTGVALNKVIPQYQPITTTASYPPNVATYPSAASPFQFQVRPPPQIPQTPLISDLIAAQYPSTPVNNNNEDELQPYKKMKTT

SEQ ID NO: 36441 - protein, 69 aa, Diabrotica virgifera
  misc_feature: Coding regions on vcDNA: vcDNA=SeqID_16138; Strand=-; Position=68-277
MDRKYFGNFLSFLNYSKTPRKRFLYKYQYLRAFSTLFNKQVKERKSYVNAYTWTVSKNFKFISSFPIYL

SEQ ID NO: 36442 - protein, 26 aa, Diabrotica virgifera
  misc_feature: Coding regions on vcDNA: vcDNA=SeqID_16139; Strand=-; Position=2-79
EISSMRFQELIKNLLSFQYRTALTGI

SEQ ID NO: 36443 - protein, 66 aa, Diabrotica virgifera; identical to SEQ ID NO: 26808
  misc_feature: Coding regions on vcDNA: vcDNA=SeqID_16140; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36444 - protein, 122 aa, Diabrotica virgifera
  misc_feature: Coding regions on vcDNA: vcDNA=SeqID_16141; Strand=-; Position=1-366
  misc_feature (6)..(36): Xaa can be any naturally occurring amino acid
  misc_feature (43)..(103): Xaa can be any naturally occurring amino acid
  misc_feature (105)..(122): Xaa can be any naturally occurring amino acid
YIYKKXXXXXXXXXXXXXXXXXXXXXXXXXXXXXXXSIRVSRXXXXXXXXXXXXXXXXXXXXXXXXXXXXXXXXXXXXXXXXXXXXXXXXXXXXXXXXXXXXXIXXXXXXXXXXXXXXXXXX

SEQ ID NO: 36445 - protein, 130 aa, Diabrotica virgifera
  misc_feature: Coding regions on vcDNA: vcDNA=SeqID_16142; Strand=+; Position=335-730
  misc_feature: Homolog annotation: Hit_ID=AAM93477.1; Match level="QueryCoverage =89%, HitCoverage=31%, E-value=2e-18, Identity=43%"; Hit description =H+-transporting ATP synthase alpha subunit isoform 1 [Myxine glutinosa]
  misc_feature: Gene Ontology Annotation: Molecular function=hydrogen-transporting ATP synthase activity, rotational mechanism; Cellular component =extracellular space; Biological process=hydrogen transport
  misc_feature (38)..(38): Xaa can be any naturally occurring amino acid
  misc_feature (48)..(48): Xaa can be any naturally occurring amino acid
  misc_feature (79)..(79): Xaa can be any naturally occurring amino acid
  misc_feature (87)..(87): Xaa can be any naturally occurring amino acid
  misc_feature (92)..(92): Xaa can be any naturally occurring amino acid
SNPGHGFRGCIHDPINHHLLSGDKNFEKKLYCIYYSIXKDTHSASKLXTRLPHAEDCHYTIIDSRTGCAAAHLRYLFPXAFCWYDRXYYDNXIPALILYDELSEQAEDYREMSLLLLRTPRRDSYAVDEF

SEQ ID NO: 36446 - protein, 251 aa, Diabrotica virgifera
  misc_feature: Coding regions on vcDNA: vcDNA=SeqID_16143; Strand=+; Position=1-753
  misc_feature (1)..(21): Xaa can be any naturally occurring amino acid
  misc_feature (23)..(61): Xaa can be any naturally occurring amino acid
  misc_feature (64)..(250): Xaa can be any naturally occurring amino acid
XXXXXXXXXXXXXXXXXXXXXTXXXXXXXXXXXXXXXXXXXXXXXXXXXXXXXXXXXXXXXKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXA

SEQ ID NO: 36447 - protein, 128 aa, Diabrotica virgifera
  misc_feature: Coding regions on vcDNA: vcDNA=SeqID_16144; Strand=+; Position=1-387
  misc_feature (3)..(74): Xaa can be any naturally occurring amino acid
  misc_feature (84)..(95): Xaa can be any naturally occurring amino acid
PLXXXXXXXXXXXXXXXXXXXXXXXXXXXXXXXXXXXXXXXXXXXXXXXXXXXXXXXXXXXXXXXXXXXXXXXXFKSFTFSYRXXXXXXXXXXXXEDIDLIKDFRNTFFHQDIKHMPFWINSIDSPGH

SEQ ID NO: 36448 - protein, 152 aa, Diabrotica virgifera
  misc_feature: Coding regions on vcDNA: vcDNA=SeqID_16145; Strand=+; Position=271-729
  misc_feature: Pfam annotation: Pfam_ID=DUF227; Match level="Score=-4.4, E-value =0.0037, Copies=1"; Pfam description=Domain of unknown function (DUF227)
  misc_feature (110)..(110): Xaa can be any naturally occurring amino acid
  misc_feature (137)..(137): Xaa can be any naturally occurring amino acid
  misc_feature (145)..(146): Xaa can be any naturally occurring amino acid
  misc_feature (152)..(152): Xaa can be any naturally occurring amino acid
HITRFLMQLFRKRKVRYPAFPFPMCFKMFSTDDRDVLVYNNLFSMGFQPIHSRSFSPITINVILRQLAEFHALSFSAFDQCTEEFQELLSKWLPDIKSLLASLNLEDNLXTGLQVVADMLMEEKRFDLKEKMEKDLXDGFLAIAXXSVSEVX

SEQ ID NO: 36449 - protein, 22 aa, Diabrotica virgifera
  misc_feature: Coding regions on vcDNA: vcDNA=SeqID_16146; Strand=-; Position=1-66
  misc_feature (2)..(2): Xaa can be any naturally occurring amino acid
  misc_feature (4)..(21): Xaa can be any naturally occurring amino acid
SXPXXXXXXXXXXXXXXXXXXN

SEQ ID NO: 36450 - protein, 149 aa, Diabrotica virgifera
  misc_feature: Coding regions on vcDNA: vcDNA=SeqID_16147; Strand=+; Position=494-940
  misc_feature: Homolog annotation: Hit_ID=NP_777225.1; Match level="QueryCoverage =93%, HitCoverage=23%, E-value=3e-14, Identity=30%"; Hit description =p97 protein [Bos taurus] dbj|BAA20065.1| bucentaur [Bos taurus]
  misc_feature (85)..(85): Xaa can be any naturally occurring amino acid
  misc_feature (130)..(130): Xaa can be any naturally occurring amino acid
  misc_feature (144)..(144): Xaa can be any naturally occurring amino acid
MDVQDNGQAWIRKTNKRAPKSNRNRKLRGIINIGTWNIKTMLAMSKMEEVAKEMSDYNIDIIALQELTWKEEGRIDKQNYTMYYXGENTQGRNGTGFMISRTWREYVLEFKKVNGRISYLRINNRAANIXMINIYAPTEQADDXEKDDF

SEQ ID NO: 36451 - protein, 24 aa, Diabrotica virgifera
  misc_feature: Coding regions on vcDNA: vcDNA=SeqID_16148; Strand=-; Position=0-71
  misc_feature (3)..(23): Xaa can be any naturally occurring amino acid
KLXXXXXXXXXXXXXXXXXXXXXA

SEQ ID NO: 36452 - protein, 207 aa, Diabrotica virgifera
  misc_feature: Coding regions on vcDNA: vcDNA=SeqID_16149; Strand=-; Position=3-623
  misc_feature (3)..(35): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(75): Xaa can be any naturally occurring amino acid
  misc_feature (89)..(95): Xaa can be any naturally occurring amino acid
  misc_feature (97)..(103): Xaa can be any naturally occurring amino acid
  misc_feature (110)..(207): Xaa can be any naturally occurring amino acid
IYXXXXXXXXXXXXXXXXXXXXXXXXXXXXXXXXXKINXXIXLIXXXXXXXXXXXXXXXXXXXXXXXXXXXXXXXHPNYSVPGRDYILXXXXXXXNXXXXXXXRNSYINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36453 - protein, 17 aa, Diabrotica virgifera
  misc_feature: Coding regions on vcDNA: vcDNA=SeqID_16150; Strand=-; Position=0-50
AQFDVSVRYYSHVRLYG

SEQ ID NO: 36454 - protein, 71 aa, Diabrotica virgifera
  misc_feature: Coding regions on vcDNA: vcDNA=SeqID_16151; Strand=+; Position=359-569
  misc_feature (39)..(39): Xaa can be any naturally occurring amino acid
MSSKTQFYPHSTSKQTSRPPSRTHHPMPTPPTTPQHHPXPPRRTHEHPSPPPRAALTTTSDRTTLRDRASP

SEQ ID NO: 36455 - protein, 89 aa, Diabrotica virgifera
  misc_feature: Coding regions on vcDNA: vcDNA=SeqID_16152; Strand=+; Position=1-270
  misc_feature (1)..(41): Xaa can be any naturally occurring amino acid
  misc_feature (60)..(74): Xaa can be any naturally occurring amino acid
  misc_feature (80)..(87): Xaa can be any naturally occurring amino acid
XXXXXXXXXXXXXXXXXXXXXXXXXXXXXXXXXXXXXXXXXDVPIFVILISKFLGHKIIXXXXXXXXXXXXXXXPHINLXXXXXXXXLY

SEQ ID NO: 36456 - protein, 116 aa, Diabrotica virgifera
  misc_feature: Coding regions on vcDNA: vcDNA=SeqID_16153; Strand=+; Position=98-445
  misc_feature: Homolog annotation: Hit_ID=AAD02197.1; Match level="QueryCoverage =95%, HitCoverage=64%, E-value=6e-32, Identity=61%"; Hit description =putative ferritin-1 heavy chain [Schistosoma japonicum]
  misc_feature: Gene Ontology Annotation: Molecular function=iron ion binding; Cellular component=ferritin complex; Biological process=iron ion homeostasis
  misc_feature: Pfam annotation: Pfam_ID=Ferritin; Match level="Score=81.0, E-value =3.2e-21, Copies=1"; Pfam description=Ferritin-like domain
MSQVRQNFHKDCEDAINKQINVELSASYVYMTMAYHFHRDDVALMGFHKYFKECSEEEREHAYRLMEYMYKRGGKIILSEIKAPEKQERTSPGEAMAPALNLEQGVNESLLHHPKV

SEQ ID NO: 36457 - protein, 31 aa, Diabrotica virgifera
  misc_feature: Coding regions on vcDNA: vcDNA=SeqID_16154; Strand=-; Position=3-95
  misc_feature (21)..(31): Xaa can be any naturally occurring amino acid
LNRIEFRKKLINSCYKTHWGXXXXXXXXXXX

SEQ ID NO: 36458 - protein, 250 aa, Diabrotica virgifera
  misc_feature: Coding regions on vcDNA: vcDNA=SeqID_16155; Strand=+; Position=87-836
  misc_feature: Homolog annotation: Hit_ID=CAC39318.1; Match level="QueryCoverage =82%, HitCoverage=32%, E-value=3e-26, Identity=36%"; Hit description =VMP3 protein [Volvox carteri f. nagariensis]
  misc_feature: Gene Ontology Annotation: Molecular function=actin binding; Cellular component=actin cortical patch (sensu Saccharomyces); Biological process=endocytosis
  misc_feature (130)..(136): Xaa can be any naturally occurring amino acid
  misc_feature (200)..(212): Xaa can be any naturally occurring amino acid
  misc_feature (240)..(248): Xaa can be any naturally occurring amino acid
MLPNLPSSEPNARSARQERTHPTQTSDPGKRRHTRENTGTDKETPKKRKASGQAHAQTKNDPTQRHPRPPTTTGPRSRPPSFFLDNRHPTKRAPNRPPPSHPTHHQQPAPPSTPAHPPTPHSTDTYDTPXXXXXXXASPPPPQPARAPPRPDQTEETNAAPQRPSPPAGTPPPRPPHHTPPRPNTRAPPTPPPPPPPPPXXXXXXXXXXXXXPPPGHEPNAPAPPPPPPRPSNHSPNPPXXXXXXXXXPP

SEQ ID NO: 36459 - protein, 223 aa, Diabrotica virgifera
  misc_feature: Coding regions on vcDNA: vcDNA=SeqID_16156; Strand=-; Position=2-670
  misc_feature (10)..(223): Xaa can be any naturally occurring amino acid
LFYPSTFIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36460 - protein, 150 aa, Diabrotica virgifera
  misc_feature: Coding regions on vcDNA: vcDNA=SeqID_16157; Strand=-; Position=3-452
  misc_feature (33)..(39): Xaa can be any naturally occurring amino acid
  misc_feature (51)..(59): Xaa can be any naturally occurring amino acid
  misc_feature (61)..(150): Xaa can be any naturally occurring amino acid
TGVGPGGAFFLTEVAGIFLGSSYDTMKTFRSSXXXXXXXYESRQIFFLITXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36461 - protein, 70 aa, Diabrotica virgifera
  misc_feature: Coding regions on vcDNA: vcDNA=SeqID_16158; Strand=+; Position=626-835
  misc_feature (26)..(33): Xaa can be any naturally occurring amino acid
  misc_feature (44)..(55): Xaa can be any naturally occurring amino acid
  misc_feature (58)..(70): Xaa can be any naturally occurring amino acid
LYKGSIIICLLIEGWYEWLDEKYTFXXXXXXXXFLVKRLRFYCXXXXXXXXXXXXYIXXXXXXXXXXXXX

SEQ ID NO: 36462 - protein, 77 aa, Diabrotica virgifera
  misc_feature: Coding regions on vcDNA: vcDNA=SeqID_16159; Strand=-; Position=75-308
  misc_feature (14)..(20): Xaa can be any naturally occurring amino acid
  misc_feature (27)..(34): Xaa can be any naturally occurring amino acid
  misc_feature (52)..(60): Xaa can be any naturally occurring amino acid
PSDVQGGKFGPQRXXXXXXXRNIFNFXXXXXXXXFNIILDLLISWNKKNSLXXXXXXXXXIWGQRRTPFSFLVPILY

SEQ ID NO: 36463 - protein, 25 aa, Diabrotica virgifera
  misc_feature: Coding regions on vcDNA: vcDNA=SeqID_16160; Strand=-; Position=1-75
  misc_feature (13)..(22): Xaa can be any naturally occurring amino acid
VYSFLHYYILRKXXXXXXXXXXPDT

SEQ ID NO: 36464 - protein, 20 aa, Diabrotica virgifera
  misc_feature: Coding regions on vcDNA: vcDNA=SeqID_16161; Strand=+; Position=1-60
  misc_feature (1)..(12): Xaa can be any naturally occurring amino acid
XXXXXXXXXXXXFLLPAGRQ

SEQ ID NO: 36465 - protein, 52 aa, Diabrotica virgifera
  misc_feature: Coding regions on vcDNA: vcDNA=SeqID_16162; Strand=+; Position=3-161
VEIDMPIAIVHFSTHHIRQNPMNIFWRLDIIHNRFLRGNLFELCEKKIISIM

SEQ ID NO: 36466 - protein, 294 aa, Diabrotica virgifera
  misc_feature: Coding regions on vcDNA: vcDNA=SeqID_16163; Strand=+; Position=2-883
  misc_feature (1)..(15): Xaa can be any naturally occurring amino acid
  misc_feature (18)..(254): Xaa can be any naturally occurring amino acid
  misc_feature (269)..(275): Xaa can be any naturally occurring amino acid
  misc_feature (280)..(293): Xaa can be any naturally occurring amino acid
XXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTFFLKDGEDPYKRXXXXXXXGFFKXXXXXXXXXXXXXXG

SEQ ID NO: 36467 - protein, 35 aa, Diabrotica virgifera
  misc_feature: Coding regions on vcDNA: vcDNA=SeqID_16164; Strand=-; Position=1-105
  misc_feature (7)..(35): Xaa can be any naturally occurring amino acid
KKFRLYXXXXXXXXXXXXXXXXXXXXXXXXXXXXX

SEQ ID NO: 36468 - protein, 115 aa, Diabrotica virgifera
  misc_feature: Coding regions on vcDNA: vcDNA=SeqID_16165; Strand=-; Position=1-345
  misc_feature (90)..(90): Xaa can be any naturally occurring amino acid
  misc_feature (96)..(96): Xaa can be any naturally occurring amino acid
  misc_feature (106)..(112): Xaa can be any naturally occurring amino acid
KKNLLLSGFFYIVLCSFGFILVRCSFIRPFPVFFSVFCSCYRCFFCFCLIAVPIASHFVHRLDLLFSRFVGSTFLKEKSSFSPLLHPQKXFSLLLXSTTHTLAPLXXXXXXXPRR

SEQ ID NO: 36469 - protein, 60 aa, Diabrotica virgifera
  misc_feature: Coding regions on vcDNA: vcDNA=SeqID_16166; Strand=-; Position=394-576
  misc_feature (46)..(55): Xaa can be any naturally occurring amino acid
KRVATCTGELRRQFCASYYQFIRSQVSLGNVCHRRTVFLGRVTHRXXXXXXXXXXRHGLI

SEQ ID NO: 36470 - protein, 131 aa, Diabrotica virgifera
  misc_feature: Coding regions on vcDNA: vcDNA=SeqID_16167; Strand=+; Position=2-394
  misc_feature (7)..(7): Xaa can be any naturally occurring amino acid
SPRPGGXHGEEREPFPAPTRRQGRPEGRPAPGRNPQPNVTTAGTAEQGDEGGPGPTTGTAQEPTTRQKRKKTHQQSQERPQTKREDTKRGRQQTNAAPQPAERRRKKTTKKNFEQEAKRNGTRTPGRAKGP

SEQ ID NO: 36471 - protein, 297 aa, Diabrotica virgifera
  misc_feature: Coding regions on vcDNA: vcDNA=SeqID_16168; Strand=-; Position=3-893
  misc_feature (14)..(27): Xaa can be any naturally occurring amino acid
  misc_feature (33)..(297): Xaa can be any naturally occurring amino acid
LLHNYKLNPHRRSXXXXXXXXXXXXXXVIPKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36472 - protein, 76 aa, Diabrotica virgifera
  misc_feature: Coding regions on vcDNA: vcDNA=SeqID_16169; Strand=+; Position=1-231
EHLMRSLISAVFLNIEHVFLNLRVSPWIILNSLRLHILYCGFISLIGSAVEVHDCFVQVVKTFWSIKCFRFVTYRL

SEQ ID NO: 36473 - protein, 81 aa, Diabrotica virgifera
  misc_feature: Coding regions on vcDNA: vcDNA=SeqID_16170; Strand=+; Position=441-683
DLPFSKFVVTCLSSLIYKTRFLPLFVLTGPYGPAATYLLHTTPTPFTLCFPCHFLSLLPNRNLPKALPTSPFLYPILYFPT

SEQ ID NO: 36474 - protein, 79 aa, Diabrotica virgifera
  misc_feature: Coding regions on vcDNA: vcDNA=SeqID_16171; Strand=-; Position=3-239
  misc_feature (64)..(70): Xaa can be any naturally occurring amino acid
  misc_feature (73)..(79): Xaa can be any naturally occurring amino acid
RFHVLVSPFDLLRHLKTSCLPDSCINLIIFRFFINVNYSFKFIFYDKICTRSLTIIFYVICSYXXXXXXXFLXXXXXXX

SEQ ID NO: 36475 - protein, 275 aa, Diabrotica virgifera
  misc_feature: Coding regions on vcDNA: vcDNA=SeqID_16172; Strand=+; Position=35-862
  misc_feature: Homolog annotation: Hit_ID=EAL31805.1; Match level="QueryCoverage =83%, HitCoverage=77%, E-value=3e-25, Identity=29%"; Hit description =GA11412-PA [Drosophila pseudoobscura]
  misc_feature (154)..(163): Xaa can be any naturally occurring amino acid
MSCIYFSLLHKTVKNNNCVAILLRNYSRKVGSGNNSESPYKYVKSKQPIEDSCNLVWRDPSFELLAANEFPLFLRGNIGIAWYDTQTTVRSQHELIMEQIDDSSCEQGDMVVRIQTCPTLLRQIAKDLFPYRTLQDNGELSVITVALKPNIKDXXXXXXXXXXRLAQTFLIAAKSICDKLRNVGYWADFINPFSGRPYFAPSALRELYQNDEKFRCLDFQIVENKDCKVISNEDSGKKHFIGSLFTNAPLNKDNPHSIFCMKCVFNFLMLIVLNS

SEQ ID NO: 36476 - protein, 74 aa, Diabrotica virgifera
  misc_feature: Coding regions on vcDNA: vcDNA=SeqID_16173; Strand=+; Position=72-295
  misc_feature: Homolog annotation: Hit_ID=EAA07909.2; Match level="QueryCoverage =86%, HitCoverage=5%, E-value=2e-22, Identity=71%"; Hit description =ENSANGP00000018189 [Anopheles gambiae str. PEST] ref|XP_563123.1| ENSANGP00000018189 [Anopheles gambiae str
  misc_feature: Gene Ontology Annotation: Molecular function=transcription factor activity
  misc_feature: Pfam annotation: Pfam_ID=SelR; Match level="Score=-5.2, E-value=8.9e -09, Copies=1"; Pfam description=SelR domain
  misc_feature (14)..(14): Xaa can be any naturally occurring amino acid
MLHRKKEQKDPSLXGANLLLLITQPGRIRTEVTCAECGAHLGHVFGDGPPPTRKRFCINSASLNFIPHEKKDES

SEQ ID NO: 36477 - protein, 189 aa, Diabrotica virgifera
  misc_feature: Coding regions on vcDNA: vcDNA=SeqID_16174; Strand=+; Position=108-674
  misc_feature: Homolog annotation: Hit_ID=XP_317325.1; Match level="QueryCoverage =94%, HitCoverage=27%, E-value=2e-65, Identity=67%"; Hit description =ENSANGP00000006861 [Anopheles gambiae]
  misc_feature: Gene Ontology Annotation: Molecular function=neurotransmitter:sodium symporter activity; Cellular component=ubiquitin ligase complex; Biological process=cell organization and biogenesis
  misc_feature: Pfam annotation: Pfam_ID=Pro_isomerase; Match level="Score=65.0, E -value=2.1e-16, Copies=1"; Pfam description=Cyclophilin type peptidyl- prolyl cis-t
MSVVIVTTLGDITVDLYLNDRPRACLNFLKLCKLKYYNYNLFHTISRGFIAQTGDPTGSRSGGSSMYGLLDGPNKRYFEAEDEPRIKHTKMGLISFVGNEDHMIGSQFFFTLGEDLIYLDQKHCVFGEVVEGMSVLEEINEVICDNDDCPYQDVRITHTVILSDPFPDPKRLVVPSRSRNRREDSSTIA

SEQ ID NO: 36478 - protein, 95 aa, Diabrotica virgifera
  misc_feature: Coding regions on vcDNA: vcDNA=SeqID_16175; Strand=-; Position=331-618
  misc_feature (9)..(17): Xaa can be any naturally occurring amino acid
  misc_feature (57)..(64): Xaa can be any naturally occurring amino acid
LENDKRYSXXXXXXXXXPKKSYIFVWYLFFVSLIFFKLHGGKGRSSRKSKNELHNLXXXXXXXXIYFNAVQLFKHALLNDTPPSVSATSQRPVIL

SEQ ID NO: 36479 - protein, 78 aa, Diabrotica virgifera
  misc_feature: Coding regions on vcDNA: vcDNA=SeqID_16176; Strand=-; Position=3-236
ESRKIKNRRENISNKSKDCDSRIKLEIQLRLSKCYVWSSLFYAVETWSLKTSTVNKLEVFKMWTSRRILEISCAYLER

SEQ ID NO: 36480 - protein, 29 aa, Diabrotica virgifera
  misc_feature: Coding regions on vcDNA: vcDNA=SeqID_16177; Strand=-; Position=1-87
PGGGRHLFFSDWDPSQKNFRGFSLRVIFF

SEQ ID NO: 36481 - protein, 164 aa, Diabrotica virgifera
  misc_feature: Coding regions on vcDNA: vcDNA=SeqID_16178; Strand=-; Position=352-846
  misc_feature: Homolog annotation: Hit_ID=S13329; Match level="QueryCoverage=87%, HitCoverage=14%, E-value=2e-39, Identity=56%"; Hit description =hypothetical protein 2 - fruit fly (Drosophila melanogaster)
YAVIEVKYLGIHLDRSLTWRKHIWTKRKQLGLQFRNVYWLMGRSSRLSLDNKLLLYKAILMPIWTYGLELWGTASHSNIEIIQRFQSKTLRTITNAPWYINNRIIHRDLKTDTVQEVITKRSAAYIAKLEDHENQFALNLLDNSQEQRRLKRFKPLDLPFRVNF

SEQ ID NO: 36482 - protein, 49 aa, Diabrotica virgifera
  misc_feature: Coding regions on vcDNA: vcDNA=SeqID_16179; Strand=+; Position=12-161
  misc_feature (7)..(7): Xaa can be any naturally occurring amino acid
APGGIMXQRSEPPLNGTKKNAERENKKYLRWFSLTECLQRDPHVDPIVQ

SEQ ID NO: 36483 - protein, 271 aa, Diabrotica virgifera
  misc_feature: Coding regions on vcDNA: vcDNA=SeqID_16180; Strand=+; Position=2-814
  misc_feature: Homolog annotation: Hit_ID=NP_476739.1; Match level="QueryCoverage =100%, HitCoverage=83%, E-value=1e-104, Identity=30%"; Hit description=CG1977-PA [Drosophila melanogaster] gb|AAF47569.1| CG1977-PA [Drosophila melanogaster]
  misc_feature: Gene Ontology Annotation: Molecular function=actin binding; Cellular component=plasma membrane; Biological process=neuromuscular synaptic transmission
  misc_feature: Pfam annotation: Pfam_ID=Spectrin; Match level="Score=157.6, E-value =2.8e-44, Copies=2"; Pfam description=Spectrin repeat
  misc_feature (212)..(212): Xaa can be any naturally occurring amino acid
  misc_feature (223)..(223): Xaa can be any naturally occurring amino acid
  misc_feature (237)..(237): Xaa can be any naturally occurring amino acid
LEDVGEDLEQVEVMQKKFDDFQTDLKANEVRLAEMNEIAMQLVSLDQTEAAMKIRTQIDDLNTKWTDLQKLTSERANQLGSAHEVQRFHRDVDETKDWITEKDEALNNDDLGKDLRSVQTLQRKHEGLERDLAALGDKIKQLDDTANRLVNSHPESAEQTRLKQEEITELWTQLTAKANSRKEKLLDSYDLQRFLNDHRDLLAWISSMLALXSSEELGNDVTXQKLLIERHQEHRTXEIDARAGPFLHLDNSLNSCLNRIHYVCPQTPRTL

SEQ ID NO: 36484 - protein, 334 aa, Diabrotica virgifera
  misc_feature: Coding regions on vcDNA: vcDNA=SeqID_16181; Strand=-; Position=0-1001
  misc_feature (1)..(14): Xaa can be any naturally occurring amino acid
  misc_feature (16)..(22): Xaa can be any naturally occurring amino acid
  misc_feature (25)..(330): Xaa can be any naturally occurring amino acid
XXXXXXXXXXXXXXKXXXXXXXRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDARG

SEQ ID NO: 36485 - protein, 23 aa, Diabrotica virgifera
  misc_feature: Coding regions on vcDNA: vcDNA=SeqID_16182; Strand=-; Position=0-68
  misc_feature (5)..(17): Xaa can be any naturally occurring amino acid
RGGRXXXXXXXXXXXXXLLSLKV

SEQ ID NO: 36486 - protein, 97 aa, Diabrotica virgifera
  misc_feature: Coding regions on vcDNA: vcDNA=SeqID_16183; Strand=+; Position=2-295
  misc_feature (1)..(44): Xaa can be any naturally occurring amino acid
  misc_feature (47)..(84): Xaa can be any naturally occurring amino acid
XXXXXXXXXXXXXXXXXXXXXXXXXXXXXXXXXXXXXXXXXXXXSFXXXXXXXXXXXXXXXXXXXXXXXXXXXXXXXXXXXXXXRDPMSFININRFF

SEQ ID NO: 36487 - protein, 359 aa, Diabrotica virgifera
  misc_feature: Coding regions on vcDNA: vcDNA=SeqID_16184; Strand=-; Position=1-1077
  misc_feature (6)..(12): Xaa can be any naturally occurring amino acid
  misc_feature (25)..(359): Xaa can be any naturally occurring amino acid
NPPSGXXXXXXXWTFPKKIPLFSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36488 - protein, 52 aa, Diabrotica virgifera
  misc_feature: Coding regions on vcDNA: vcDNA=SeqID_16185; Strand=-; Position=5-163
  misc_feature (19)..(31): Xaa can be any naturally occurring amino acid
YLVIIHKTIKISLIYLFNXXXXXXXXXXXXXPGPRDQNMNDHVIKITLLSQS

SEQ ID NO: 36489 - protein, 71 aa, Diabrotica virgifera
  misc_feature: Coding regions on vcDNA: vcDNA=SeqID_16186; Strand=+; Position=211-426
PSVFYFTLTFTIRNINTHNNQYSYQSIYCVKFPLVINRCNLILMHITVYEYMSYSLKCFSLSYHNISNQSI

SEQ ID NO: 36490 - protein, 244 aa, Diabrotica virgifera
  misc_feature: Coding regions on vcDNA: vcDNA=SeqID_16187; Strand=-; Position=1-732
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(229): Xaa can be any naturally occurring amino acid
  misc_feature (231)..(240): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXGREG

SEQ ID NO: 36491 - protein, 126 aa, Diabrotica virgifera
  misc_feature: Coding regions on vcDNA: vcDNA=SeqID_16188; Strand=+; Position=3-383
  misc_feature (47)..(59): Xaa can be any naturally occurring amino acid
  misc_feature (63)..(118): Xaa can be any naturally occurring amino acid
PLRAREQQRQKKETFFYGPRAKEDREREGDANKRQTKKTFLVYQALXXXXXXXXXXXXXGAKXXXXXXXXXXXXXXXXXXXXXXXXXXXXXXXXXXXXXXXXXXXXXXXXXXXXXXXXTSLKIELY

SEQ ID NO: 36492 - protein, 79 aa, Diabrotica virgifera
  misc_feature: Coding regions on vcDNA: vcDNA=SeqID_16189; Strand=+; Position=1-240
  misc_feature: Homolog annotation: Hit_ID=EAA05846.2; Match level="QueryCoverage =100%, HitCoverage=81%, E-value=7e-30, Identity=73%"; Hit description= ENSANGP00000011079 [Anopheles gambiae str. PEST] ref|XP_559756.1| ENSANGP00000011079 [Anopheles gambiae s
  misc_feature: Pfam annotation: Pfam_ID=ATP-synt_G; Match level="Score=98.9, E-value= 1.3e-26, Copies=1"; Pfam description=Mitochondrial ATP synthase g subunit
PKFNTFMKYARVELSPPTPADIPQIRAGIGRLITSARTGAWKNQSVKEAWLNTLVGIEVLCWFYVGECIGKRHIVGYDV

SEQ ID NO: 36493 - protein, 60 aa, Diabrotica virgifera
  misc_feature: Coding regions on vcDNA: vcDNA=SeqID_16190; Strand=+; Position=1-180
  misc_feature (1)..(23): Xaa can be any naturally occurring amino acid
  misc_feature (25)..(44): Xaa can be any naturally occurring amino acid
  misc_feature (46)..(53): Xaa can be any naturally occurring amino acid
XXXXXXXXXXXXXXXXXXXXXXXGXXXXXXXXXXXXXXXXXXXXPXXXXXXXXSPSRENT

SEQ ID NO: 36494 - protein, 288 aa, Diabrotica virgifera
  misc_feature: Coding regions on vcDNA: vcDNA=SeqID_16191; Strand=-; Position=1-864
  misc_feature (1)..(286): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEV

SEQ ID NO: 36495 - protein, 90 aa, Diabrotica virgifera
  misc_feature: Coding regions on vcDNA: vcDNA=SeqID_16192; Strand=+; Position=194-466
  misc_feature (12)..(19): Xaa can be any naturally occurring amino acid
  misc_feature (21)..(40): Xaa can be any naturally occurring amino acid
  misc_feature (47)..(54): Xaa can be any naturally occurring amino acid
  misc_feature (56)..(71): Xaa can be any naturally occurring amino acid
FFCNRNAIRFYXXXXXXXXKXXXXXXXXXXXXXXXXXXXXILRDELXXXXXXXXNXXXXXXXXXXXXXXXXVIYFYILLSFMFYKPVITI

SEQ ID NO: 36496 - protein, 191 aa, Diabrotica virgifera
  misc_feature: Coding regions on vcDNA: vcDNA=SeqID_16193; Strand=-; Position=3-575
  misc_feature (14)..(30): Xaa can be any naturally occurring amino acid
  misc_feature (32)..(191): Xaa can be any naturally occurring amino acid
FHLKIKFVYNLNKXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36497 - protein, 278 aa, Diabrotica virgifera
  misc_feature: Coding regions on vcDNA: vcDNA=SeqID_16194; Strand=+; Position=1-834
  misc_feature: Homolog annotation: Hit_ID=CAB96534.1; Match level="QueryCoverage =93%, HitCoverage=29%, E-value=1e-100, Identity=68%"; Hit description= coatomer protein gamma 2-subunit [Takifugu rubripes]
  misc_feature: Gene Ontology Annotation: Molecular function=molecular_function unknown; Cellular component=membrane; Biological process =intracellular protein transport
ENLITDPNRSIATLAITTLLKTGAESSVDRLMKQIATFVSEISDEFKVVVIQAIKVLALKFPRKHSTLMNFLSAMLRDEGGLEYKASIADTIITLIEDNPEAKESGLAHLCEFIEDCEHVSLAVRILHLLGKEGPKTKQPSRYIRFIYNRVILECPSVRAAAVSAMAQFGASCPDLLENIQILLSRCQMDSDDEVRDRATYYSNILNKNDKSLYNNYILDSLQVSIPSLERSLREYIQNPTDEPFDIKSVPVAAVPTAEEREVKNKSEGLLVSQGPVR

SEQ ID NO: 36498 - protein, 283 aa, Diabrotica virgifera
  misc_feature: Coding regions on vcDNA: vcDNA=SeqID_16195; Strand=+; Position=43-891
  misc_feature: Homolog annotation: Hit_ID=AAM90673.1; Match level="QueryCoverage =92%, HitCoverage=48%, E-value=4e-18, Identity=24%"; Hit description =surface protein SdrI [Staphylococcus saprophyticus]
  misc_feature: Gene Ontology Annotation: Molecular function=chaperone activity; Cellular component=extracellular space; Biological process=protein folding
  misc_feature (228)..(234): Xaa can be any naturally occurring amino acid
  misc_feature (251)..(251): Xaa can be any naturally occurring amino acid
  misc_feature (254)..(261): Xaa can be any naturally occurring amino acid
MRSVIVLFAIICAISLATVIAQNADPAVDVADPASEPCVNDDDVYPPDEPFPDIPANGTTRNGTEVVNQNTTVPQNSEPEGSGNGEQEINGNADNQTDAPQPNDDNTTAENSTDGQTDAPQGNENGAAAENNAQSDAQTDAAQGNGNEAAADNNGSADAAQGNDNRAAAENNANADAQTDAAQGSANEANAENNANADAQNDAAQANDNEATAENSGNADPAQGNDNXXXXXXXGNANAAQSNDSEAAAEXNGXXXXXXXXAQGSANAAHADNNANTDAQNGA

SEQ ID NO: 36499 - protein, 106 aa, Diabrotica virgifera
  misc_feature: Coding regions on vcDNA: vcDNA=SeqID_16196; Strand=-; Position=392-712
TKVVVVYYFSSIRKITNNYKTCLRRKQDGHCSRYHEPQQMTRSDIKISSAFCLKAKDKLNNLLKFIMTNKCRMGPKSKIELSRDISFIKCISKDEQPGKGVSLFVQ

SEQ ID NO: 36500 - protein, 62 aa, Diabrotica virgifera
  misc_feature: Coding regions on vcDNA: vcDNA=SeqID_16197; Strand=-; Position=82-270
LPSARLHLADGIHPSSIAFLNFWNWTIPRFFAWFAPFSLKFHFLGLCFLPEVSPFEIDSTSL

SEQ ID NO: 36501 - protein, 42 aa, Diabrotica virgifera
  misc_feature: Coding regions on vcDNA: vcDNA=SeqID_16198; Strand=+; Position=2-130
  misc_feature (2)..(10): Xaa can be any naturally occurring amino acid
NXXXXXXXXXDIKMRPRCWIKVIIGEELYYKACRFLNFLGLG

SEQ ID NO: 36502 - protein, 245 aa, Diabrotica virgifera
  misc_feature: Coding regions on vcDNA: vcDNA=SeqID_16199; Strand=-; Position=2-736
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(245): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36503 - protein, 267 aa, Diabrotica virgifera
  misc_feature: Coding regions on vcDNA: vcDNA=SeqID_16200; Strand=+; Position=103-901
  misc_feature: Homolog annotation: Hit_ID=XP_312164.1; Match level="QueryCoverage =96%, HitCoverage=45%, E-value=1e-110, Identity=77%"; Hit description= ENSANGP00000022161 [Anopheles gambiae]
  misc_feature: Gene Ontology Annotation: Molecular function=chaperone activity; Cellular component=cytoskeleton; Biological process=protein folding
  misc_feature: Pfam annotation: Pfam_ID=Cpn60_TCP1; Match level="Score=-163.8, E -value=1.1e-07, Copies=1"; Pfam description=TCP-1/cpn60 chaperonin family
  misc_feature (188)..(194): Xaa can be any naturally occurring amino acid
  misc_feature (216)..(216): Xaa can be any naturally occurring amino acid
  misc_feature (244)..(244): Xaa can be any naturally occurring amino acid
LTNVTTIFFGVLGQNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQHIHPTIIIRQYRQALEDMIQLLEGPLSIPVDRNDKNALAQVVKGCIGTKFISKWSDLAVNIALDAVNTVLXXXXXXXEVDIKRYAKVEKIPGGSIEESXILRGVMLNKDVTHPQMKRYIQNPRIILXLDCALEYKKGESQTNVEISAETD

SEQ ID NO: 36504 - protein, 292 aa, Diabrotica virgifera
  misc_feature: Coding regions on vcDNA: vcDNA=SeqID_16201; Strand=+; Position=32-907
  misc_feature: Homolog annotation: Hit_ID=XP_393160.1; Match level="QueryCoverage =92%, HitCoverage=100%, E-value=1e-110, Identity=69%"; Hit description=similar to ENSANGP00000022004 [Apis mellifera]
  misc_feature: Gene Ontology Annotation: Molecular function=SNF1A/AMP-activated protein kinase activity; Cellular component=nucleus; Biological process=response to stress
  misc_feature: Pfam annotation: Pfam_ID=AMPKBI; Match level="Score=166.8, E-value =4.6e-47, Copies=1"; Pfam description=5'-AMP-activated protein kinase, beta
MSVLIFKMGNAGSSGPTRERQKSGEVVPASPTKEGQAFTFDKKPENKLQIQSSQDEEEPYFTKPASSYDQPRPRANTVSEGTQPVRNASKTPTVFRWEGGGKDVCICGTFSNWETIPMVKSYGDFVAIVDLPEGEHQYKFYVDGEWKNDPGNKIIEDDSGAKNNLIVVKKSDFEVFQALAKDSENAKDDSQKEFGQDIPPNKPWEKTSGPPILPPHLLQVILNKDTPLSCEPTLLPEPNHVMLNHLYALSIKDGVMVLSATHRYRKKYVTTLLYKPILWDLIYFGHNEDGIL

SEQ ID NO: 36505 - protein, 134 aa, Diabrotica virgifera
  misc_feature: Coding regions on vcDNA: vcDNA=SeqID_16202; Strand=+; Position=163-564
  misc_feature: Homolog annotation: Hit_ID=XP_394252.1; Match level="QueryCoverage =84%, HitCoverage=27%, E-value=4e-26, Identity=50%"; Hit description =similar to 60A protein precursor (Glass bottom boat protein) [Apis mellifera]
  misc_feature: Gene Ontology Annotation: Biological process=wing vein morphogenesis
MQSVLACLLFFTFWSFSSCSRSGIYIDNGFDQTAIERTMTRDEKREMELEILSLLGLPKRPRTISKNPLKRSAPRFLLDIYKTLMDADNEDDQRAKRSVDVYLSGEEQNRIDERDIIMTFGGANDHVPNVRHER

SEQ ID NO: 36506 - protein, 54 aa, Diabrotica virgifera
  misc_feature: Coding regions on vcDNA: vcDNA=SeqID_16203; Strand=-; Position=2-163
  misc_feature (15)..(22): Xaa can be any naturally occurring amino acid
  misc_feature (34)..(54): Xaa can be any naturally occurring amino acid
PLLGHSRLIYKFNLXXXXXXXXINSIKTAFFSFXXXXXXXXXXXXXXXXXXXXX

SEQ ID NO: 36507 - protein, 310 aa, Diabrotica virgifera
  misc_feature: Coding regions on vcDNA: vcDNA=SeqID_16204; Strand=-; Position=0-929
  misc_feature (5)..(16): Xaa can be any naturally occurring amino acid
  misc_feature (18)..(304): Xaa can be any naturally occurring amino acid
NKFMXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRCKWT

SEQ ID NO: 36508 - protein, 142 aa, Diabrotica virgifera
  misc_feature: Coding regions on vcDNA: vcDNA=SeqID_16205; Strand=+; Position=304-732
  misc_feature: Homolog annotation: Hit_ID=XP_395941.1; Match level="QueryCoverage =76%, HitCoverage=63%, E-value=4e-24, Identity=45%"; Hit description =similar to ENSANGP00000012978 [Apis mellifera]
  misc_feature: Gene Ontology Annotation: Molecular function=peptidoglycan recognition activity; Biological process=anti-Gram-positive bacterial polypeptide induction
  misc_feature: Pfam annotation: Pfam_ID=Amidase_2; Match level="Score=-19.1, E-value= 0.018, Copies=1"; Pfam description=N-acetylmuramoyl-L-alanine amidase
MVYRRYLRIGCVVLSLFYQTNCECPKIYTRNEWSARKALSTRPLREDPPPYVVVHHSATRSCFSLEDCSKLVKSIQDYHIDHNACNDIVYNFLIGGDATIYQGRAYALRDAHSIPYHARSLGDCLLGSYKDTNPPRVQLRVL

SEQ ID NO: 36509 - protein, 74 aa, Diabrotica virgifera
  misc_feature: Coding regions on vcDNA: vcDNA=SeqID_16206; Strand=-; Position=2-223
  misc_feature (7)..(13): Xaa can be any naturally occurring amino acid
PCGYFSXXXXXXXDVGRILIFRSSEFSGENEIRVKKKSPLFVSGASVVVLFCSSMCWSLQGILSFLAFSLGPWE

SEQ ID NO: 36510 - protein, 24 aa, Diabrotica virgifera
  misc_feature: Coding regions on vcDNA: vcDNA=SeqID_16207; Strand=-; Position=3-74
  misc_feature (16)..(24): Xaa can be any naturally occurring amino acid
KSKAYATLARLKYRGXXXXXXXXX

SEQ ID NO: 36511 - protein, 235 aa, Diabrotica virgifera
  misc_feature: Coding regions on vcDNA: vcDNA=SeqID_16208; Strand=-; Position=1-705
  misc_feature (1)..(218): Xaa can be any naturally occurring amino acid
  misc_feature (221)..(235): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 36512 - protein, 84 aa, Diabrotica virgifera
  misc_feature: Coding regions on vcDNA: vcDNA=SeqID_16209; Strand=-; Position=434-688
ILGNVALLFKELENSSIPLPIENFELECHSFFHWPSSIRIGRELSLRFGSSLIFRKGIQRISIFFRLTSELLKSGVQPESGAFY

SEQ ID NO: 36513 - protein, 174 aa, Diabrotica virgifera
  misc_feature: Coding regions on vcDNA: vcDNA=SeqID_16210; Strand=-; Position=158-680
  misc_feature: Homolog annotation: Hit_ID=XP_317949.1; Match level="QueryCoverage =97%, HitCoverage=38%, E-value=2e-09, Identity=29%"; Hit description =ENSANGP00000020548 [Anopheles gambiae]
  misc_feature (66)..(66): Xaa can be any naturally occurring amino acid
  misc_feature (89)..(89): Xaa can be any naturally occurring amino acid
YIQGQHLTIITERKIYQFEKVKRYLRQTFIRRPNMKEEIQARIMAGNRCIFALNKLLRSKNIYLKXANIRICKTDKIYILVKWTMNKSXAKVMLQGWERNVSKKIFGGKLWKEMGIKRPNIQPNMYGELNIVGIIKSRRLRWLRHIQMILTRGIRGKKKKGGPKTSRNDVEKHI

SEQ ID NO: 36514 - protein, 62 aa, Diabrotica virgifera
  misc_feature: Coding regions on vcDNA: vcDNA=SeqID_16211; Strand=-; Position=35-223
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
FXXXXXXXXXXXNQPGSHRFKXXXXXXXXXEXXXXXXXXXXXXXXSNIEFKSIIKIATSMLD

SEQ ID NO: 36515 - protein, 66 aa, Diabrotica virgifera
  misc_feature: Coding regions on vcDNA: vcDNA=SeqID_16212; Strand=-; Position=3-200
  misc_feature (3)..(13): Xaa can be any naturally occurring amino acid
  misc_feature (29)..(29): Xaa can be any naturally occurring amino acid
  misc_feature (33)..(46): Xaa can be any naturally occurring amino acid
  misc_feature (53)..(65): Xaa can be any naturally occurring amino acid
PFXXXXXXXXXXXTNLGSHRFKLRSCKIXKVEXXXXXXXXXXXXXXSNIEVAXXXXXXXXXXXXXC

SEQ ID NO: 36516 - protein, 36 aa, Diabrotica virgifera
  misc_feature: Coding regions on vcDNA: vcDNA=SeqID_16213; Strand=-; Position=1-108
  misc_feature (3)..(15): Xaa can be any naturally occurring amino acid
  misc_feature (22)..(34): Xaa can be any naturally occurring amino acid
RTXXXXXXXXXXXXXIQHRGRXXXXXXXXXXXXXLL

SEQ ID NO: 36517 - protein, 100 aa, Diabrotica virgifera
  misc_feature: Coding regions on vcDNA: vcDNA=SeqID_16214; Strand=+; Position=1-303
  misc_feature (21)..(45): Xaa can be any naturally occurring amino acid
  misc_feature (50)..(63): Xaa can be any naturally occurring amino acid
SPPPRDYLFFRMRLFIFSSSXXXXXXXXXXXXXXXXXXXXXXXXXDYHIXXXXXXXXXXXXXXNYNSYWKTNLLKKHFEMKCYSSLDISNPLRNILNLFV

SEQ ID NO: 36518 - protein, 23 aa, Diabrotica virgifera
  misc_feature: Coding regions on vcDNA: vcDNA=SeqID_16215; Strand=-; Position=1-69
  misc_feature (5)..(23): Xaa can be any naturally occurring amino acid
PLHPXXXXXXXXXXXXXXXXXXX

SEQ ID NO: 36519 - protein, 247 aa, Diabrotica virgifera
  misc_feature: Coding regions on vcDNA: vcDNA=SeqID_16216; Strand=+; Position=1-744
  misc_feature: Homolog annotation: Hit_ID=XP_392341.1; Match level="QueryCoverage =91%, HitCoverage=39%, E-value=3e-79, Identity=64%"; Hit description =similar to CG1021-PA [Apis mellifera]
AAGAPGAAAHPHQQHSGGKFVSDDGSECSSVTSDSIGRYAREGHDKYTDVNKKIRLVQEQLDNFRESFDIIKSLQQEIHDLNSALQEERFKSERLEEQINDLTELHQNEVENLKQAMADMEEKVQYQSEERLRDIHEMLEHCQTKIQKMEHQALQQQQYVTLEGLDNSNARALVVKLINVLLTVLQVVLLLVATGAGIIMPFLRTRLRILSTVVLVIGIAFVLRQWPEVRDIGSHMMRRLKDTLDPP

SEQ ID NO: 36520 - protein, 206 aa, Diabrotica virgifera
  misc_feature: Coding regions on vcDNA: vcDNA=SeqID_16217; Strand=+; Position=1-619
  misc_feature: Homolog annotation: Hit_ID=XP_312437.1; Match level="QueryCoverage =98%, HitCoverage=27%, E-value=4e-55, Identity=53%"; Hit description =ENSANGP00000021357 [Anopheles gambiae]
  misc_feature (75)..(93): Xaa can be any naturally occurring amino acid
  misc_feature (183)..(183): Xaa can be any naturally occurring amino acid
IKQGYGMTESSPVTFIMPKMTPPSKIGTIGVLYPSTEAKVVCLVSGKTLGTHESGELLVRGPQIMMGYLNNEAAXXXXXXXXXXXXXXXXXXXDEDGYFYIVDRCKELIKVKGNQVSPTELENLIMEIEGIADAAVVGVPDTLAGEVPRAYVVRLANASINEEDIQRWVNGKVSHYKKLVGGXVKFVDIIPRNPSGKILRNELKLN

SEQ ID NO: 36521 - protein, 64 aa, Diabrotica virgifera
  misc_feature: Coding regions on vcDNA: vcDNA=SeqID_16218; Strand=-; Position=1-192
  misc_feature (5)..(41): Xaa can be any naturally occurring amino acid
  misc_feature (44)..(64): Xaa can be any naturally occurring amino acid
TISLXXXXXXXXXXXXXXXXXXXXXXXXXXXXXXXXXXXXXEVXXXXXXXXXXXXXXXXXXXXX

SEQ ID NO: 36522 - protein, 86 aa, Diabrotica virgifera
  misc_feature: Coding regions on vcDNA: vcDNA=SeqID_16219; Strand=-; Position=261-521
  misc_feature (39)..(47): Xaa can be any naturally occurring amino acid
LAPVYGGQEEWRKPLFNPSLTQGVQLLHFLGINQNYIIXXXXXXXXXPTEKSFSEHKFVYFCFSAVSQNIKNKLFVITIVVSSHKI

SEQ ID NO: 36523 - protein, 30 aa, Diabrotica virgifera
  misc_feature: Coding regions on vcDNA: vcDNA=SeqID_16220; Strand=-; Position=1-90
  misc_feature (1)..(13): Xaa can be any naturally occurring amino acid
XXXXXXXXXXXXXHFLNLNSAGIRHFMRGE

SEQ ID NO: 36524 - protein, 108 aa, Diabrotica virgifera; identical to SEQ ID NO: 27732
  misc_feature: Coding regions on vcDNA: vcDNA=SeqID_16221; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 36525 - protein, 296 aa, Diabrotica virgifera
  misc_feature: Coding regions on vcDNA: vcDNA=SeqID_16222; Strand=+; Position=2-889
  misc_feature: Homolog annotation: Hit_ID=XP_394762.1; Match level="QueryCoverage =100%, HitCoverage=34%, E-value=1e-136, Identity=82%"; Hit description=similar to CG32498-PO [Apis mellifera]
  misc_feature: Gene Ontology Annotation: Molecular function=cAMP-specific phosphodiesterase activity; Cellular component=insoluble fraction; Biological process=locomotor rhythm
  misc_feature: Pfam annotation: Pfam_ID=PDEase_I; Match level="Score=141.9, E-value =1.5e-39, Copies=1"; Pfam description=3'5'-cyclic nucleotide phosphodiester
  misc_feature (268)..(268): Xaa can be any naturally occurring amino acid
KELSHFSESSKSGNQISEYICSTFLDKQQELDLPSLRDEVPELLPKPTQRKERARGPHSTMSQISGVNRKPLCHTNSFTGEKLPLHGIETPYEEELGKSLIMIDQWGIDIFRIGELSNGKPLTCVAYTTFNNRDLLKTMNIPPKTFITFMMTLEDHYVKENPFHNSLHAADVAQSTHVLLNTPALESVFTPLEVTAALFAACIHDVDHPGLTNQFLINSSSELALMYNDESVLENHHLAVAFKLLSNDGCDIFCNMTKKQRQTLRKMXIDMVLSTDMSKHMTLLADLKTMVETKKV

SEQ ID NO: 36526 - protein, 254 aa, Diabrotica virgifera
  misc_feature: Coding regions on vcDNA: vcDNA=SeqID_16223; Strand=-; Position=1-762
  misc_feature (2)..(227): Xaa can be any naturally occurring amino acid
  misc_feature (231)..(253): Xaa can be any naturally occurring amino acid
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXE

SEQ ID NO: 36527 - protein, 31 aa, Diabrotica virgifera
  misc_feature: Coding regions on vcDNA: vcDNA=SeqID_16224; Strand=-; Position=2-94
SLYLVLISSRFDISWLKGSLSITRVVTRTLR

SEQ ID NO: 36528 - protein, 67 aa, Diabrotica virgifera
  misc_feature: Coding regions on vcDNA: vcDNA=SeqID_16225; Strand=-; Position=168-371
  misc_feature (50)..(57): Xaa can be any naturally occurring amino acid
  misc_feature (60)..(65): Xaa can be any naturally occurring amino acid
ITYLTYYKWFTVKRPKSLDRKALYRNLTRPNSRRPKSRRPKSIRYIIQGXXXXXXXXTIXXXXXXQY

SEQ ID NO: 36529 - protein, 66 aa, Diabrotica virgifera
  misc_feature: Coding regions on vcDNA: vcDNA=SeqID_16226; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LSXXXXXXXXXXXTNLAHTGLNXXXXXXXXSNXXXXXXXXXXXXXXPTSRSXXXXXXXXXXXXXXV

SEQ ID NO: 36530 - protein, 266 aa, Diabrotica virgifera
  misc_feature: Coding regions on vcDNA: vcDNA=SeqID_16227; Strand=-; Position=1-798
  misc_feature (1)..(225): Xaa can be any naturally occurring amino acid
  misc_feature (227)..(266): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXX

SEQ ID NO: 36531 - protein, 74 aa, Diabrotica virgifera
  misc_feature: Coding regions on vcDNA: vcDNA=SeqID_16228; Strand=+; Position=352-576
  misc_feature (64)..(70): Xaa can be any naturally occurring amino acid
EKIRKLVPSTQVKIKVKDSLCFLSIQRRHIILQAAVSVSTLLQWGYLNTSESKRKQNCVYKQKXXXXXXXQQFS

SEQ ID NO: 36532 - protein, 264 aa, Diabrotica virgifera
  misc_feature: Coding regions on vcDNA: vcDNA=SeqID_16229; Strand=-; Position=1-792
  misc_feature (4)..(22): Xaa can be any naturally occurring amino acid
  misc_feature (26)..(188): Xaa can be any naturally occurring amino acid
  misc_feature (192)..(229): Xaa can be any naturally occurring amino acid
  misc_feature (232)..(244): Xaa can be any naturally occurring amino acid
  misc_feature (247)..(262): Xaa can be any naturally occurring amino acid
LFTXXXXXXXXXXXXXXXXXXXHFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSIXXXXXXXXXXXXXXXXXXXXXXXXXXXXXXXXXXXXXXRYXXXXXXXXXXXXXLSXXXXXXXXXXXXXXXXEK

SEQ ID NO: 36533 - protein, 151 aa, Diabrotica virgifera
  misc_feature: Coding regions on vcDNA: vcDNA=SeqID_16230; Strand=-; Position=534-989
IYDRKKEPTVGEFDRPHRERLYLPLFVSEFPPMAGSRRCRGSPCVCMNYPSPVPPFLGCREPNRWRSSHWPNPLAPPIPPAHEFVTPRFPFEFRSSTFGISHWPVPARPPAYPPTTVPPFFPHRVNTPWPVILILPVRRALRRNLITGSTV

SEQ ID NO: 36534 - protein, 27 aa, Diabrotica virgifera
  misc_feature: Coding regions on vcDNA: vcDNA=SeqID_16231; Strand=-; Position=0-80
  misc_feature (11)..(25): Xaa can be any naturally occurring amino acid
NKLNLYYNLTXXXXXXXXXXXXXXXIS

SEQ ID NO: 36535 - protein, 246 aa, Diabrotica virgifera
  misc_feature: Coding regions on vcDNA: vcDNA=SeqID_16232; Strand=-; Position=2-739
  misc_feature (4)..(4): Xaa can be any naturally occurring amino acid
  misc_feature (6)..(23): Xaa can be any naturally occurring amino acid
  misc_feature (27)..(230): Xaa can be any naturally occurring amino acid
  misc_feature (232)..(246): Xaa can be any naturally occurring amino acid
NLSXYXXXXXXXXXXXXXXXXXXPHPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 36536 - protein, 63 aa, Diabrotica virgifera
  misc_feature: Coding regions on vcDNA: vcDNA=SeqID_16233; Strand=+; Position=90-278
IWHSLLTTFLFKHCTMSREMQLFRLWKGRLAQVRLIHVAATSNAAAAEAKRAEKPARPKTLPF

SEQ ID NO: 36537 - protein, 182 aa, Diabrotica virgifera
  misc_feature: Coding regions on vcDNA: vcDNA=SeqID_16234; Strand=-; Position=0-545
  misc_feature (3)..(180): Xaa can be any naturally occurring amino acid
VGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 36538 - protein, 134 aa, Diabrotica virgifera
  misc_feature: Coding regions on vcDNA: vcDNA=SeqID_16235; Strand=+; Position=252-656
  misc_feature: Homolog annotation: Hit_ID=NP_610608.1; Match level="QueryCoverage =67%, HitCoverage=6%, E-value=3e-11, Identity=37%"; Hit description =CG12340-PA [Drosophila melanogaster] gb|AAF58755.1| CG12340-PA [Drosophila melanogaster]
MREKNLGEETLTRSDLEQFCLQKICEAIIHKSEAGELHQIILRQAQIIDNLRKEVQQISKQAKDLDIVHKKLMNDIRVHGTMKPLVPLKITRSVGLQVKLNVSEDPNKRKTFTVPVATNKTATTTTNSKSCSKT

SEQ ID NO: 36539 - protein, 79 aa, Diabrotica virgifera
  misc_feature: Coding regions on vcDNA: vcDNA=SeqID_16236; Strand=-; Position=2-238
  misc_feature (2)..(2): Xaa can be any naturally occurring amino acid
  misc_feature (5)..(13): Xaa can be any naturally occurring amino acid
  misc_feature (15)..(15): Xaa can be any naturally occurring amino acid
  misc_feature (18)..(18): Xaa can be any naturally occurring amino acid
  misc_feature (20)..(20): Xaa can be any naturally occurring amino acid
  misc_feature (23)..(23): Xaa can be any naturally occurring amino acid
  misc_feature (28)..(28): Xaa can be any naturally occurring amino acid
  misc_feature (35)..(43): Xaa can be any naturally occurring amino acid
  misc_feature (46)..(59): Xaa can be any naturally occurring amino acid
  misc_feature (65)..(78): Xaa can be any naturally occurring amino acid
NXYLXXXXXXXXXPXVLXYXIIXKIETXLGSHRFXXXXXXXXXSNXXXXXXXXXXXXXXPTSRSXXXXXXXXXXXXXXV

SEQ ID NO: 36540 - protein, 95 aa, Diabrotica virgifera
  misc_feature: Coding regions on vcDNA: vcDNA=SeqID_16237; Strand=-; Position=344-631
YNDGSRSGLPLPSTHPVVRQASIHPYQSCLIIHPGSLAMNESVISAVYKIRAIWDPADPLCDETWLKISVLFILCICIKKIQYSSQVNLKSNFCL

SEQ ID NO: 36541 - protein, 204 aa, Diabrotica virgifera
  misc_feature: Coding regions on vcDNA: vcDNA=SeqID_16238; Strand=-; Position=2-612
  misc_feature: Homolog annotation: Hit_ID=BAC57900.1; Match level="QueryCoverage =99%, HitCoverage=18%, E-value=1e-39, Identity=42%"; Hit description =reverse transcriptase [Anopheles gambiae]
  misc_feature (15)..(15): Xaa can be any naturally occurring amino acid
LNIKVGKAAGPDGVXSEAIKIIIRKYPEMIRRIFNNLLHRQEFPNQIKQARLTLILKPVKDPDIANSYRPMCLLDCLGKFYEYLIKNRLEEDPQRNRSISDRQYGFRRSRSTIDAIKVITDTVKETRKRWTVLVMFDVKNEFNSANWGHIVKALEKSRVSEYLVNIIKNYLNERYVQLAKPKDPQTTGGVPQRSVLGPTLWNVL

SEQ ID NO: 36542 - protein, 39 aa, Diabrotica virgifera
  misc_feature: Coding regions on vcDNA: vcDNA=SeqID_16239; Strand=-; Position=2-118
  misc_feature (29)..(39): Xaa can be any naturally occurring amino acid
IEDIKLHQEIHLVIYKNKSLHILKCENLXXXXXXXXXXX

SEQ ID NO: 36543 - protein, 317 aa, Diabrotica virgifera
  misc_feature: Coding regions on vcDNA: vcDNA=SeqID_16240; Strand=+; Position=2-952
  misc_feature: Homolog annotation: Hit_ID=XP_308743.1; Match level="QueryCoverage =89%, HitCoverage=54%, E-value=1e-45, Identity=36%"; Hit description =ENSANGP00000015016 [Anopheles gambiae]
  misc_feature: Gene Ontology Annotation: Molecular function=UDP-glycosyltransferase activity; Cellular component=microsome; Biological process =xenobiotic metabolism
  misc_feature (114)..(121): Xaa can be any naturally occurring amino acid
GRFLIYSLSVIFFFGPVANGYNILFVFPMPAKSHFILGTAMAKQLVAAGHDITMVACFEEKSPPLGGTYTNVVLDDIYYSNKDFNFLDLQHVSPELTIYNAYQSGHMLSKAILXXXXXXXXLASDQKFDVVIIEQFCNDALKVLGWYYDAPVIVFSTVGANYWVNPLVGSPSPISYIPELHLDYTENMTLLQRFRNTIAILSHILTQQISYYPAQQEILRQNFPGSPSLDELVTNVSLVLLNSHESLNQPVPLVPNMINVGGMHIMPNKELPKDLQVIMGHAKEGIVYFSLGLMVIRLMIRAITAILCFRKLPYKVS

SEQ ID NO: 36544 - protein, 239 aa, Diabrotica virgifera
  misc_feature: Coding regions on vcDNA: vcDNA=SeqID_16241; Strand=+; Position=140-859
  misc_feature: Homolog annotation: Hit_ID=XP_315750.1; Match level="QueryCoverage =78%, HitCoverage=47%, E-value=4e-39, Identity=42%"; Hit description =ENSANGP00000018633 [Anopheles gambiae]
  misc_feature: Pfam annotation: Pfam_ID=LETM1; Match level="Score=-62.0, E-value =5.9e-08, Copies=1"; Pfam description=LETM1-like protein
  misc_feature (66)..(72): Xaa can be any naturally occurring amino acid
MHLSRIPAVAGTYVRSPSFGSLVFKQSWPVTNSLSYTIVRCKHRKSIYKREEAKKLRFYVVTKYVXXXXXXXKVLEKNFPQTVQTYRQFIDGTREFIRDAKEYFRIIRILNTPGKSFANLLRREMELYQQMPKDMKKVAPVLITFSIPFGSYVILPLAYMFPRYLLCSHFWNLKQKSEYQILSLKDRLVHNRPIFRHLQSQMYFLKPHCLYKRWKEVVGKIGSGVHPTGGEIAECNNSL

SEQ ID NO: 36545 - protein, 50 aa, Diabrotica virgifera
  misc_feature: Coding regions on vcDNA: vcDNA=SeqID_16242; Strand=-; Position=1-150
  misc_feature (7)..(14): Xaa can be any naturally occurring amino acid
  misc_feature (17)..(25): Xaa can be any naturally occurring amino acid
  misc_feature (36)..(48): Xaa can be any naturally occurring amino acid
AHTGLNXXXXXXXXSTXXXXXXXXXIINLIQHRGRXXXXXXXXXXXXXLL

SEQ ID NO: 36546 - protein, 108 aa, Diabrotica virgifera
  misc_feature: Coding regions on vcDNA: vcDNA=SeqID_16243; Strand=-; Position=0-323
  misc_feature (17)..(23): Xaa can be any naturally occurring amino acid
NACCNRNGISKKSDYSXXXXXXXEYGNKGKVMCIPHCLTFPISLVSGHRTIQILPAMIGSNAEQELNLESPRKRIGVQNKKVYKGQQTSSISDQNCITEIQEIDSAPP

SEQ ID NO: 36547 - protein, 22 aa, Diabrotica virgifera
  misc_feature: Coding regions on vcDNA: vcDNA=SeqID_16244; Strand=-; Position=1-66
  misc_feature (8)..(8): Xaa can be any naturally occurring amino acid
  misc_feature (11)..(17): Xaa can be any naturally occurring amino acid
  misc_feature (20)..(20): Xaa can be any naturally occurring amino acid
KIDILKTXYHXXXXXXXKIXIY

SEQ ID NO: 36548 - protein, 288 aa, Diabrotica virgifera
  misc_feature: Coding regions on vcDNA: vcDNA=SeqID_16245; Strand=+; Position=2-865
  misc_feature: Homolog annotation: Hit_ID=XP_394283.1; Match level="QueryCoverage =97%, HitCoverage=23%, E-value=4e-59, Identity=63%"; Hit description =similar to calcium channel, voltage-dependent, alpha 1F subunit; Cav1.4alpha1 [Apis
  misc_feature: Gene Ontology Annotation: Molecular function=voltage-gated calcium channel activity; Cellular component=voltage-gated calcium channel complex; Biological process=epithelial fluid transport
DEVTVGKFYATFLIQDYFRRFKKRKEQEMRDGDKDIQNTVTLQAGLRTLHEAGPELKRAISGNLDELIDDNPEPMHRRNHSLFGSVWSSMRRGHTFNRAKSLKLNSTQIKITPASSVDYLPYNSIKNAVTEGMNHITSMTKNVQNRVSASSLNNQDNYKDEEIPLRSLSNLHNGDEKNNYTVIDKSGFLHPNYKVGAGEANGHVGPERLSHSLPGSPADRRLASFEVVGSAESLVRILAEQGLGKYCDQDFVRYTRRDAEALDMTQEEMDRAAHQILFTEKLIHHPLQ

SEQ ID NO: 36549 - protein, 103 aa, Diabrotica virgifera
  misc_feature: Coding regions on vcDNA: vcDNA=SeqID_16246; Strand=+; Position=191-502
  misc_feature: Homolog annotation: Hit_ID=AAO15464.1; Match level="QueryCoverage =99%, HitCoverage=50%, E-value=8e-21, Identity=51%"; Hit description =60S ribosomal protein L15 [Spodoptera frugiperda]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L15e; Match level="Score=-36.7, E -value=1.3e-05, Copies=1"; Pfam description=Ribosomal L15
  misc_feature (16)..(16): Xaa can be any naturally occurring amino acid
  misc_feature (48)..(48): Xaa can be any naturally occurring amino acid
  misc_feature (59)..(59): Xaa can be any naturally occurring amino acid
QGFVMYRIRIQQVELXRPDPKGATYVKPISLDLNVLKPALSLQDIAAXRPMNNLSGLKXLNSYWEHQHSTYYYFVISLVDPSHNCIHLDPKNNCIDDSKLKHL

SEQ ID NO: 36550 - protein, 67 aa, Diabrotica virgifera
  misc_feature: Coding regions on vcDNA: vcDNA=SeqID_16247; Strand=-; Position=378-581
ICADSFACWFLIQCRLLILYKTIFSAFNPPCCYFLCNYLLQFCATFWYKVVSAGEEFREGKPYKIMS

SEQ ID NO: 36551 - protein, 99 aa, Diabrotica virgifera
  misc_feature: Coding regions on vcDNA: vcDNA=SeqID_16248; Strand=-; Position=118-417
IYKFIVSDNQNAACILSAKVFLVFFTYCLQLRRNNIIMFIILSSLQRLNPEHASYIFNGSKNLSLTVILVINLNFALYDSQNTACFCPSSISRVNEVFF

SEQ ID NO: 36552 - protein, 94 aa, Diabrotica virgifera
  misc_feature: Coding regions on vcDNA: vcDNA=SeqID_16249; Strand=+; Position=200-484
  misc_feature: Homolog annotation: Hit_ID=XP_391967.1; Match level="QueryCoverage =91%, HitCoverage=5%, E-value=3e-40, Identity=84%"; Hit description =similar to CG15105-PA [Apis mellifera]
  misc_feature: Pfam annotation: Pfam_ID=zf-C3HC4; Match level="Score=33.4, E-value =6.9e-07, Copies=1"; Pfam description=Zinc finger, C3HC4 type (RING finger)
  misc_feature (54)..(54): Xaa can be any naturally occurring amino acid
MEQFEQLLTCAICLDRYRNPKLLPCQHSFCMEPCLEGTVDYVRRQIKCPKCRAXHRIPYNGVQGFPTNETLLRFLQLHFEITAELPYSSYCYYL

SEQ ID NO: 36553 - protein, 244 aa, Diabrotica virgifera
  misc_feature: Coding regions on vcDNA: vcDNA=SeqID_16250; Strand=-; Position=1-732
  misc_feature (3)..(227): Xaa can be any naturally occurring amino acid
  misc_feature (230)..(244): Xaa can be any naturally occurring amino acid
LFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVXXXXXXXXXXXXXXX

SEQ ID NO: 36554 - protein, 27 aa, Diabrotica virgifera
  misc_feature: Coding regions on vcDNA: vcDNA=SeqID_16251; Strand=-; Position=1-81
  misc_feature (4)..(27): Xaa can be any naturally occurring amino acid
IFHXXXXXXXXXXXXXXXXXXXXXXXX

SEQ ID NO: 36555 - protein, 31 aa, Diabrotica virgifera
  misc_feature: Coding regions on vcDNA: vcDNA=SeqID_16252; Strand=-; Position=0-92
FYWRVQIDNKDCDLDVGLEFIIGVAAIFKSR

SEQ ID NO: 36556 - protein, 242 aa, Diabrotica virgifera
  misc_feature: Coding regions on vcDNA: vcDNA=SeqID_16253; Strand=-; Position=1-726
  misc_feature (4)..(230): Xaa can be any naturally occurring amino acid
  misc_feature (232)..(242): Xaa can be any naturally occurring amino acid
VILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXX

SEQ ID NO: 36557 - protein, 215 aa, Diabrotica virgifera
  misc_feature: Coding regions on vcDNA: vcDNA=SeqID_16254; Strand=-; Position=2-646
  misc_feature (14)..(22): Xaa can be any naturally occurring amino acid
  misc_feature (27)..(34): Xaa can be any naturally occurring amino acid
  misc_feature (36)..(215): Xaa can be any naturally occurring amino acid
LMNYIKTVCFSFKXXXXXXXXXLMIIXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36558 - protein, 139 aa, Diabrotica virgifera
  misc_feature: Coding regions on vcDNA: vcDNA=SeqID_16255; Strand=+; Position=33-452
  misc_feature: Homolog annotation: Hit_ID=AAR87072.1; Match level="QueryCoverage =92%, HitCoverage=49%, E-value=9e-41, Identity=64%"; Hit description =cytochrome b [Bruchus tristiculus]
  misc_feature: Pfam annotation: Pfam_ID=Cytochrom_B_N; Match level="Score=59.1, E -value=1.3e-14, Copies=1"; Pfam description=Cytochrome b(N -terminal)/b6/petB
  misc_feature (52)..(52): Xaa can be any naturally occurring amino acid
  misc_feature (62)..(70): Xaa can be any naturally occurring amino acid
  misc_feature (81)..(90): Xaa can be any naturally occurring amino acid
  misc_feature (92)..(98): Xaa can be any naturally occurring amino acid
  misc_feature (110)..(110): Xaa can be any naturally occurring amino acid
  misc_feature (116)..(116): Xaa can be any naturally occurring amino acid
LSLIILPTPSLLGLCLGIQIITGLFLAIHYCPNVELAFNRVAHICRDVNYGXLLRTLHANGXXXXXXXXXIHIGRGIYYRXXXXXXXXXXGXXXXXXXIATAFLGYVLPXGQISFXGETVIINLISAIPYLGNILSQRV

SEQ ID NO: 36559 - protein, 92 aa, Diabrotica virgifera
  misc_feature: Coding regions on vcDNA: vcDNA=SeqID_16256; Strand=+; Position=1-279
  misc_feature (6)..(11): Xaa can be any naturally occurring amino acid
PNRGPXXXXXXSPFLQKGPLFFLNSEKGKAEKKRMSNVILKRTKQNEQSKWDNCFIITYFLCERLLKSMNFEMSRVRKRSNIMLIANCSDDE

SEQ ID NO: 36560 - protein, 228 aa, Diabrotica virgifera
  misc_feature: Coding regions on vcDNA: vcDNA=SeqID_16257; Strand=+; Position=58-744
  misc_feature: Homolog annotation: Hit_ID=XP_312783.1; Match level="QueryCoverage =96%, HitCoverage=91%, E-value=1e-43, Identity=42%"; Hit description =ENSANGP00000020370 [Anopheles gambiae]
  misc_feature: Gene Ontology Annotation: Molecular function=general RNA polymerase II transcription factor activity; Cellular component=transcription factor complex; Biological process=establishment and/or maintenance of chromatin
  misc_feature: Pfam annotation: Pfam_ID=TFIID-31kDa; Match level="Score=169.6, E -value=6.6e-48, Copies=1"; Pfam description=Transcription initiation factor IID, 3
MAVQSKHIPKDGQVIMAIMKEMGITDYEPKTIVQLTEFVYRYATSILEEARMYSNNSKQKFLGVDDVRLALQLTCESTFTTPPPREVLMELAHVKNYSHLPQVKRHCGLRLPPDRYCLSSCNYTLKSSKKGKGNFSMAGSPAIKMTPKANINFLKRTTPTISKQTVTIPKPITKVITTQPQLQKTLLKPKIEITQNVQIAPPIKTEMDFDTSGILKRKREDDSEPMQT

SEQ ID NO: 36561 - protein, 129 aa, Diabrotica virgifera
  misc_feature: Coding regions on vcDNA: vcDNA=SeqID_16258; Strand=+; Position=71-459
  misc_feature: Homolog annotation: Hit_ID=NP_491169.1; Match level="QueryCoverage =87%, HitCoverage=13%, E-value=1e-10, Identity=31%"; Hit description =integrase, catalytic domain containing protein family member (1E54) [Caenorhabditis elegans]
  misc_feature (52)..(52): Xaa can be any naturally occurring amino acid
  misc_feature (117)..(123): Xaa can be any naturally occurring amino acid
RSKKTSKNENSDLFTNIQGGSILFWRGIAIRQKTPLIFIQSTLTAHRYVENXVVRLWRDATVENLIFMHDNGPPHTISVTRDIIEAEGIPCLEWTAYSPELNSIEYLWDMLKRKIRXXXXXXXNTARLV

SEQ ID NO: 36562 - protein, 270 aa, Diabrotica virgifera
  misc_feature: Coding regions on vcDNA: vcDNA=SeqID_16259; Strand=-; Position=1-810
  misc_feature (1)..(1): Xaa can be any naturally occurring amino acid
  misc_feature (3)..(3): Xaa can be any naturally occurring amino acid
  misc_feature (5)..(14): Xaa can be any naturally occurring amino acid
  misc_feature (16)..(206): Xaa can be any naturally occurring amino acid
  misc_feature (208)..(247): Xaa can be any naturally occurring amino acid
  misc_feature (250)..(270): Xaa can be any naturally occurring amino acid
XIXYXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXEVXXXXXXXXXXXXXXXXXXXXX

SEQ ID NO: 36563 - protein, 126 aa, Diabrotica virgifera
  misc_feature: Coding regions on vcDNA: vcDNA=SeqID_16260; Strand=+; Position=2-382
  misc_feature (1)..(15): Xaa can be any naturally occurring amino acid
  misc_feature (18)..(53): Xaa can be any naturally occurring amino acid
  misc_feature (63)..(96): Xaa can be any naturally occurring amino acid
  misc_feature (116)..(121): Xaa can be any naturally occurring amino acid
XXXXXXXXXXXXXXXYLXXXXXXXXXXXXXXXXXXXXXXXXXXXXXXXXXXXXLRNRNRYSFXXXXXXXXXXXXXXXXXXXXXXXXXXXXXXXXXXDELSKIKFYSKFNFSNQKLXXXXXXSLKYR

SEQ ID NO: 36564 - protein, 47 aa, Diabrotica virgifera
  misc_feature: Coding regions on vcDNA: vcDNA=SeqID_16261; Strand=-; Position=0-140
LIIGYSHARLLIILLTSKRSYASFWLMPGPAREPGISGRGLQACHLS

SEQ ID NO: 36565 - protein, 56 aa, Diabrotica virgifera
  misc_feature: Coding regions on vcDNA: vcDNA=SeqID_16262; Strand=-; Position=219-389
EGCSFHFNIIQPLLITPASSFGSVDALKVRYKFRTVFQQVLFISQRMLFLISLVLI

SEQ ID NO: 36566 - protein, 96 aa, Diabrotica virgifera
  misc_feature: Coding regions on vcDNA: vcDNA=SeqID_16263; Strand=-; Position=257-547
  misc_feature (49)..(54): Xaa can be any naturally occurring amino acid
  misc_feature (77)..(96): Xaa can be any naturally occurring amino acid
HFKPKRIFAEKKNSQQNVVKSRGVTEAPAARSLRGAPSCRLINICKNVXXXXXXAHTCATFFKPCSIENEVAHQIDXXXXXXXXXXXXXXXXXXXX

SEQ ID NO: 36567 - protein, 272 aa, Diabrotica virgifera
  misc_feature: Coding regions on vcDNA: vcDNA=SeqID_16264; Strand=-; Position=1-816
  misc_feature: Pfam annotation: Pfam_ID=zf-CCHC; Match level="Score=19.6, E-value =0.00085, Copies=1"; Pfam description=Zinc knuckle
SSPHTILETELQKLGVKLMSPISFLRIGTSRPEFQHILSFRRQVYISPLVDLILPESLLICNNNTTNRICMSLDQHSCYICKNIDHVASNCPQKNNNSSSVINNTVTTADTISDVTIHSAQIHSESNHFVEDSQSKQHKNKDFNITNKCDTPKPETENPPTNKDINVNEPGPEINESSFTSQINEEPTLQIQSKRSFSETVTPPDTPECFKRPTTDTRSKKKKTTQTRETLDIKKQMEPTKAFFEDEKNHTVLNYQETIHFFENAYGSANTL

SEQ ID NO: 36568 - protein, 265 aa, Diabrotica virgifera
  misc_feature: Coding regions on vcDNA: vcDNA=SeqID_16265; Strand=+; Position=3-797
  misc_feature: Homolog annotation: Hit_ID=AAR97606.1; Match level="QueryCoverage =98%, HitCoverage=49%, E-value=6e-63, Identity=45%"; Hit description =cytochrome P450 9E1 [Diploptera punctata]
DAWVGIYQFFFPTLLIRDVKLVKQLGVKDFDHFSDHRPILPEKCDPLWSRNLFALTGQRWKDMRPVLSPSFTSSKMKIMFSLMSQCGDNLVKFFMENDKNTIEIEMKDIFTRFTNDVIATTAFGVEVDSLRKPENEFYLMGKETTDLSGFWKSMKFFGYSIMPKVFELFKLKIFDNHVRKFFTELVCDTIKVREEKGILRPDLIHLLMEARKGIHQNEEKVMDAGFAVVQESNLAKAVPTNMTDLDITAQALIFFFAGFDTDSTA

SEQ ID NO: 36569 - protein, 109 aa, Diabrotica virgifera
  misc_feature: Coding regions on vcDNA: vcDNA=SeqID_16266; Strand=+; Position=432-761
AEKVLTRLTESLNCKFLCSNDFIRSGKKLKLTFMNISSLAICTLLKEQSTLLKLKNKSGIVYNLMDFCILMLLSMSVFIEVKANLSNKNTLSRKISFVGHNAFVCQFLI

SEQ ID NO: 36570 - protein, 262 aa, Diabrotica virgifera
  misc_feature: Coding regions on vcDNA: vcDNA=SeqID_16267; Strand=+; Position=71-855
  misc_feature: Homolog annotation: Hit_ID=AAN10050.1; Match level="QueryCoverage =91%, HitCoverage=79%, E-value=8e-52, Identity=49%"; Hit description =Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=117.2, E-value=3.9e -32, Copies=1"; Pfam description='Cold-shock' DNA-binding domain
  misc_feature (87)..(87): Xaa can be any naturally occurring amino acid
  misc_feature (112)..(119): Xaa can be any naturally occurring amino acid
MAEAEQQQTAPEQPKAVPKQKEVLATKVTGTVKWFNVKSGYGFINRNDTKEDVFVHQSAIIKNNPKKAVRSVGDGEVVEFSVVVGEXNEAANVTGPNGDPVRGSPYAADRRXXXXXXXXPRGRRGRRGGSRGGGPPRESQSEGELKDGVQSGGEGGQGGQGPPRRYAPRRGRGGYSYYRGPYRGPPGELEQNGDAPRGRRPPRGFFRRNYRGGRGGARPRSQDSQGQAGELNGQEGGPRGPRGHATADVAQRPEPVTLSQSL

SEQ ID NO: 36571 - protein, 69 aa, Diabrotica virgifera
  misc_feature: Coding regions on vcDNA: vcDNA=SeqID_16268; Strand=-; Position=320-529
IQFTPWQLLTTSIYHVHIESLRRLLSIVVCTTMYTSIFSHIFNSIYVRTSDNTFFLSTHISQDSLTTAN

SEQ ID NO: 36572 - protein, 21 aa, Diabrotica virgifera
  misc_feature: Coding regions on vcDNA: vcDNA=SeqID_16269; Strand=-; Position=1-63
  misc_feature (2)..(20): Xaa can be any naturally occurring amino acid
HXXXXXXXXXXXXXXXXXXXN

SEQ ID NO: 36573 - protein, 262 aa, Diabrotica virgifera
  misc_feature: Coding regions on vcDNA: vcDNA=SeqID_16270; Strand=-; Position=1-786
  misc_feature (4)..(188): Xaa can be any naturally occurring amino acid
  misc_feature (191)..(228): Xaa can be any naturally occurring amino acid
  misc_feature (231)..(260): Xaa can be any naturally occurring amino acid
SFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRYXXXXXXXXXXXXXXXXXXXXXXXXXXXXXXEG

SEQ ID NO: 36574 - protein, 99 aa, Diabrotica virgifera
  misc_feature: Coding regions on vcDNA: vcDNA=SeqID_16271; Strand=-; Position=0-296
  misc_feature (15)..(22): Xaa can be any naturally occurring amino acid
  misc_feature (27)..(35): Xaa can be any naturally occurring amino acid
  misc_feature (40)..(94): Xaa can be any naturally occurring amino acid
FPPFLFSPSPSSPPXXXXXXXXPFSSXXXXXXXXXFPFPXXXXXXXXXXXXXXXXXXXXXXXXXXXXXXXXXXXXXXXXXXXXXXXXXXXXXXXAPVWG

SEQ ID NO: 36575 - protein, 242 aa, Diabrotica virgifera
  misc_feature: Coding regions on vcDNA: vcDNA=SeqID_16272; Strand=-; Position=1-726
  misc_feature (1)..(19): Xaa can be any naturally occurring amino acid
  misc_feature (22)..(22): Xaa can be any naturally occurring amino acid
  misc_feature (24)..(242): Xaa can be any naturally occurring amino acid
XXXXXXXXXXXXXXXXXXXLHXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36576 - protein, 127 aa, Diabrotica virgifera
  misc_feature: Coding regions on vcDNA: vcDNA=SeqID_16273; Strand=-; Position=158-541
  misc_feature (76)..(115): Xaa can be any naturally occurring amino acid
PLASLHCLEGALVRLFFIICHLDKGGISTMVINGVMPWFSQSNRCKKSDFGFIFSCLYEGLIRSIPEVENLGPLEXXXXXXXXXXXXXXXXXXXXXXXXXXXXXXXXXXXXXXXXSDCLIPIAYQQN

SEQ ID NO: 36577 - protein, 118 aa, Diabrotica virgifera
  misc_feature: Coding regions on vcDNA: vcDNA=SeqID_16274; Strand=-; Position=552-908
  misc_feature: Homolog annotation: Hit_ID=PC1123; Match level="QueryCoverage=68%, HitCoverage=12%, E-value=1e-09, Identity=40%"; Hit description =hypothetical protein - bloodfluke planorb (fragment)
  misc_feature (18)..(18): Xaa can be any naturally occurring amino acid
  misc_feature (23)..(23): Xaa can be any naturally occurring amino acid
MTIFSRHNINIEPFIVHXREIPXKKVVKYLGIILDDKLTWKFHIEYMLNRCEKGLNFLKMTTKTWWGTDVQTSLLFYRTYIRFIVDYGCWLYGSASKELTKQIKHIYKPVSADLYWCR

SEQ ID NO: 36578 - protein, 72 aa, Diabrotica virgifera
  misc_feature: Coding regions on vcDNA: vcDNA=SeqID_16275; Strand=-; Position=1-216
FQFILLYTKLLKSYKYFEVIDGEAAPKNLSKSTKASPFTADHRDCAEKHTCVLHTLTFTLLILSIVIVRKDD

SEQ ID NO: 36579 - protein, 186 aa, Diabrotica virgifera
  misc_feature: Coding regions on vcDNA: vcDNA=SeqID_16276; Strand=-; Position=1-558
  misc_feature (5)..(129): Xaa can be any naturally occurring amino acid
  misc_feature (132)..(169): Xaa can be any naturally occurring amino acid
  misc_feature (172)..(186): Xaa can be any naturally occurring amino acid
LFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXX

SEQ ID NO: 36580 - protein, 28 aa, Diabrotica virgifera
  misc_feature: Coding regions on vcDNA: vcDNA=SeqID_16277; Strand=+; Position=52-135
  misc_feature (17)..(28): Xaa can be any naturally occurring amino acid
FSELKFNYINRSDMMEXXXXXXXXXXXX

SEQ ID NO: 36581 - protein, 100 aa, Diabrotica virgifera
  misc_feature: Coding regions on vcDNA: vcDNA=SeqID_16278; Strand=+; Position=192-494
  misc_feature: Homolog annotation: Hit_ID=XP_309120.1; Match level="QueryCoverage =94%, HitCoverage=20%, E-value=5e-15, Identity=45%"; Hit description =ENSANGP00000024967 [Anopheles gambiae] gb|EAA04978.2| ENSANGP00000024967 [Anopheles gambiae
  misc_feature: Gene Ontology Annotation: Molecular function=peptidase activity; Cellular component=mitochondrion
  misc_feature (24)..(24): Xaa can be any naturally occurring amino acid
  misc_feature (44)..(44): Xaa can be any naturally occurring amino acid
  misc_feature (53)..(53): Xaa can be any naturally occurring amino acid
  misc_feature (73)..(73): Xaa can be any naturally occurring amino acid
VATENGSSLTTTVSICSDAVRRYXDDKNIGGAHSMTHMKLTETXKRTQCELEXLDIEYLCAQVYAYTGTYETXYYSKCLVKNVPPVIQILCDIILECQIA

SEQ ID NO: 36582 - protein, 66 aa, Diabrotica virgifera
  misc_feature: Coding regions on vcDNA: vcDNA=SeqID_16279; Strand=-; Position=99-299
ANQLLHCRSAHPTHLQLNLIPNFLYSHLAAVQKATITSSRISFPSPLVLAALALVALKQIKYCSIL

SEQ ID NO: 36583 - protein, 99 aa, Diabrotica virgifera
  misc_feature: Coding regions on vcDNA: vcDNA=SeqID_16280; Strand=+; Position=1-300
  misc_feature (1)..(75): Xaa can be any naturally occurring amino acid
  misc_feature (83)..(98): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXLRSLHCFXXXXXXXXXXXXXXXXF

SEQ ID NO: 36584 - protein, 168 aa, Diabrotica virgifera
  misc_feature: Coding regions on vcDNA: vcDNA=SeqID_16281; Strand=-; Position=3-506
  misc_feature (25)..(168): Xaa can be any naturally occurring amino acid
THSCGVRIYNIFHSHVIIIHACKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36585 - protein, 90 aa, Diabrotica virgifera
  misc_feature: Coding regions on vcDNA: vcDNA=SeqID_16282; Strand=-; Position=637-909
  misc_feature (5)..(5): Xaa can be any naturally occurring amino acid
  misc_feature (30)..(30): Xaa can be any naturally occurring amino acid
  misc_feature (57)..(57): Xaa can be any naturally occurring amino acid
KENLXLSLNVIKIKIAVICDFLESTHSVCXKEQMTILPLDFVTKPCFHFFSIVWRKXQIQVLRHQVTQFLWNYKYCFSYCVHLFSVQTFY

SEQ ID NO: 36586 - protein, 103 aa, Diabrotica virgifera
  misc_feature: Coding regions on vcDNA: vcDNA=SeqID_16283; Strand=-; Position=1-309
  misc_feature (7)..(8): Xaa can be any naturally occurring amino acid
  misc_feature (11)..(70): Xaa can be any naturally occurring amino acid
  misc_feature (72)..(72): Xaa can be any naturally occurring amino acid
  misc_feature (74)..(80): Xaa can be any naturally occurring amino acid
  misc_feature (82)..(103): Xaa can be any naturally occurring amino acid
NLILKNXXNNXXXXXXXXXXXXXXXXXXXXXXXXXXXXXXXXXXXXXXXXXXXXXXXXXXXXXXXXXXXXQXYXXXXXXXYXXXXXXXXXXXXXXXXXXXXXX

SEQ ID NO: 36587 - protein, 283 aa, Diabrotica virgifera
  misc_feature: Coding regions on vcDNA: vcDNA=SeqID_16284; Strand=-; Position=0-848
  misc_feature (16)..(29): Xaa can be any naturally occurring amino acid
  misc_feature (36)..(268): Xaa can be any naturally occurring amino acid
YTCYLIYKLNPTSSSXXXXXXXXXXXXXXVIRKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANRGLFLKKFGRLRG

SEQ ID NO: 36588 - protein, 53 aa, Diabrotica virgifera
  misc_feature: Coding regions on vcDNA: vcDNA=SeqID_16285; Strand=-; Position=1-159
  misc_feature (1)..(35): Xaa can be any naturally occurring amino acid
  misc_feature (37)..(52): Xaa can be any naturally occurring amino acid
XXXXXXXXXXXXXXXXXXXXXXXXXXXXXXXXXXXIXXXXXXXXXXXXXXXXL

SEQ ID NO: 36589 - protein, 83 aa, Diabrotica virgifera
  misc_feature: Coding regions on vcDNA: vcDNA=SeqID_16286; Strand=-; Position=211-462
ILLRKLLQKSMIFFASYRCTRDINTHHLIVYKKIHHICVIIETSSVINSPPVINFLFIYRAILNIVGHLQFTMAKSALIHVDH

SEQ ID NO: 36590 - protein, 79 aa, Diabrotica virgifera
  misc_feature: Coding regions on vcDNA: vcDNA=SeqID_16287; Strand=+; Position=3-239
  misc_feature (2)..(14): Xaa can be any naturally occurring amino acid
  misc_feature (20)..(34): Xaa can be any naturally occurring amino acid
  misc_feature (36)..(43): Xaa can be any naturally occurring amino acid
  misc_feature (58)..(59): Xaa can be any naturally occurring amino acid
  misc_feature (66)..(76): Xaa can be any naturally occurring amino acid
TXXXXXXXXXXXXXCDLDVXXXXXXXXXXXXXXXVXXXXXXXXSLNRCEPQVVSIFNXXIYFSTKXXXXXXXXXXXDNY

SEQ ID NO: 36591 - protein, 149 aa, Diabrotica virgifera
  misc_feature: Coding regions on vcDNA: vcDNA=SeqID_16288; Strand=+; Position=279-726
  misc_feature: Homolog annotation: Hit_ID=EAL41711.1; Match level="QueryCoverage =100%, HitCoverage=34%, E-value=5e-24, Identity=43%"; Hit description= ENSANGP00000026596 [Anopheles gambiae str. PEST] ref|XP_564497.1| ENSANGP00000026596 [Anopheles gambiae s
  misc_feature: Gene Ontology Annotation: Molecular function=glycogenin glucosyltransferase activity; Cellular component=soluble fraction; Biological process=glycogen biosynthesis
  misc_feature (28)..(28): Xaa can be any naturally occurring amino acid
  misc_feature (37)..(37): Xaa can be any naturally occurring amino acid
  misc_feature (53)..(53): Xaa can be any naturally occurring amino acid
  misc_feature (58)..(58): Xaa can be any naturally occurring amino acid
  misc_feature (66)..(66): Xaa can be any naturally occurring amino acid
  misc_feature (79)..(79): Xaa can be any naturally occurring amino acid
  misc_feature (129)..(129): Xaa can be any naturally occurring amino acid
MFNTSNKKHILHSKDDPNRRMVTRPELXMTFTKIHCXCLTRIHQCAILNAYTXAITTXDELFERDXILSADPHISCTDXSISADIAYRPYNETYKELILFVLNTPRYDRSDQGLLYFIVLRTWYSTDIXMHLPFIYNLSFSDCYSYLSA

SEQ ID NO: 36592 - protein, 54 aa, Diabrotica virgifera
  misc_feature: Coding regions on vcDNA: vcDNA=SeqID_16289; Strand=-; Position=138-302
SRGQGDAVIVISNNIRHIITQVQKKQRISSINRNHSYYIYYVAVLIYSCGRTLI

SEQ ID NO: 36593 - protein, 90 aa, Diabrotica virgifera
  misc_feature: Coding regions on vcDNA: vcDNA=SeqID_16290; Strand=+; Position=510-782
FHTTNRHKYLGYEIKISRNSQTHEIQRRIGLTWAEFDILNHILKSSIPMCLKRKFYNQRVFHVQTYLTDTTKRPFKSKARSRRHRNNHDA

SEQ ID NO: 36594 - protein, 270 aa, Diabrotica virgifera
  misc_feature: Coding regions on vcDNA: vcDNA=SeqID_16291; Strand=+; Position=85-897
  misc_feature: Homolog annotation: Hit_ID=XP_316230.1; Match level="QueryCoverage =98%, HitCoverage=36%, E-value=2e-26, Identity=31%"; Hit description =ENSANGP00000017684 [Anopheles gambiae]
  misc_feature (33)..(61): Xaa can be any naturally occurring amino acid
  misc_feature (120)..(130): Xaa can be any naturally occurring amino acid
MGSYLSEPVTNKVSTDESNDKLSCGASSMQGWXXXXXXXXXXXXXXXXXXXXXXXXXXXXXHEVAQYCSQKLPQFIKDTQAYKDGDIMQALIQGFLEFDATIPTKDVVAVLKEIAGEKEXXXXXXXXXXXDNLYEEATMPIEQVIEKYTNLVNPVLKSLKKDGDKFPKSPNLKSKQEEAGSSSGSSTISNKASKDDSGNSEDAAGSSIEVKSTKESSSSPEKNGSIPEIKVTSSESPESKDAPQESQVTQNGEASEDVKTDGTVTPTWCQ

SEQ ID NO: 36595 - protein, 105 aa, Diabrotica virgifera
  misc_feature: Coding regions on vcDNA: vcDNA=SeqID_16292; Strand=+; Position=60-377
LKLNVMHFICYCSFVKVVENFLSKSENYRDIAEDMLNNFNKHGCHMSIKMHYLHSHLDRFPENLDFLGDLSEEQGERFHQDIKTTEERYQGRCDTHMMADYCCSL

SEQ ID NO: 36596 - protein, 101 aa, Diabrotica virgifera
  misc_feature: Coding regions on vcDNA: vcDNA=SeqID_16293; Strand=+; Position=24-330
  misc_feature: Homolog annotation: Hit_ID=CAE51322.1; Match level="QueryCoverage =86%, HitCoverage=2%, E-value=3e-12, Identity=38%"; Hit description =basement membrane-specific heparan sulfate proteoglycan core protein precursor [Gallus gallus]
  misc_feature: Gene Ontology Annotation: Cellular component=basement membrane
  misc_feature: Pfam annotation: Pfam_ID=Laminin_G_2; Match level="Score=43.2, E -value=7.7e-10, Copies=1"; Pfam description=Laminin G domain
  misc_feature (48)..(48): Xaa can be any naturally occurring amino acid
MFNLQRSHFTFQQDTGLLLYNGNKGSDISGDYISLALKGGVPEFKYNXGAGTTLVRADRPITIGDWHTIKISRNRRKVTMYVDGDGPVVAVADGQYPDRYT

SEQ ID NO: 36597 - protein, 315 aa, Diabrotica virgifera
  misc_feature: Coding regions on vcDNA: vcDNA=SeqID_16294; Strand=+; Position=2-945
  misc_feature: Homolog annotation: Hit_ID=XP_393477.1; Match level="QueryCoverage =99%, HitCoverage=62%, E-value=1e-114, Identity=50%"; Hit description= similar to ENSANGP00000001195 [Apis mellifera]
  misc_feature: Gene Ontology Annotation: Molecular function=carboxypeptidase D activity; Cellular component=integral to membrane; Biological process=neuropeptide signaling pathway
  misc_feature: Pfam annotation: Pfam_ID=Peptidase_M14; Match level="Score=242.3, E -value=8.8e-70, Copies=1"; Pfam description=Zinc carboxypeptidase
  misc_feature (267)..(267): Xaa can be any naturally occurring amino acid
  misc_feature (269)..(269): Xaa can be any naturally occurring amino acid
  misc_feature (283)..(283): Xaa can be any naturally occurring amino acid
SEHPDLVKLRSVGKSVRNRDLWALEINSNVQNRTLLTPMFKYVANMHGDEAIGRQLMIYLALYLIHNYGTNDRVTRLVNSTDIYLMPSMNPDGYENSEEGRCESKKQYVGRENENSVDLNRDFPDQFDATKAGTILSGRQPETIAMMTWIISRPFVLSGNLHGGAVVASYPYDDSNSGRRCCVESRSPDNNIFKTLALNYAQSNPVMKKGNACKDDTFDQGITNGAFWYEVRGGMQDFNYVHSNCFEVTFELSCCKFPLAKTLPQEXAXNKEALLTFMESTHXGAKGLVRNENGDAVLDADVVVVGITHNVTTSN

SEQ ID NO: 36598 - protein, 17 aa, Diabrotica virgifera
  misc_feature: Coding regions on vcDNA: vcDNA=SeqID_16295; Strand=-; Position=0-50
  misc_feature (6)..(6): Xaa can be any naturally occurring amino acid
IIDLTXPNKITLLSLRV

SEQ ID NO: 36599 - protein, 259 aa, Diabrotica virgifera
  misc_feature: Coding regions on vcDNA: vcDNA=SeqID_16296; Strand=+; Position=99-877
  misc_feature: Homolog annotation: Hit_ID=1K9O; Match level="QueryCoverage=96%, HitCoverage=66%, E-value=5e-44, Identity=40%"; Hit description=Chain I, Crystal Structure Of Michaelis Serpin-Trypsin Complex
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=19.2, E-value =1.4e-11, Copies=1"; Pfam description=Serpin (serine protease inhibitor)
  misc_feature (30)..(30): Xaa can be any naturally occurring amino acid
  misc_feature (245)..(245): Xaa can be any naturally occurring amino acid
IYSEHLQGTRENIILSGLSAEIVLSLLAMXAKGETQKQLLIGLGLPNNITDVNKAFTEITSRLKVNTPDLKLLSANKIYPAKGFPIEKAFQDVAVNDYNSGVQNLDYNKPAEAAGTINGWVEDQTNHKIQNLIDPQMLDASTVLVLVNALYYTGKWDHPFEKYNSADRLFHSSPTESKKIPTMYTEAFAKYAYNDKLKAKFLELGFQGANVTMTFVLPDEINGLAAAEQNLKEYLAPQPLASARXAITLPRFKINTKID

SEQ ID NO: 36600 - protein, 312 aa, Diabrotica virgifera
  misc_feature: Coding regions on vcDNA: vcDNA=SeqID_16297; Strand=+; Position=2-940
  misc_feature: Homolog annotation: Hit_ID=AAP94623.1; Match level="QueryCoverage =91%, HitCoverage=30%, E-value=1e-125, Identity=77%"; Hit description= NMDA-type glutamate receptor 1 [Apis mellifera] ref|XP_392657.1| NMDA- type glutamate receptor 1 [Apis mel
  misc_feature: Gene Ontology Annotation: Molecular function=N-methyl-D-aspartate selective glutamate receptor activity; Cellular component=integral to plasma membrane; Biological process=glutamate signaling pathway
  misc_feature: Pfam annotation: Pfam_ID=ANF_receptor; Match level="Score=41.3, E -value=2.8e-09, Copies=1"; Pfam description=Receptor family ligand binding region
  misc_feature (277)..(277): Xaa can be any naturally occurring amino acid
LLKVVIYGLICCCFLSFLKANPRDWPNPTVFNIGGVLSSNESEKYFQETIAHLNFDSQYVPKGVTYYHTAILMDPNPIRTALNVCKYLISRKVYAVVVSHPLIGDLSPAAVSYTSGFYHIPVIGISSRDSAFSDKNIHVSFLRTVPPYSHQADVWVEMLKHFKYKKVIFIHSSDTDGRALLGRFQTTSQSLEDDVDIKVQVESVIEFESGLDSFRDQLLELKNAQSRVYLMYASKNDAKIIFRDAAAFNMTDAGFAWIVTEQALEADNIPEGILGLXLVNATNEKAHIRDSIYVLASALRDMNPTKEITEAP

SEQ ID NO: 36601 - protein, 86 aa, Diabrotica virgifera
  misc_feature: Coding regions on vcDNA: vcDNA=SeqID_16298; Strand=+; Position=74-334
MALHCEKIRILNIIIIIMMITYEISARPGNEWRQNNSCQDKDSIKREICQRCAKQTKSLLAYPMCCNEEDAVHKWCYHYTTYGKVA

SEQ ID NO: 36602 - protein, 263 aa, Diabrotica virgifera
  misc_feature: Coding regions on vcDNA: vcDNA=SeqID_16299; Strand=+; Position=81-872
  misc_feature: Homolog annotation: Hit_ID=XP_395449.1; Match level="QueryCoverage =93%, HitCoverage=48%, E-value=5e-70, Identity=50%"; Hit description =similar to ENSANGP00000014036 [Apis mellifera]
  misc_feature (250)..(250): Xaa can be any naturally occurring amino acid
MDHTPIQQFYKDANVFITGGTGFMGKILVEKLLRSTEVGTLYLLVREKKGKHKDDRITEIFDDVVFKRLKSEKSKFRHRVQAISGDLMLPHLGLSESDRQLLISKVNVIIHMGATIKFNESIISALHANVYSTKLVIDLAKEMKHIKSIVYVSTAYSNCTRSEVEERLYDPPISYEKSVELIEKLSPKELEKSTSRLIGKWPNTYTFTKCIAESLVNKEGNKLPVAIFRPSIVESTYREPMEGWKNNFYXQWFLLCALYRFFQ

SEQ ID NO: 36603 - protein, 68 aa, Diabrotica virgifera
  misc_feature: Coding regions on vcDNA: vcDNA=SeqID_16300; Strand=-; Position=523-729
SSSELLVRDFVRFVVRGNRTASSEPVQPILGIRFGVRICAVVISKYKHFYNVLCFKQLICSGVYFICF

SEQ ID NO: 36604 - protein, 249 aa, Diabrotica virgifera
  misc_feature: Coding regions on vcDNA: vcDNA=SeqID_16301; Strand=+; Position=2-751
  misc_feature (1)..(50): Xaa can be any naturally occurring amino acid
  misc_feature (53)..(66): Xaa can be any naturally occurring amino acid
  misc_feature (77)..(97): Xaa can be any naturally occurring amino acid
  misc_feature (120)..(173): Xaa can be any naturally occurring amino acid
  misc_feature (175)..(208): Xaa can be any naturally occurring amino acid
  misc_feature (210)..(220): Xaa can be any naturally occurring amino acid
  misc_feature (227)..(239): Xaa can be any naturally occurring amino acid
XXXXXXXXXXXXXXXXXXXXXXXXXXXXXXXXXXXXXXXXXXXXXXXXXXALXXXXXXXXXXXXXXGPPPVKTQNGXXXXXXXXXXXXXXXXXXXXXQTGGANFFLCFDPPKKKPGVPPXXXXXXXXXXXXXXXXXXXXXXXXXXXXXXXXXXXXXXXXXXXXXXXXXXXXXXLXXXXXXXXXXXXXXXXXXXXXXXXXXXXXXXXXXPXXXXXXXXXXXLKGTKFXXXXXXXXXXXXXAPKFNSGGGF

SEQ ID NO: 36605 - protein, 204 aa, Diabrotica virgifera
  misc_feature: Coding regions on vcDNA: vcDNA=SeqID_16302; Strand=-; Position=249-863
  misc_feature: Homolog annotation: Hit_ID=EAL40141.1; Match level="QueryCoverage =54%, HitCoverage=22%, E-value=7e-09, Identity=33%"; Hit description =ENSANGP00000016317 [Anopheles gambiae str. PEST] ref|XP_557375.1| ENSANGP00000016317 [Anopheles gambiae st
  misc_feature (140)..(151): Xaa can be any naturally occurring amino acid
SGNVCTIYQHQRAKKDLVPLKFLDEFINVEHQFVSLSSHNETVIIGAVYIPPSSNQDIYVDHCSAVEFIVENNPNSSLYLFGDYNLPQATWNYSTEDGLSVSCPAEYPALTVCESFSYLNLRQANIVANQHGVLLDLCFXXXXXXXXXXXXTAVDTLLSNNYHHVALSCELIVSDINPLSCDILYYDFKNAGYIRGVQVLGRDT

SEQ ID NO: 36606 - protein, 140 aa, Diabrotica virgifera
  misc_feature: Coding regions on vcDNA: vcDNA=SeqID_16303; Strand=-; Position=439-864
  misc_feature: Homolog annotation: Hit_ID=T30319; Match level="QueryCoverage=95%, HitCoverage=11%, E-value=2e-19, Identity=38%"; Hit description=Lian -Aa1 retrotransposition protein - yellow fever mosquito gb|AAB65093.1| Lian-Aa1
  misc_feature: Pfam annotation: Pfam_ID=RnaseH; Match level="Score=-14.0, E-value =0.0042, Copies=1"; Pfam description=RNase H
  misc_feature (19)..(19): Xaa can be any naturally occurring amino acid
  misc_feature (30)..(30): Xaa can be any naturally occurring amino acid
  misc_feature (33)..(33): Xaa can be any naturally occurring amino acid
  misc_feature (71)..(71): Xaa can be any naturally occurring amino acid
KQKSYSLGQYTTVFQGEGXALVACIYEIMXETXKSKRININTDSQAAILAVQNPLAKSKVLINCKDLLNSXNKVSSIWVPDHERIHGNERADLLAKQGTRETFVGPEPSFGIIKDATKNEVQKWLIRNHQKKCRATQGQL

SEQ ID NO: 36607 - protein, 241 aa, Diabrotica virgifera
  misc_feature: Coding regions on vcDNA: vcDNA=SeqID_16304; Strand=-; Position=2-724
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(235): Xaa can be any naturally occurring amino acid
  misc_feature (237)..(241): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 36608 - protein, 79 aa, Diabrotica virgifera
  misc_feature: Coding regions on vcDNA: vcDNA=SeqID_16305; Strand=-; Position=3-239
  misc_feature (3)..(3): Xaa can be any naturally occurring amino acid
  misc_feature (7)..(14): Xaa can be any naturally occurring amino acid
  misc_feature (16)..(27): Xaa can be any naturally occurring amino acid
  misc_feature (36)..(44): Xaa can be any naturally occurring amino acid
  misc_feature (46)..(59): Xaa can be any naturally occurring amino acid
  misc_feature (66)..(78): Xaa can be any naturally occurring amino acid
NIXLNIXXXXXXXXFXXXXXXXXXXXXQPGSHRFKXXXXXXXXXEXXXXXXXXXXXXXXSNIEVAXXXXXXXXXXXXXC

SEQ ID NO: 36609 - protein, 66 aa, Diabrotica virgifera; identical to SEQ ID NO: 26808
  misc_feature: Coding regions on vcDNA: vcDNA=SeqID_16306; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36610 - protein, 67 aa, Diabrotica virgifera
  misc_feature: Coding regions on vcDNA: vcDNA=SeqID_16307; Strand=+; Position=2-205
GSFTPDEGKGKPFPLYRKILFFVGAPRPREMSVHCVNAFIHYLQHAYLALFLNNYRFIICHFQSPKR

SEQ ID NO: 36611 - protein, 226 aa, Diabrotica virgifera
  misc_feature: Coding regions on vcDNA: vcDNA=SeqID_16308; Strand=+; Position=205-882
  misc_feature: Homolog annotation: Hit_ID=EAL34534.1; Match level="QueryCoverage =87%, HitCoverage=65%, E-value=4e-34, Identity=39%"; Hit description =GA11094-PA [Drosophila pseudoobscura]
  misc_feature: Gene Ontology Annotation: Molecular function=ribonuclease P activity; Cellular component=nucleolar ribonuclease P complex
  misc_feature: Pfam annotation: Pfam_ID=RNase_P_p30; Match level="Score=114.4, E -value=2.8e-31, Copies=1"; Pfam description=RNase P subunit p30
MEILNAREVQEPVPMPYDLLPIKTVIKNLNLVNFQIFNRLTIVFVNQDGLHKVTKSPNFRKYQIVAAAPTTNQALSYTCNNFDADIFTFNPENKFGLRLNRKLYNQLLQRGYHFELLYSPAIEDTTKRKNLIHASHLYHAFGKSRNIIFSSGAHDPVVIRGPYDVINFGFLFGLSQIQCKTAVSYCPHKVVINSVGRRHGKAIMFVEIPREQENTIETAEINGTVI

SEQ ID NO: 36612 - protein, 66 aa, Diabrotica virgifera; identical to SEQ ID NO: 26808
  misc_feature: Coding regions on vcDNA: vcDNA=SeqID_16309; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36613 - protein, 208 aa, Diabrotica virgifera
  misc_feature: Coding regions on vcDNA: vcDNA=SeqID_16310; Strand=+; Position=164-790
  misc_feature: Homolog annotation: Hit_ID=XP_395354.1; Match level="QueryCoverage =68%, HitCoverage=32%, E-value=4e-10, Identity=38%"; Hit description =similar to dsRNA adenosine deaminase [Apis mellifera]
MNMMDAKMQPQNMQYFSSCGPNNGPMQGGPMPPHMGHMEGPMSQDGPIGPMSMGSHMGNGPGPMGGNMGMPAGMIPMMRGPMRPPMGMRMPQMVFNGPPGGAEPMFNPGPNMGNPSPQMFVSGPKGSPMGLGAPDASQPLPPSMGQNNSFKNSPFVCPTTADPNYAQQFHNFQQQLYATGTRSQMGGQAMGPGPGPPHMQQPPYYNPK

SEQ ID NO: 36614 - protein, 207 aa, Diabrotica virgifera
  misc_feature: Coding regions on vcDNA: vcDNA=SeqID_16311; Strand=+; Position=161-783
  misc_feature: Homolog annotation: Hit_ID=AAV34812.1; Match level="QueryCoverage =95%, HitCoverage=47%, E-value=6e-56, Identity=57%"; Hit description =ribosomal protein L3 [Bombyx mori]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=47.3, E -value=2.4e-12, Copies=1"; Pfam description=Ribosomal protein L3
  misc_feature (36)..(52): Xaa can be any naturally occurring amino acid
  misc_feature (133)..(133): Xaa can be any naturally occurring amino acid
  misc_feature (192)..(192): Xaa can be any naturally occurring amino acid
ILNSFVSILEDPHMEIVDGDRNIVTPHVLRALATVXXXXXXXXXXXXXXXXXYKSKKKAFTKASNKWSGDIGKKATEKDLRKSVRYCQVVRDIAHTQTKLLKPRQLNAHVTKILLNGAIEGDTEACPKEHLEXPIPIDDDFAQDEMIDCIGVTRGHAYNGVTSRWYTKILPRERHKGLRNVACIGECNPSRXSFTAARAGHKLTIQK

SEQ ID NO: 36615 - protein, 307 aa, Diabrotica virgifera
  misc_feature: Coding regions on vcDNA: vcDNA=SeqID_16312; Strand=-; Position=1-921
  misc_feature (1)..(306): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXE

SEQ ID NO: 36616 - protein, 285 aa, Diabrotica virgifera
  misc_feature: Coding regions on vcDNA: vcDNA=SeqID_16313; Strand=-; Position=2-859
  misc_feature (19)..(32): Xaa can be any naturally occurring amino acid
  misc_feature (39)..(51): Xaa can be any naturally occurring amino acid
  misc_feature (53)..(284): Xaa can be any naturally occurring amino acid
HPGSRRFKLRSCNILKVEXXXXXXXXXXXXXXFNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 36617 - protein, 104 aa, Diabrotica virgifera
  misc_feature: Coding regions on vcDNA: vcDNA=SeqID_16314; Strand=+; Position=408-722
  misc_feature (4)..(11): Xaa can be any naturally occurring amino acid
  misc_feature (15)..(25): Xaa can be any naturally occurring amino acid
  misc_feature (41)..(50): Xaa can be any naturally occurring amino acid
  misc_feature (64)..(72): Xaa can be any naturally occurring amino acid
  misc_feature (85)..(96): Xaa can be any naturally occurring amino acid
LRIXXXXXXXXQYVXXXXXXXXXXXFINLLLKHNIYNVFTXXXXXXXXXXNLYISSKPIGLIHXXXXXXXXXPLTTCLFVSTLQXXXXXXXXXXXXHLDRANGP

SEQ ID NO: 36618 - protein, 216 aa, Diabrotica virgifera
  misc_feature: Coding regions on vcDNA: vcDNA=SeqID_16315; Strand=+; Position=291-938
  misc_feature: Homolog annotation: Hit_ID=XP_308493.1; Match level="QueryCoverage =93%, HitCoverage=20%, E-value=2e-89, Identity=79%"; Hit description =ENSANGP00000022800 [Anopheles gambiae]
MSKRHAEEAASGSQPPIKKIHFEPHLIGPVSTLEEMDIKVLQFQNKKLAQRIEQRCRTEQELRQRIEQLEKRQTQDDAMLNVVNRYWNQLNEDIRILLQRFDAETADESETKNENEATTSFLMQLSTWDKDELNDKLANRVQVSRRAVAKVIQAFDRLMQRNEKITLALKGELEGQEIPNLDEAIRQTNIQLQAENRNLQALHTTLHEKYHTLSLK

SEQ ID NO: 36619 - protein, 33 aa, Diabrotica virgifera
  misc_feature: Coding regions on vcDNA: vcDNA=SeqID_16316; Strand=+; Position=1-99
  misc_feature (12)..(12): Xaa can be any naturally occurring amino acid
HYAAALFIGEWXKGLSRPTLPANDRGERRVYEK

SEQ ID NO: 36620 - protein, 298 aa, Diabrotica virgifera
  misc_feature: Coding regions on vcDNA: vcDNA=SeqID_16317; Strand=+; Position=19-912
  misc_feature: Homolog annotation: Hit_ID=CAE47497.1; Match level="QueryCoverage =100%, HitCoverage=94%, E-value=3e-85, Identity=48%"; Hit description= cathepsin L-like proteinase [Diabrotica virgifera virgifera]
  misc_feature: Gene Ontology Annotation: Molecular function=cysteine-type peptidase activity; Cellular component=extracellular space; Biological process= proteolysis and peptidolysis
  misc_feature: Pfam annotation: Pfam_ID=Peptidase_C1; Match level="Score=218.2, E -value=1.6e-62, Copies=1"; Pfam description=Papain family cysteine protease
  misc_feature (170)..(175): Xaa can be any naturally occurring amino acid
MRVIVVIACLIVAITAKLNDYDHWVFFKDKHSKHYKITEDKLRFQIFQNNLRQIEEHNARYARGEVRWFKGVTKFADWTKEEFKVLLGRQAASRPKRNESLGVYMADPNVNVPSSVDWRNEDAVLPVRNQGMCGSCWAFSTVGALEGQVAIHQKQKVPLSPQNLIDCSTXXXXXXDGDQVKAFEYVQSNGISSEEDYPYMVKDQECNKNVKKSIASISGYKHLNPTEEDLISAIATVGPIAVSADASDWPYYAGGIYDDKYCGDNINHAIIATGYTDEYIVIKNSWGEEWGEDGYMRI

SEQ ID NO: 36621 - protein, 298 aa, Diabrotica virgifera
  misc_feature: Coding regions on vcDNA: vcDNA=SeqID_16318; Strand=+; Position=9-902
  misc_feature: Homolog annotation: Hit_ID=AAF87759.1; Match level="QueryCoverage =94%, HitCoverage=64%, E-value=1e-111, Identity=75%"; Hit description= cytochrome oxidase subunit I [Diabrotica virgifera virgifera]
  misc_feature: Pfam annotation: Pfam_ID=COX1; Match level="Score=76.8, E-value=6e -20, Copies=1"; Pfam description=Cytochrome C and Quinol oxidase polyp
  misc_feature (2)..(15): Xaa can be any naturally occurring amino acid
  misc_feature (23)..(23): Xaa can be any naturally occurring amino acid
  misc_feature (48)..(56): Xaa can be any naturally occurring amino acid
  misc_feature (83)..(83): Xaa can be any naturally occurring amino acid
  misc_feature (128)..(136): Xaa can be any naturally occurring amino acid
  misc_feature (140)..(146): Xaa can be any naturally occurring amino acid
  misc_feature (157)..(164): Xaa can be any naturally occurring amino acid
  misc_feature (185)..(185): Xaa can be any naturally occurring amino acid
  misc_feature (220)..(220): Xaa can be any naturally occurring amino acid
  misc_feature (237)..(237): Xaa can be any naturally occurring amino acid
  misc_feature (240)..(246): Xaa can be any naturally occurring amino acid
  misc_feature (273)..(279): Xaa can be any naturally occurring amino acid
  misc_feature (289)..(289): Xaa can be any naturally occurring amino acid
  misc_feature (293)..(293): Xaa can be any naturally occurring amino acid
LXXXXXXXXXXXXXXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAXFIQXFPLFT

SEQ ID NO: 36622 - protein, 52 aa, Diabrotica virgifera
  misc_feature: Coding regions on vcDNA: vcDNA=SeqID_16319; Strand=+; Position=236-394
HYDSIKIPVYNFYKPFHTINNSMNIFILYTNDESIIRLSLHEKNAHTKSITT

SEQ ID NO: 36623 - protein, 186 aa, Diabrotica virgifera
  misc_feature: Coding regions on vcDNA: vcDNA=SeqID_16320; Strand=+; Position=3-567
  misc_feature: Homolog annotation: Hit_ID=AAQ24506.1; Match level="QueryCoverage =95%, HitCoverage=47%, E-value=3e-47, Identity=60%"; Hit description =muscle-specific actin 2 [Aedes aegypti]
  misc_feature: Gene Ontology Annotation: Molecular function=structural constituent of cytoskeleton; Cellular component=cytoskeleton; Biological process= actin cytoskeleton organization and biogenesis
  misc_feature: Pfam annotation: Pfam_ID=Actin; Match level="Score=-68.3, E-value =0.02, Copies=1"; Pfam description=Actin
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (54)..(54): Xaa can be any naturally occurring amino acid
  misc_feature (71)..(71): Xaa can be any naturally occurring amino acid
  misc_feature (74)..(74): Xaa can be any naturally occurring amino acid
  misc_feature (87)..(87): Xaa can be any naturally occurring amino acid
  misc_feature (90)..(90): Xaa can be any naturally occurring amino acid
  misc_feature (136)..(136): Xaa can be any naturally occurring amino acid
  misc_feature (154)..(154): Xaa can be any naturally occurring amino acid
  misc_feature (157)..(157): Xaa can be any naturally occurring amino acid
DLCDYLMKSLTVRVYSXTTTAEREIXSDIQIXFCYVDLNFEHEMLTVAASTSLXNRYELSDVLSFTIVNQXIPXPEVLFQSSFLSMXSLXIHETVYKSIMKRELISVRTCYTNTDLSEGTTMYPAIAERMEKEMHXLAPSTIKIEIFNTPQMKXSVXNAGCILSSLYTFQQMSISQTEIRGSQHSN

SEQ ID NO: 36624 - protein, 171 aa, Diabrotica virgifera
  misc_feature: Coding regions on vcDNA: vcDNA=SeqID_16321; Strand=+; Position=271-788
  misc_feature: Homolog annotation: Hit_ID=AAM19283.1; Match level="QueryCoverage =99%, HitCoverage=53%, E-value=3e-41, Identity=58%"; Hit description =elongation factor-1 alpha [Leptopeza sp. NCSU-99071981]
  misc_feature (39)..(39): Xaa can be any naturally occurring amino acid
  misc_feature (71)..(71): Xaa can be any naturally occurring amino acid
  misc_feature (80)..(80): Xaa can be any naturally occurring amino acid
  misc_feature (86)..(86): Xaa can be any naturally occurring amino acid
  misc_feature (109)..(109): Xaa can be any naturally occurring amino acid
  misc_feature (120)..(120): Xaa can be any naturally occurring amino acid
  misc_feature (134)..(134): Xaa can be any naturally occurring amino acid
  misc_feature (146)..(146): Xaa can be any naturally occurring amino acid
  misc_feature (153)..(153): Xaa can be any naturally occurring amino acid
TEYKDEVKSLIEDSDAILLPSRPTEKPLRLPLQSFYKIXAIVTVHVGLVETDVLKPAMNVLFAPDNFPTEXLPLTMYREXSSSNYXADNDVFNVNNASVTECASWLPTXDTKNNQPRGDXDLPAQVIVLTPPWXISNQYPPALDCXHTGHNAXKFAEIKQKVYRCSGNTTE

SEQ ID NO: 36625 - protein, 143 aa, Diabrotica virgifera
  misc_feature: Coding regions on vcDNA: vcDNA=SeqID_16322; Strand=+; Position=345-776
  misc_feature: Homolog annotation: Hit_ID=XP_321443.1; Match level="QueryCoverage =90%, HitCoverage=30%, E-value=1e-29, Identity=51%"; Hit description =ENSANGP00000025162 [Anopheles gambiae]
  misc_feature: Gene Ontology Annotation: Molecular function=iron-sulfur electron transfer carrier; Cellular component=membrane fraction; Biological process=mitochondrial electron transport, NADH to ubiquinone
  misc_feature (31)..(31): Xaa can be any naturally occurring amino acid
  misc_feature (61)..(61): Xaa can be any naturally occurring amino acid
  misc_feature (93)..(93): Xaa can be any naturally occurring amino acid
  misc_feature (131)..(131): Xaa can be any naturally occurring amino acid
TSNLASCLSIQVFGINIDSEMTKKVRDSHYXFLLLNQPLDCPICEMCGECDLLYRNMVFDXYRARFTDIDSIAKKAMKKTEILLQMVTTIMTXCMHCTRCMRFASEIASNVHLCTTCQMNYMRVDTHVVKXFMSELSGKVINL

SEQ ID NO: 36626 - protein, 18 aa, Diabrotica virgifera
  misc_feature: Coding regions on vcDNA: vcDNA=SeqID_16323; Strand=-; Position=1-57
  misc_feature (1)..(17): Xaa can be any naturally occurring amino acid
XXXXXXXXXXXXXXXXXK

SEQ ID NO: 36627 - protein, 75 aa, Diabrotica virgifera
  misc_feature: Coding regions on vcDNA: vcDNA=SeqID_16324; Strand=-; Position=492-719
SSYNLTLKYIIKTVNIMKQILIVNNINKYEVSSPQLSNKSYQFMPKYHLRSIIVTVYSEQMCFIKTLYNPFIQIK

SEQ ID NO: 36628 - protein, 330 aa, Diabrotica virgifera
  misc_feature: Coding regions on vcDNA: vcDNA=SeqID_16325; Strand=-; Position=1-990
  misc_feature (1)..(326): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGREE

SEQ ID NO: 36629 - protein, 77 aa, Diabrotica virgifera
  misc_feature: Coding regions on vcDNA: vcDNA=SeqID_16326; Strand=+; Position=206-439
LFNIFMLTKFFLMECVVMIITFLLVFDVSTSNPEIVLKKRKIRKSTNVGFPCKLNLGIKYNYHYLIFMILNRLFRRR

SEQ ID NO: 36630 - protein, 206 aa, Diabrotica virgifera
  misc_feature: Coding regions on vcDNA: vcDNA=SeqID_16327; Strand=+; Position=347-964
  misc_feature: Homolog annotation: Hit_ID=NP_722482.1; Match level="QueryCoverage =91%, HitCoverage=15%, E-value=4e-17, Identity=40%"; Hit description =Bcl-2-associated transcription factor [Mus musculus] gb|AAH34300.1| Bcl-2-associated
  misc_feature: Gene Ontology Annotation: Molecular function=transcription co -activator activity; Cellular component=nucleus; Biological process =mRNA splice site selection
  misc_feature (55)..(68): Xaa can be any naturally occurring amino acid
  misc_feature (162)..(162): Xaa can be any naturally occurring amino acid
PIVIFLLGRRPPEPPGRPRSDSRSPKRRSRSRSRSSSGSRSRSRSRSRSYRSRSXXXXXXXXXXXXXXYSRSRSRSRSYSGDRRRYNRRGGFRGRHLNDRGTYYKPRFQTPRHNGQRGRGYYNNNRDSRYGDRDYRGRGRPYGFQNRGNRRQQRGRYGSRGXGGYRDYRDRRYSRSRSRDRDHSRSYSQSNSDASPSSKRDRSSPP

SEQ ID NO: 36631 - protein, 66 aa, Diabrotica virgifera; identical to SEQ ID NO: 26808
  misc_feature: Coding regions on vcDNA: vcDNA=SeqID_16328; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36632 - protein, 66 aa, Diabrotica virgifera; identical to SEQ ID NO: 28562
  misc_feature: Coding regions on vcDNA: vcDNA=SeqID_16329; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36633 - protein, 110 aa, Diabrotica virgifera
  misc_feature: Coding regions on vcDNA: vcDNA=SeqID_16330; Strand=-; Position=3-332
HEKCIVHRSNCNLSISVVLVDNIIVSSVPSMSIVLPQQTRLQITARYVYASYYIDISQHPQTVLSYSSLITYTLTLYTPNKQLIQETISFSSTSIYHHKPIPLNLSHSFK

SEQ ID NO: 36634 - protein, 202 aa, Diabrotica virgifera
  misc_feature: Coding regions on vcDNA: vcDNA=SeqID_16331; Strand=+; Position=115-720
  misc_feature: Homolog annotation: Hit_ID=XP_310211.1; Match level="QueryCoverage =100%, HitCoverage=42%, E-value=2e-47, Identity=53%"; Hit description= ENSANGP00000011012 [Anopheles gambiae]
  misc_feature: Pfam annotation: Pfam_ID=V-ATPase_H; Match level="Score=-141.3, E -value=4.3e-08, Copies=1"; Pfam description=V-ATPase subunit H
  misc_feature (12)..(12): Xaa can be any naturally occurring amino acid
  misc_feature (33)..(33): Xaa can be any naturally occurring amino acid
  misc_feature (50)..(50): Xaa can be any naturally occurring amino acid
  misc_feature (116)..(116): Xaa can be any naturally occurring amino acid
  misc_feature (131)..(131): Xaa can be any naturally occurring amino acid
  misc_feature (178)..(178): Xaa can be any naturally occurring amino acid
  misc_feature (189)..(189): Xaa can be any naturally occurring amino acid
YIESIARCLQMXLRIDNYRCGFLTDYVISTTVXVLSVRVHFQIQHHLIFXWCTLTFNPLLAEKMDYYIDIPRFVDILSDSLKEITTMIILAAFIKLIEEPKYQLDSEEHCITMKIXKVLKQLFILKQRKIXTEVYDLCDVQLLIEKLLIAVQYLSPCKEYLTELRSACLECSPVHDRXLWRENAQRLSXRNYKLLRVLIRLI

SEQ ID NO: 36635 - protein, 26 aa, Diabrotica virgifera
  misc_feature: Coding regions on vcDNA: vcDNA=SeqID_16332; Strand=-; Position=1-78
  misc_feature (8)..(17): Xaa can be any naturally occurring amino acid
LIQHRGRXXXXXXXXXXKNYAVIPKG

SEQ ID NO: 36636 - protein, 140 aa, Diabrotica virgifera
  misc_feature: Coding regions on vcDNA: vcDNA=SeqID_16333; Strand=+; Position=70-492
  misc_feature: Homolog annotation: Hit_ID=EAL26698.1; Match level="QueryCoverage =93%, HitCoverage=94%, E-value=2e-51, Identity=83%"; Hit description =GA14517-PA [Drosophila pseudoobscura]
  misc_feature: Gene Ontology Annotation: Molecular function=transporter activity; Cellular component=proton-transporting ATP synthase complex (sensu Eukarya)
  misc_feature: Pfam annotation: Pfam_ID=ATP-synt_C; Match level="Score=109.8, E -value=6.7e-30, Copies=1"; Pfam description=ATP synthase subunit C
IADVICARLIAPATRSALVANTKQYLRPLSSVVNQSQIQVQNVQQHKQPTLLPAIRSFQTTPVSRDIDSAAKFIGAGAATVGVAGSGAGIGTVFGSLIIGYARNPSLKQQLFSYAILGFALSEAMGLFCLMMAFLLLFAF

SEQ ID NO: 36637 - protein, 72 aa, Diabrotica virgifera
  misc_feature: Coding regions on vcDNA: vcDNA=SeqID_16334; Strand=+; Position=557-775
NCDMSFSSHTRLLFFPVLSIFEFHILFQILQLIYSVLFAYFLCSREKFLTLSKYHDIINHRLKYTNSTNYIC

SEQ ID NO: 36638 - protein, 279 aa, Diabrotica virgifera
  misc_feature: Coding regions on vcDNA: vcDNA=SeqID_16335; Strand=+; Position=19-855
  misc_feature: Homolog annotation: Hit_ID=XP_307863.1; Match level="QueryCoverage =95%, HitCoverage=65%, E-value=1e-121, Identity=79%"; Hit description= ENSANGP00000018620 [Anopheles gambiae] gb|EAA03629.2| ENSANGP00000018620 [Anopheles gambiae
  misc_feature: Gene Ontology Annotation: Molecular function=methionine adenosyltransferase activity; Cellular component=cytoplasm; Biological process=amino acid metabolism
  misc_feature: Pfam annotation: Pfam_ID=S-AdoMet_synt_M; Match level="Score=272.5, E- value=7.1e-79, Copies=1"; Pfam description=S-adenosylmethionine synthetase, cent
  misc_feature (159)..(168): Xaa can be any naturally occurring amino acid
LENPEFASSFRRTISEYSRRCSRKQRRTRNRGRGSGFDHKTCNVLLALDQQSPDIAAGVHINKNEEEIGAGDQGLMFGYATDETEECMPLTVVLAHRLNHKIADLRRSGEFWWARPDSKTQVTAEYTFQRGACIPQRVHTVVVSLQHSDKISLEELRTXXXXXXXXXXIPAKYLDDQTVIHINPCGLFIIGGPQSDAGLTGRKIIVDTYGGWGAHGGGAFSGKDFTKVDRSAAYAARWVAKSLVKAGLCRRCLVQVSYAIGLAEPLSITVFDYGTSKLT

SEQ ID NO: 36639 - protein, 253 aa, Diabrotica virgifera
  misc_feature: Coding regions on vcDNA: vcDNA=SeqID_16336; Strand=+; Position=2-763
  misc_feature: Homolog annotation: Hit_ID=XP_311405.1; Match level="QueryCoverage =100%, HitCoverage=35%, E-value=3e-81, Identity=61%"; Hit description= ENSANGP00000016646 [Anopheles gambiae]
  misc_feature: Gene Ontology Annotation: Molecular function=tumor necrosis factor receptor binding; Cellular component=extracellular space; Biological process=biological_process unknown
  misc_feature: Pfam annotation: Pfam_ID=HSP90; Match level="Score=-329.7, E-value =0.019, Copies=1"; Pfam description=Hsp90 protein
IKEGIITNYNMTEKESAANLLLFESSHEAPEKKVTLNDYLARATDNRTIYYLAAPSRTLAENSPYYESLKSRKQEVLFCYEPYDELVLMQLQQFKGNKLVSVEKDMREDKNANDLTNLGDDSLKRSEINDLSAWIKEKLGDKVAAVTATSRLESHPCVVTVEEMAAARHFIRTQSHSVSEDRRYAILQPKFEINPKHPIIKKMYTLMGTNPVLGELLAKQLFANSMVGAGLVEDPRTLLTSMNDLLVKALEKH

SEQ ID NO: 36640 - protein, 74 aa, Diabrotica virgifera
  misc_feature: Coding regions on vcDNA: vcDNA=SeqID_16337; Strand=+; Position=230-454
PQRGSHPKSFRFNKLLDSFSIKKMSGDISPLKKMTTLLMQKPGCCWVHNLNNITEHQKRLKRNLTVVFRKEGSL

SEQ ID NO: 36641 - protein, 79 aa, Diabrotica virgifera
  misc_feature: Coding regions on vcDNA: vcDNA=SeqID_16338; Strand=-; Position=588-827
SKTNDDNEKNRRLFYYLAQEMFLNPTNFDEIFANFSKHLPHLLQVALFSSKKESNEHPQHILKTILLGRIVVKRKDLQG

SEQ ID NO: 36642 - protein, 84 aa, Diabrotica virgifera
  misc_feature: Coding regions on vcDNA: vcDNA=SeqID_16339; Strand=-; Position=153-407
ILIYLHVRLLSLVSLLRGRLVMTCGMQYDSYCVVKITFDSYKDNHEPTLQNIFILRLQFRRCLLVSLITKLKLYGTNTTYKLKS

SEQ ID NO: 36643 - protein, 40 aa, Diabrotica virgifera
  misc_feature: Coding regions on vcDNA: vcDNA=SeqID_16340; Strand=-; Position=86-208
GRVVALYDDPLVDTRLYACFSTTGFTLFVSLYVTHWLEAS

SEQ ID NO: 36644 - protein, 302 aa, Diabrotica virgifera
  misc_feature: Coding regions on vcDNA: vcDNA=SeqID_16341; Strand=+; Position=86-994
  misc_feature: Homolog annotation: Hit_ID=XP_311853.1; Match level="QueryCoverage =69%, HitCoverage=71%, E-value=3e-25, Identity=35%"; Hit description =ENSANGP00000018296 [Anopheles gambiae]
  misc_feature: Pfam annotation: Pfam_ID=RBFA; Match level="Score=-34.2, E-value=0.1, Copies=1"; Pfam description=Ribosome-binding factor A
  misc_feature (125)..(137): Xaa can be any naturally occurring amino acid
MSRNFLVLKSVCLHFNSNFHTSCCYQVAPRQAGNFMKKVMGYFKEEAPNITDAFSKPSTGHISTNPRRVTVLNKLFMRNITDLMSTELYSSQLLGLGVEINKVKISTDYKILKVYWTSANIHQEXXXXXXXXXXXXXRHALSQLRLMGNVPIIQFVKDKHYDKIHELNKRLAIADYGEDGPSNTDPVAHLISEFQLSMPIDDKLKEQLVKLEEQNPYEVKDLQLPAMTHCVFNLDHEDIMNRVKKNNRKTRNADSSSRSVDESASFKLNQYSNTDPVVFRKCKLQREAFNKFLHQRNIMQKK

SEQ ID NO: 36645 - protein, 92 aa, Diabrotica virgifera
  misc_feature: Coding regions on vcDNA: vcDNA=SeqID_16342; Strand=-; Position=122-400
NSFECVKHFTSSSSVFIYGSVICEIKCCSTLNSFSICRKCYHLTMSNSLRESLMKQIYGEILNYLDFSIMCQFALGVFFSLCKKVFILINYV

SEQ ID NO: 36646 - protein, 63 aa, Diabrotica virgifera
  misc_feature: Coding regions on vcDNA: vcDNA=SeqID_16343; Strand=-; Position=219-410
  misc_feature (1)..(5): Xaa can be any naturally occurring amino acid
XXXXXLNLMYYLFTNHFEYIKANISALRSKTLYHNLLNSLYQLDKFKILLFFKYPYKQILSFY

SEQ ID NO: 36647 - protein, 323 aa, Diabrotica virgifera
  misc_feature: Coding regions on vcDNA: vcDNA=SeqID_16344; Strand=-; Position=1-969
  misc_feature (5)..(322): Xaa can be any naturally occurring amino acid
KVIYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 36648 - protein, 83 aa, Diabrotica virgifera
  misc_feature: Coding regions on vcDNA: vcDNA=SeqID_16345; Strand=+; Position=606-857
  misc_feature (31)..(37): Xaa can be any naturally occurring amino acid
  misc_feature (75)..(81): Xaa can be any naturally occurring amino acid
NNVNSIHENGQPKVECRHQKVERSLDATFSXXXXXXXCYFSSLFDFNIMKWYSIDNTKKITRKMKTPIPDREVQXXXXXXXSF

SEQ ID NO: 36649 - protein, 75 aa, Diabrotica virgifera
  misc_feature: Coding regions on vcDNA: vcDNA=SeqID_16346; Strand=-; Position=182-409
  misc_feature (21)..(26): Xaa can be any naturally occurring amino acid
KYLNEILILPNTYYLVTCQTXXXXXXIKYPKKSNEVLCKIRNKNSTYLLTCAMALPISYYSNIYSNQPIKTNRSK

SEQ ID NO: 36650 - protein, 293 aa, Diabrotica virgifera
  misc_feature: Coding regions on vcDNA: vcDNA=SeqID_16347; Strand=+; Position=35-913
  misc_feature: Homolog annotation: Hit_ID=XP_319685.1; Match level="QueryCoverage =87%, HitCoverage=48%, E-value=6e-49, Identity=37%"; Hit description =ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=7.0, E-value =0.002, Copies=1"; Pfam description=Major Facilitator Superfamily
MVQDNKISNNLVYQLVNTEIKEGDDVTADKIDSGPTIGKRHQQALILCILLTCCFVIRTALTVAIVAMTDPTASSNKDIPTYNWDDKSLVMASFLWGYFIPQVAAGYFSDKYGGKWFLVVSAAITATAGLLIPSAALYLGSKGVMVCRFLQGLSQGFLFPSLHATCGKWIPVPERSRLGTFVYTGATLGVCSSLILTGYISSSRYGWPMVFYSFNTIALIVVALYAYIGTNDPSSHPTITEEEKNYIINSLNTATDRRNLSVPWKEMLTSKALIAVLMTNICCNFTHWLFISE

SEQ ID NO: 36651 - protein, 47 aa, Diabrotica virgifera
  misc_feature: Coding regions on vcDNA: vcDNA=SeqID_16348; Strand=+; Position=391-534
  misc_feature (15)..(15): Xaa can be any naturally occurring amino acid
HNGTRKNPKKERCLXDIGLREYTTDADLYHLMSNNRPTEGVQDAIRG

SEQ ID NO: 36652 - protein, 67 aa, Diabrotica virgifera
  misc_feature: Coding regions on vcDNA: vcDNA=SeqID_16349; Strand=-; Position=144-347
  misc_feature (18)..(30): Xaa can be any naturally occurring amino acid
  misc_feature (36)..(45): Xaa can be any naturally occurring amino acid
  misc_feature (55)..(62): Xaa can be any naturally occurring amino acid
MSINNFLIKPLSNIIILXXXXXXXXXXXXXDLTQSXXXXXXXXXXFFLISHHSNXXXXXXXXILILK

SEQ ID NO: 36653 - protein, 25 aa, Diabrotica virgifera
  misc_feature: Coding regions on vcDNA: vcDNA=SeqID_16350; Strand=-; Position=1-75
  misc_feature (5)..(24): Xaa can be any naturally occurring amino acid
SKKLXXXXXXXXXXXXXXXXXXXXN

SEQ ID NO: 36654 - protein, 227 aa, Diabrotica virgifera
  misc_feature: Coding regions on vcDNA: vcDNA=SeqID_16351; Strand=-; Position=1-681
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(227): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 36655 - protein, 41 aa, Diabrotica virgifera
  misc_feature: Coding regions on vcDNA: vcDNA=SeqID_16352; Strand=-; Position=0-122
  misc_feature (8)..(40): Xaa can be any naturally occurring amino acid
IKKNGIKXXXXXXXXXXXXXXXXXXXXXXXXXXXXXXXXXL

SEQ ID NO: 36656 - protein, 218 aa, Diabrotica virgifera
  misc_feature: Coding regions on vcDNA: vcDNA=SeqID_16353; Strand=+; Position=15-671
  misc_feature: Homolog annotation: Hit_ID=AAL62468.1; Match level="QueryCoverage =99%, HitCoverage=52%, E-value=1e-63, Identity=59%"; Hit description =ribosomal protein L3 [Spodoptera frugiperda]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=56.8, E -value=6.3e-14, Copies=1"; Pfam description=Ribosomal protein L3
  misc_feature (9)..(9): Xaa can be any naturally occurring amino acid
  misc_feature (33)..(33): Xaa can be any naturally occurring amino acid
  misc_feature (46)..(46): Xaa can be any naturally occurring amino acid
  misc_feature (104)..(104): Xaa can be any naturally occurring amino acid
  misc_feature (115)..(115): Xaa can be any naturally occurring amino acid
  misc_feature (168)..(168): Xaa can be any naturally occurring amino acid
  misc_feature (179)..(179): Xaa can be any naturally occurring amino acid
ETPPMFVFXVVGYIETPHDLMSLATVWYDPLSXEDCRRRFYNNCYXNKKKVFTKDSKKWSDDLLINSIKKDLKKIAKYCEVARIIAHTHKKLMKFRQNKGHIMXILLNDAIVYDXYLELNIQLDKTIPIVNVFALDEMIDCNAVTMEHVYKGDTSRCHTKKLHRKTHXELRKVGCIVAXYPSRVSFTDARADQKVYLRGAAMRHKIYRMGAGIHTKDD

SEQ ID NO: 36657 - protein, 66 aa, Diabrotica virgifera
  misc_feature: Coding regions on vcDNA: vcDNA=SeqID_16354; Strand=+; Position=727-924
  misc_feature (15)..(20): Xaa can be any naturally occurring amino acid
  misc_feature (27)..(27): Xaa can be any naturally occurring amino acid
  misc_feature (48)..(48): Xaa can be any naturally occurring amino acid
  misc_feature (56)..(56): Xaa can be any naturally occurring amino acid
  misc_feature (63)..(63): Xaa can be any naturally occurring amino acid
FTSPVNIFDKMVFWXXXXXXAVTYFLXQLYLMYRHSFLPRYFYFVLLXLYFMQNHXKVTIQYXEIF

SEQ ID NO: 36658 - protein, 144 aa, Diabrotica virgifera
  misc_feature: Coding regions on vcDNA: vcDNA=SeqID_16355; Strand=+; Position=77-511
  misc_feature (2)..(16): Xaa can be any naturally occurring amino acid
  misc_feature (20)..(32): Xaa can be any naturally occurring amino acid
  misc_feature (41)..(54): Xaa can be any naturally occurring amino acid
  misc_feature (61)..(68): Xaa can be any naturally occurring amino acid
  misc_feature (70)..(81): Xaa can be any naturally occurring amino acid
  misc_feature (124)..(141): Xaa can be any naturally occurring amino acid
EXXXXXXXXXXXXXXXRASXXXXXXXXXXXXXHLKDLKRLXXXXXXXXXXXXXXHAMLFLXXXXXXXXRXXXXXXXXXXXXYTCLYYYYYIFLGIELKNIILLSFNFYIKIKIRNFHIFLYAIXXXXXXXXXXXXXXXXXXRFN

SEQ ID NO: 36659 - protein, 33 aa, Diabrotica virgifera
  misc_feature: Coding regions on vcDNA: vcDNA=SeqID_16356; Strand=-; Position=3-101
  misc_feature (18)..(19): Xaa can be any naturally occurring amino acid
  misc_feature (26)..(26): Xaa can be any naturally occurring amino acid
IINFIHIEGRNLIYRLTXXNKITLYXLSKLFYI

SEQ ID NO: 36660 - protein, 45 aa, Diabrotica virgifera
  misc_feature: Coding regions on vcDNA: vcDNA=SeqID_16357; Strand=-; Position=35-172
LIRITPKISNYRNEHSVIIQNFLHLYLHSQNLTHTKLFLYHDHSP

SEQ ID NO: 36661 - protein, 71 aa, Diabrotica virgifera
  misc_feature: Coding regions on vcDNA: vcDNA=SeqID_16358; Strand=+; Position=234-449
LSQDLLILSILVTNTLLYVQKGIKIPSPATFTIHGECSLMLLENLALAIGCTEHGISSTSTIRLWQDVLRF

SEQ ID NO: 36662 - protein, 128 aa, Diabrotica virgifera
  misc_feature: Coding regions on vcDNA: vcDNA=SeqID_16359; Strand=-; Position=390-776
  misc_feature (10)..(26): Xaa can be any naturally occurring amino acid
QYQKLKQYPXXXXXXXXXXXXXXXXXQYSIYSPPPSPSNNPIFNFPSVNNTLICSTNTLKHYTSSLTPIITAQTQISLLSKNIFTSHILITHAIKLITLIIDEISHTCNLTIIFSTKKPTSTLLYNTV

SEQ ID NO: 36663 - protein, 176 aa, Diabrotica virgifera
  misc_feature: Coding regions on vcDNA: vcDNA=SeqID_16360; Strand=+; Position=232-759
  misc_feature: Homolog annotation: Hit_ID=XP_321973.1; Match level="QueryCoverage =96%, HitCoverage=29%, E-value=3e-50, Identity=54%"; Hit description =ENSANGP00000011955 [Anopheles gambiae]
  misc_feature: Gene Ontology Annotation: Molecular function=sodium dependent multivitamin transporter activity; Cellular component=integral to plasma membrane; Biological process=transport
  misc_feature (32)..(32): Xaa can be any naturally occurring amino acid
MTTEKLLAVGDIGSSMQRFGWVDYVTFIEMLXISLVVGIYFGVCKKSETAQDYLVASRSMGIIPIAMSLLASSVSGISLLGIPTEVYVYGIQYNYILGGFVIASILMGYIFLPVFQGLQLTSTYEYHDRRFSKGVRLFGSLLFSIKMLSWVPLVIYVPALALNQASGINVHFITPT

SEQ ID NO: 36664 - protein, 113 aa, Diabrotica virgifera
  misc_feature: Coding regions on vcDNA: vcDNA=SeqID_16361; Strand=+; Position=2-343
  misc_feature: Pfam annotation: Pfam_ID=CBM_14; Match level="Score=42.4, E-value =1.4e-09, Copies=1"; Pfam description=Chitin binding Peritrophin-A domain
FFFFRCRNYRNMLRLNGPIGWALAVLMQGALLPAVILAQTENPNVSCDNEYAYYPDPNDCSSFFQCINGTKQHMECVSPLLWDNHIQGCEEESDCCMYINNTYLFNETICNFT

SEQ ID NO: 36665 - protein, 221 aa, Diabrotica virgifera
  misc_feature: Coding regions on vcDNA: vcDNA=SeqID_16362; Strand=+; Position=3-668
  misc_feature: Homolog annotation: Hit_ID=NP_788547.1; Match level="QueryCoverage =100%, HitCoverage=50%, E-value=1e-106, Identity=87%"; Hit description=CG5605-PG, isoform G [Drosophila melanogaster] ref|NP _730520.1| CG5605-PF, isoform F [Drosophila
  misc_feature: Gene Ontology Annotation: Biological process=protein biosynthesis
  misc_feature: Pfam annotation: Pfam_ID=eRF1_3; Match level="Score=224.9, E-value =1.5e-64, Copies=1"; Pfam description=eRF1 domain 3
  misc_feature (65)..(71): Xaa can be any naturally occurring amino acid
NDKPNIAGLILAGSADFKTELSQSDMFDPRLQAKVIKLVDVSYGGENGFNQAIELAAESLQNVKXXXXXXXIGRYFDEISQDTGKYCFGVEDTLRGLELGAVETLICWENLDIQRYVLKNHATGSETILHLTPEQEKDKSHFSDKETGVELELVECQPLLEWLANNYKNFGATLEIITDKSQEGSQFVRGFGGIGGILRYKVDFQSLQADEPLDDVDLDDY

SEQ ID NO: 36666 - protein, 72 aa, Diabrotica virgifera
  misc_feature: Coding regions on vcDNA: vcDNA=SeqID_16363; Strand=-; Position=0-215
  misc_feature (1)..(71): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXG

SEQ ID NO: 36667 - protein, 40 aa, Diabrotica virgifera
  misc_feature: Coding regions on vcDNA: vcDNA=SeqID_16364; Strand=+; Position=3-125
NITMRNCHMLKFVYHVFLDIAILHFPLRDHFLIFEHSYVM

SEQ ID NO: 36668 - protein, 138 aa, Diabrotica virgifera
  misc_feature: Coding regions on vcDNA: vcDNA=SeqID_16365; Strand=-; Position=420-836
  misc_feature (1)..(18): Xaa can be any naturally occurring amino acid
  misc_feature (20)..(27): Xaa can be any naturally occurring amino acid
  misc_feature (43)..(52): Xaa can be any naturally occurring amino acid
  misc_feature (57)..(87): Xaa can be any naturally occurring amino acid
  misc_feature (90)..(111): Xaa can be any naturally occurring amino acid
  misc_feature (115)..(134): Xaa can be any naturally occurring amino acid
XXXXXXXXXXXXXXXXXXLXXXXXXXXIFILSFIAAFNKQTNXXXXXXXXXXRGHSXXXXXXXXXXXXXXXXXXXXXXXXXXXXXXXKPXXXXXXXXXXXXXXXXXXXXXXLNLXXXXXXXXXXXXXXXXXXXXYFNI

SEQ ID NO: 36669 - protein, 160 aa, Diabrotica virgifera
  misc_feature: Coding regions on vcDNA: vcDNA=SeqID_16366; Strand=-; Position=350-832
  misc_feature (7)..(13): Xaa can be any naturally occurring amino acid
  misc_feature (20)..(34): Xaa can be any naturally occurring amino acid
  misc_feature (48)..(55): Xaa can be any naturally occurring amino acid
  misc_feature (69)..(76): Xaa can be any naturally occurring amino acid
  misc_feature (81)..(115): Xaa can be any naturally occurring amino acid
  misc_feature (118)..(160): Xaa can be any naturally occurring amino acid
TSIRSSXXXXXXXLFNSKIXXXXXXXXXXXXXXXPSFHLSIKNLMIIXXXXXXXXSVIQTNQWTDETFXXXXXXXXLIITXXXXXXXXXXXXXXXXXXXXXXXXXXXXXXXXXXXLYXXXXXXXXXXXXXXXXXXXXXXXXXXXXXXXXXXXXXXXXXXX

SEQ ID NO: 36670 - protein, 202 aa, Diabrotica virgifera
  misc_feature: Coding regions on vcDNA: vcDNA=SeqID_16367; Strand=-; Position=0-605
  misc_feature (2)..(8): Xaa can be any naturally occurring amino acid
  misc_feature (13)..(58): Xaa can be any naturally occurring amino acid
  misc_feature (62)..(88): Xaa can be any naturally occurring amino acid
  misc_feature (94)..(193): Xaa can be any naturally occurring amino acid
  misc_feature (195)..(201): Xaa can be any naturally occurring amino acid
PXXXXXXXWFPGXXXXXXXXXXXXXXXXXXXXXXXXXXXXXXXXXXXXXXXXXXXXXXAPPXXXXXXXXXXXXXXXXXXXXXXXXXXXGGPYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXP

SEQ ID NO: 36671 - protein, 181 aa, Diabrotica virgifera
  misc_feature: Coding regions on vcDNA: vcDNA=SeqID_16368; Strand=+; Position=59-604
  misc_feature: Homolog annotation: Hit_ID=XP_318244.1; Match level="QueryCoverage =99%, HitCoverage=98%, E-value=9e-68, Identity=73%"; Hit description =ENSANGP00000017122 [Anopheles gambiae]
  misc_feature: Gene Ontology Annotation: Molecular function=transcription co -repressor activity; Cellular component=nucleus; Biological process =regulation of transcription, DNA-dependent
  misc_feature: Pfam annotation: Pfam_ID=CBFD_NFYB_HMF; Match level="Score=94.4, E -value=2.9e-25, Copies=1"; Pfam description=Histone-like transcription factor (CBF
KQYKMANPNNSGPLGSGNTEDDELTLPRASINKMIKELVPSVRIANEARELILNCCTEFIHLLSSEANEICNQLHKKTINAEHVLMALNRLGFCDYTAEAEAVLKDCKAVAAKRRRQSTRLENLGIPEEELLRQQQELFAKARQEQAQADQQQWEQLQAAAARQAQQQQQQQGEDDLDDYC

SEQ ID NO: 36672 - protein, 74 aa, Diabrotica virgifera
  misc_feature: Coding regions on vcDNA: vcDNA=SeqID_16369; Strand=-; Position=598-822
  misc_feature (7)..(7): Xaa can be any naturally occurring amino acid
  misc_feature (27)..(38): Xaa can be any naturally occurring amino acid
TNQTLSXSQNSPHPVEYSSIYKILKLXXXXXXXXXXXXAFLSIRLCWTIKKLGTSTTSHVLHQYRVFLNKYGKL

SEQ ID NO: 36673 - protein, 83 aa, Diabrotica virgifera
  misc_feature: Coding regions on vcDNA: vcDNA=SeqID_16370; Strand=+; Position=518-769
EQHENTELNRILSMRFRKSSFLYTPFTLYMTIVFLLSFWIYINLVTCCSSSSTIIVKENVALLQEIRVLEKASGLFCVLGLHY

SEQ ID NO: 36674 - protein, 46 aa, Diabrotica virgifera
  misc_feature: Coding regions on vcDNA: vcDNA=SeqID_16371; Strand=-; Position=80-220
PAPPPTVFPRLEIGASYRSDASYASSTFGGSVICSFLIGLKRCTRV

SEQ ID NO: 36675 - protein, 238 aa, Diabrotica virgifera; identical to SEQ ID NO: 32100
  misc_feature: Coding regions on vcDNA: vcDNA=SeqID_16372; Strand=-; Position=1-714
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(238): Xaa can be any naturally occurring amino acid

SEQ ID NO: 36676 - protein, 90 aa, Diabrotica virgifera
  misc_feature: Coding regions on vcDNA: vcDNA=SeqID_16373; Strand=-; Position=294-566
TMSRYDTWESRISELCFPHVALITAGWLFVFDLIHHHRYRHNKSSASSEQIYHINVHVVPEFQPNYLATDSTERVRTGLATLSTKVDTKI

SEQ ID NO: 36677 - protein, 136 aa, Diabrotica virgifera
  misc_feature: Coding regions on vcDNA: vcDNA=SeqID_16374; Strand=+; Position=1-411
  misc_feature (9)..(16): Xaa can be any naturally occurring amino acid
  misc_feature (18)..(24): Xaa can be any naturally occurring amino acid
  misc_feature (54)..(61): Xaa can be any naturally occurring amino acid
IRSRRSAEXXXXXXXXEXXXXXXXFLPGFARKGIRSRRSAELEEPEENNERAKXXXXXXXXFARKGIRSRRSIYLEDTEDEESGNRERRNIGFLPGFARKGIRSKRSVDDEEEKDSERTKRNIGFLPGFARKGIRS

SEQ ID NO: 36678 - protein, 124 aa, Diabrotica virgifera
  misc_feature: Coding regions on vcDNA: vcDNA=SeqID_16375; Strand=+; Position=1-375
  misc_feature: Homolog annotation: Hit_ID=AAH59014.1; Match level="QueryCoverage =77%, HitCoverage=23%, E-value=7e-14, Identity=41%"; Hit description =4930566A11Rik protein [Mus musculus]
KRERRAIIKQNEAQDQAMRQRELEYRRKQRAQATTEQILARRIRDAEARRLRRANETEEQAEARRARESEARRIRRANESEEKKEARRRRDNDARRLSRKLITNSEARPFVSILKTLLVYKLVD

SEQ ID NO: 36679 - protein, 26 aa, Diabrotica virgifera
  misc_feature: Coding regions on vcDNA: vcDNA=SeqID_16376; Strand=-; Position=1-78
  misc_feature (20)..(20): Xaa can be any naturally occurring amino acid
PIITLIHIEGRNLYYRFDSXNKITLL

SEQ ID NO: 36680 - protein, 85 aa, Diabrotica virgifera
  misc_feature: Coding regions on vcDNA: vcDNA=SeqID_16377; Strand=+; Position=121-378
NALCLTSLSRGGFTWLSICTGVSYTYLFAGCSRYWIVLLANSSCNNLLVLGGTPCILLVYRVEGLLGFQFLLGFPIPISLHFLNV

SEQ ID NO: 36681 - protein, 210 aa, Diabrotica virgifera
  misc_feature: Coding regions on vcDNA: vcDNA=SeqID_16378; Strand=+; Position=73-702
  misc_feature (13)..(28): Xaa can be any naturally occurring amino acid
  misc_feature (35)..(41): Xaa can be any naturally occurring amino acid
  misc_feature (64)..(71): Xaa can be any naturally occurring amino acid
  misc_feature (100)..(107): Xaa can be any naturally occurring amino acid
  misc_feature (168)..(174): Xaa can be any naturally occurring amino acid
MDKMKEEREKKLXXXXXXXXXXXXXXXXGSPFPPXXXXXXXPPFSPPRGGCAPPLKGWGGGYSXXXXXXXXPLKLVWGFLSGNFYNFLGIGKFWPLFRGXXXXXXXXKNSSGWGGGFGARVFCRGFSLGRPFPRFFWPLGNFFLQGGVKGGGFKGVFSPFFLFGNTFXXXXXXXGDLNRLGKVGVFFFAPPGVSLGVFLLPPRGGRVVLC

SEQ ID NO: 36682 - protein, 90 aa, Diabrotica virgifera
  misc_feature: Coding regions on vcDNA: vcDNA=SeqID_16379; Strand=-; Position=208-480
QNELSSNTITLYLIQLLLIVLGLTIKKLLPTLTKFFYSVIHVESENLSISENFQGRGRFVNIEGITHLNLYPTGVGTLKILSTYFYQTIV

SEQ ID NO: 36683 - protein, 17 aa, Diabrotica virgifera
  misc_feature: Coding regions on vcDNA: vcDNA=SeqID_16380; Strand=-; Position=1-51
  misc_feature (1)..(15): Xaa can be any naturally occurring amino acid
XXXXXXXXXXXXXXXQL

SEQ ID NO: 36684 - protein, 75 aa, Diabrotica virgifera
  misc_feature: Coding regions on vcDNA: vcDNA=SeqID_16381; Strand=+; Position=1-228
  misc_feature: Homolog annotation: Hit_ID=XP_393596.1; Match level="QueryCoverage =94%, HitCoverage=2%, E-value=1e-25, Identity=76%"; Hit description =similar to ubiquitin specific protease 34 [Apis mellifera]
KQSHIILNFLVMEGRITCDHMDVIWAAAQLKHCSKPVHDLLPGLVKHLAAAPTLHLYSLLTKLEPKDHTEQVSTY

SEQ ID NO: 36685 - protein, 285 aa, Diabrotica virgifera
  misc_feature: Coding regions on vcDNA: vcDNA=SeqID_16382; Strand=+; Position=63-917
  misc_feature: Homolog annotation: Hit_ID=AAT37512.1; Match level="QueryCoverage =59%, HitCoverage=42%, E-value=3e-19, Identity=33%"; Hit description =caspase 8 [Ictalurus punctatus]
  misc_feature: Gene Ontology Annotation: Molecular function=caspase-8 activity; Cellular component=cytoskeleton; Biological process=apoptotic program
  misc_feature: Pfam annotation: Pfam_ID=Peptidase_C14; Match level="Score=27.3, E -value=4.3e-10, Copies=1"; Pfam description=Caspase domain
  misc_feature (266)..(266): Xaa can be any naturally occurring amino acid
HSSQQRRTITTSSSSGSITSRWPPPSTNIESTRLGSISDLTLKPIPYKKSPFPRHNSERLPTKTTNNNVVSKKFILPSSQKVETDARPFQNGSTISSVPRIQTNNTRPITLSDIPKYDTNGPRRGTVVIFNNIKFLDIKDERKGAELDEKNLKTLFRDMGFDVYVHQNQKLNEMKSKLNSYRQSRDVGRGDILIVIVMSHGNNARGSEEIPGGFTKIQTSDDKYLNVDEFLSEFTNDRCAPMKGKPKIFIFQCCRGHREELQIDAXPFTNIVKKHADMLIAFSTV

SEQ ID NO: 36686 - protein, 39 aa, Diabrotica virgifera
  misc_feature: Coding regions on vcDNA: vcDNA=SeqID_16383; Strand=-; Position=1-120
  misc_feature (4)..(37): Xaa can be any naturally occurring amino acid
YRRXXXXXXXXXXXXXXXXXXXXXXXXXXXXXXXXXXAL

SEQ ID NO: 36687 - protein, 221 aa, Diabrotica virgifera
  misc_feature: Coding regions on vcDNA: vcDNA=SeqID_16384; Strand=+; Position=1-666
  misc_feature: Homolog annotation: Hit_ID=EAA03764.2; Match level="QueryCoverage =99%, HitCoverage=25%, E-value=5e-76, Identity=60%"; Hit description =ENSANGP00000006257 [Anopheles gambiae str. PEST] ref|XP_565569.1| ENSANGP00000006257 [Anopheles gambiae st
  misc_feature: Gene Ontology Annotation: Molecular function=beta-N -acetylglucosaminyl-glycopeptide beta-14-galactosyltransferase activity; Cellular component=Golgi apparatus; Biological process =protein modification
  misc_feature: Pfam annotation: Pfam_ID=FYVE; Match level="Score=87.3, E-value=4.2e -23, Copies=1"; Pfam description=FYVE zinc finger
  misc_feature (118)..(123): Xaa can be any naturally occurring amino acid
EAGNHSAVLALIQNNSDCDATDVENDNAFHIAMREGHLNVVKVLLTESYIDVEAVNLKGRNPLHELCKYGKDNAATICGLLLECIPTYPINNPDILGNSPLLLAYINGNGSLCRVLVXXXXXXSSENSERVTIFNYQVPTKQLLNRLLDTLSEPAPWTNTDSCQECGKRFTLTVRTHHCRHCGRALCSKCSDTEVPIIKFGENKPVRVCKVCFDVLKTGAS

SEQ ID NO: 36688 - protein, 115 aa, Diabrotica virgifera
  misc_feature: Coding regions on vcDNA: vcDNA=SeqID_16385; Strand=+; Position=2-349
  misc_feature (88)..(95): Xaa can be any naturally occurring amino acid
NNKSRKRKQLHSGVYKLTCDCPKTYIGQTGRTFDKRIAEHKRAFNNRKTDTSTYALHLLDHNHSFNEEFQILHIQNKGLKLSLLESMXXXXXXXXDIILNDQLETNSSPLLNLFS

SEQ ID NO: 36689 - protein, 305 aa, Diabrotica virgifera
  misc_feature: Coding regions on vcDNA: vcDNA=SeqID_16386; Strand=+; Position=2-916
  misc_feature: Homolog annotation: Hit_ID=EAL31307.1; Match level="QueryCoverage =99%, HitCoverage=34%, E-value=1e-121, Identity=69%"; Hit description= GA10064-PA [Drosophila pseudoobscura]
  misc_feature: Gene Ontology Annotation: Molecular function=aminopeptidase activity; Cellular component=cytosol; Biological process=proteolysis and peptidolysis
  misc_feature: Pfam annotation: Pfam_ID=Peptidase_M1; Match level="Score=-95.3, E -value=2.2e-07, Copies=1"; Pfam description=Peptidase family M1
LPKIDLIAIADFCAGAMENWGLVTYRETCLLVDPKNTSAVSKQWIALVVGHELAHQWFGNLVTMEWWTHLWLNEGYASFVEFLCVNYLFPEYDIWTQFVNDSYIKALELDSLKNSHPIEVPVGNPSEIDEIFDDISYNKGASVIRMLHHYIGDEDFRKGMHLYLTRHQYKNTFTENLWAALEEASQKPVGDVMSFWTKQKGFPVVKVTQQPAGDGGGVKLTLSQSKFTADGSSPADEDYLWMIPISISTSKHPSKEVVCIVLTTRTAEIVVPESEKSDWIKVNPGAIGFYRTQYTPRMVGEVYSC

SEQ ID NO: 36690 - protein, 274 aa, Diabrotica virgifera
  misc_feature: Coding regions on vcDNA: vcDNA=SeqID_16387; Strand=-; Position=0-821
  misc_feature (2)..(270): Xaa can be any naturally occurring amino acid
VXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDARG

SEQ ID NO: 36691 - protein, 62 aa, Diabrotica virgifera
  misc_feature: Coding regions on vcDNA: vcDNA=SeqID_16388; Strand=-; Position=284-472
  misc_feature (16)..(23): Xaa can be any naturally occurring amino acid
NQKTIHLQDKLLNIIXXXXXXXXNQHHGCLDRKSAITLAILLRKIIPELEIIFKTKNVFGKS

SEQ ID NO: 36692 - protein, 61 aa, Diabrotica virgifera
  misc_feature: Coding regions on vcDNA: vcDNA=SeqID_16389; Strand=+; Position=319-501
  misc_feature (20)..(20): Xaa can be any naturally occurring amino acid
FPLTTQYSNAEADICRERYXSEGRARSEQLCQPRRKLRDGLAEDEQTVETVEEMVVGREKS

SEQ ID NO: 36693 - protein, 99 aa, Diabrotica virgifera
  misc_feature: Coding regions on vcDNA: vcDNA=SeqID_16390; Strand=-; Position=230-529
SCGYDLFVNWVDSLACNPGRSRFYIVPPFLFLLRVFSLLGRGKKNVSYFLFWIAFQSLYLVSLRSGDLFVWSWSFSFISVSFSVLVFIASNHVPLRPSF

SEQ ID NO: 36694 - protein, 90 aa, Diabrotica virgifera
  misc_feature: Coding regions on vcDNA: vcDNA=SeqID_16391; Strand=+; Position=346-618
  misc_feature (63)..(69): Xaa can be any naturally occurring amino acid
HIAESRSYWDTRYIPFVLYVFFSSCVHVIVKWSLCDLFSSFQSLSLSTFRLFLSRHEFVCFSXXXXXXXILLFLTQSLISFTLHLRNLRN

SEQ ID NO: 36695 - protein, 269 aa, Diabrotica virgifera
  misc_feature: Coding regions on vcDNA: vcDNA=SeqID_16392; Strand=-; Position=2-808
  misc_feature (7)..(17): Xaa can be any naturally occurring amino acid
  misc_feature (27)..(34): Xaa can be any naturally occurring amino acid
  misc_feature (37)..(50): Xaa can be any naturally occurring amino acid
  misc_feature (56)..(69): Xaa can be any naturally occurring amino acid
  misc_feature (78)..(239): Xaa can be any naturally occurring amino acid
  misc_feature (241)..(269): Xaa can be any naturally occurring amino acid
YIFGPFXXXXXXXXXXXTNLAHTGLNXXXXXXXXSNXXXXXXXXXXXXXXPTSRSXXXXXXXXXXXXXXVIPKVIYSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXX

SEQ ID NO: 36696 - protein, 66 aa, Diabrotica virgifera; identical to SEQ ID NO: 26808
  misc_feature: Coding regions on vcDNA: vcDNA=SeqID_16393; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36697 - protein, 27 aa, Diabrotica virgifera
  misc_feature: Coding regions on vcDNA: vcDNA=SeqID_16394; Strand=-; Position=18-101
KTPYRRPGRSDLLLRQTWLRRFKKGTS

SEQ ID NO: 36698 - protein, 66 aa, Diabrotica virgifera; identical to SEQ ID NO: 26808
  misc_feature: Coding regions on vcDNA: vcDNA=SeqID_16395; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36699 - protein, 109 aa, Diabrotica virgifera
  misc_feature: Coding regions on vcDNA: vcDNA=SeqID_16396; Strand=-; Position=242-571
CQFIPPKQPLGSTMQSFAASCIFTHTHKVVNKHCVVFGFGVLHCEGVLFSCAPLHSFFLRFVSSLDIIGVSSNISFSISGTDLYDTIGVAFSIFCYLLFALIMLYISTE

SEQ ID NO: 36700 - protein, 71 aa, Diabrotica virgifera
  misc_feature: Coding regions on vcDNA: vcDNA=SeqID_16397; Strand=-; Position=1-213
  misc_feature (6)..(71): Xaa can be any naturally occurring amino acid
IPPFFXXXXXXXXXXXXXXXXXXXXXXXXXXXXXXXXXXXXXXXXXXXXXXXXXXXXXXXXXXXXXXXXXX

SEQ ID NO: 36701 - protein, 125 aa, Diabrotica virgifera
  misc_feature: Coding regions on vcDNA: vcDNA=SeqID_16398; Strand=+; Position=94-472
  misc_feature: Homolog annotation: Hit_ID=AAF67724.2; Match level="QueryCoverage =93%, HitCoverage=24%, E-value=6e-13, Identity=39%"; Hit description =insecticide resistance-associated cytochrome P450 [Diabrotica virgifera virgifera]
  misc_feature (44)..(44): Xaa can be any naturally occurring amino acid
  misc_feature (53)..(53): Xaa can be any naturally occurring amino acid
QLLAKAYMYKLVNAREVKGLTAEAGSPRIPERRISTPECQYSIXQKFIRVLNXKLRRVVETIIPRVLDSSLCIDPLLSRTVIITIAGASFGTSARDDVTYLQFVKCGEILIYRKIRHLFPFFTYM

SEQ ID NO: 36702 - protein, 240 aa, Diabrotica virgifera
  misc_feature: Coding regions on vcDNA: vcDNA=SeqID_16399; Strand=+; Position=145-864
  misc_feature: Homolog annotation: Hit_ID=AAL39999.1; Match level="QueryCoverage =63%, HitCoverage=23%, E-value=5e-11, Identity=33%"; Hit description =SD10307p [Drosophila melanogaster]
  misc_feature: Gene Ontology Annotation: Biological process=induction of apoptosis
MLSRKNKDLRTIKEGVVGKYVRKDTPPEMPIINVWTTEPIRRHSNQGRSSLTSSNTIPTSSASSSNSSSQLTVQKFGNQKTLISDVGLGAHEGKYTPSATRFANLTIGLAGDSTTFGNPVINSSQPIYSNQPLGSVYNDSSANNANYVEIDQIYPLSHDSNNYQDSRYNRTNSPIYQNTNKNSVINDTNLDSTPIYSNTNINSFGNQPRVFRMLSRFLHIQDIALIDLKILRKQLRNYTT

SEQ ID NO: 36703 - protein, 31 aa, Diabrotica virgifera
  misc_feature: Coding regions on vcDNA: vcDNA=SeqID_16400; Strand=-; Position=1-93
  misc_feature (1)..(24): Xaa can be any naturally occurring amino acid
  misc_feature (26)..(27): Xaa can be any naturally occurring amino acid
  misc_feature (29)..(29): Xaa can be any naturally occurring amino acid
XXXXXXXXXXXXXXXXXXXXXXXXHXXLXKL

SEQ ID NO: 36704 - protein, 64 aa, Diabrotica virgifera
  misc_feature: Coding regions on vcDNA: vcDNA=SeqID_16401; Strand=-; Position=105-299
KRQGARVLSCCVNVFRMRTASRSYAFVSLSIKVSVATQTSACAVCSAILRVWENNRQVSSDTTK

SEQ ID NO: 36705 - protein, 285 aa, Diabrotica virgifera
  misc_feature: Coding regions on vcDNA: vcDNA=SeqID_16402; Strand=+; Position=3-856
  misc_feature: Homolog annotation: Hit_ID=AAA70222.2; Match level="QueryCoverage =95%, HitCoverage=22%, E-value=6e-28, Identity=31%"; Hit description =putative ORF2 [Drosophila melanogaster]
  misc_feature (110)..(110): Xaa can be any naturally occurring amino acid
  misc_feature (268)..(268): Xaa can be any naturally occurring amino acid
DAWVDSRLTCKEHINKLKGNAMKRLNIIKALSQYTWGADESILLNIYRALIRSKLDYGSFIYMSASKSDLKLLNSVHNTSIRLCLGAFKSSLVESLCEANEPPLWIRREXLLQSYFSTVSANPSNRVYRLINSKPVSDLPRTIQSIIEIQKSTLRNAIDLTKTLPYPIPTTPPWSRSILDLNTSLLAYNKHETPSILIRQYFEEIIEKNQFQKILYTDASKSEIGTGCAVTTVDKTIKSFLLPDVCSVYTVELYAILEAFKSLEIDRXNQAICTDFLSSLFSLKS

SEQ ID NO: 36706 - protein, 92 aa, Diabrotica virgifera
  misc_feature: Coding regions on vcDNA: vcDNA=SeqID_16403; Strand=-; Position=380-658
  misc_feature (63)..(69): Xaa can be any naturally occurring amino acid
TCTSTIDVAGKTYSGNAANFGYRKNDKPVATKTKLILLRGEQLTFFYLFYKSINQNKINFFIXXXXXXXFFKWFVTFPISIKIQPLLYGMIS

SEQ ID NO: 36707 - protein, 309 aa, Diabrotica virgifera
  misc_feature: Coding regions on vcDNA: vcDNA=SeqID_16404; Strand=+; Position=1-927
  misc_feature (5)..(279): Xaa can be any naturally occurring amino acid
  misc_feature (281)..(293): Xaa can be any naturally occurring amino acid
  misc_feature (301)..(309): Xaa can be any naturally occurring amino acid
IFLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXFSFRFKFXXXXXXXXX

SEQ ID NO: 36708 - protein, 67 aa, Diabrotica virgifera
  misc_feature: Coding regions on vcDNA: vcDNA=SeqID_16405; Strand=-; Position=312-515
  misc_feature (55)..(61): Xaa can be any naturally occurring amino acid
HHTALPLILPKSTYINQRPAPLNSSNSPPPPPINHHAIPHTIRYSPPPLPPHPFXXXXXXXPHHPPY

SEQ ID NO: 36709 - protein, 186 aa, Diabrotica virgifera
  misc_feature: Coding regions on vcDNA: vcDNA=SeqID_16406; Strand=+; Position=82-642
  misc_feature: Homolog annotation: Hit_ID=XP_395589.1; Match level="QueryCoverage =99%, HitCoverage=65%, E-value=1e-93, Identity=89%"; Hit description =similar to ENSANGP00000010118 [Apis mellifera]
  misc_feature: Gene Ontology Annotation: Molecular function=ubiquitin-protein ligase activity; Cellular component=proteasome complex (sensu Eukarya); Biological process=ubiquitin-dependent protein catabolism
  misc_feature: Pfam annotation: Pfam_ID=UQ_con; Match level="Score=244.7, E-value =1.6e-70, Copies=1"; Pfam description=Ubiquitin-conjugating enzyme
  misc_feature (48)..(53): Xaa can be any naturally occurring amino acid
MSSAGSSGSGRGRGGQAAVGEQKESKESKPNPKMSKALGTSAKRIQKXXXXXXLDPPPNCSAGPKGENFYEWVSTILGPPGSVYEGGVFFLDIHFSPEYPFKPPKVTFRTRIYHCNINSQGVICLDILKDNWSPALTISKVLLSICSLLTDCNPADPLVGSIATQYLQNREEHDRIARLWTKRYAT

SEQ ID NO: 36710 - protein, 100 aa, Diabrotica virgifera
  misc_feature: Coding regions on vcDNA: vcDNA=SeqID_16407; Strand=-; Position=0-299
  misc_feature (31)..(41): Xaa can be any naturally occurring amino acid
  misc_feature (77)..(82): Xaa can be any naturally occurring amino acid
DHVSSSLTSTCQYALPFFTQLYFLLVDRLAXXXXXXXXXXXFYHIHPNHLSYVFCHLSHSYLLSCIIGFTHAYKLNXXXXXXHFIPFNRSPKKLTLSQLP

SEQ ID NO: 36711 - protein, 120 aa, Diabrotica virgifera
  misc_feature: Coding regions on vcDNA: vcDNA=SeqID_16408; Strand=-; Position=1-360
  misc_feature (76)..(83): Xaa can be any naturally occurring amino acid
  misc_feature (99)..(99): Xaa can be any naturally occurring amino acid
  misc_feature (102)..(102): Xaa can be any naturally occurring amino acid
  misc_feature (110)..(112): Xaa can be any naturally occurring amino acid
  misc_feature (114)..(116): Xaa can be any naturally occurring amino acid
LPPINLFSFIKHPPPHYFLYHSLSHSTFTPLISSFFPFSISSFFFFILLPPPHTHQFPLFHFSSSSPISLPLSLSXXXXXXXXLLSFHKFLLHSLIQQXHHXFSLRTSSXXXFXXXPPGS

SEQ ID NO: 36712 - protein, 79 aa, Diabrotica virgifera
  misc_feature: Coding regions on vcDNA: vcDNA=SeqID_16409; Strand=+; Position=119-358
ETYVMSSASLRILLWPMVSQKCYIDRRAMCCEELVRETYYRQAGGDENEGCTCLLPAPTSTSDYKLPAILPSYARHSSI

SEQ ID NO: 36713 - protein, 17 aa, Diabrotica virgifera
  misc_feature: Coding regions on vcDNA: vcDNA=SeqID_16410; Strand=-; Position=1-51
  misc_feature (2)..(17): Xaa can be any naturally occurring amino acid
HXXXXXXXXXXXXXXXX

SEQ ID NO: 36714 - protein, 59 aa, Diabrotica virgifera
  misc_feature: Coding regions on vcDNA: vcDNA=SeqID_16411; Strand=+; Position=228-404
SMNLFNLYAISGGFSIWDIKYILKKCDMVGYSGGGSAGNHEYIYSISCYTIFLGFVELL

SEQ ID NO: 36715 - protein, 84 aa, Diabrotica virgifera
  misc_feature: Coding regions on vcDNA: vcDNA=SeqID_16412; Strand=+; Position=1-252
  misc_feature (2)..(54): Xaa can be any naturally occurring amino acid
  misc_feature (60)..(71): Xaa can be any naturally occurring amino acid
MXXXXXXXXXXXXXXXXXXXXXXXXXXXXXXXXXXXXXXXXXXXXXXXXXXXXXLGIRTXXXXXXXXXXXXEAYREGPDKSTDP

SEQ ID NO: 36716 - protein, 165 aa, Diabrotica virgifera
  misc_feature: Coding regions on vcDNA: vcDNA=SeqID_16413; Strand=+; Position=1-498
  misc_feature: Homolog annotation: Hit_ID=XP_397307.1; Match level="QueryCoverage =92%, HitCoverage=71%, E-value=1e-68, Identity=83%"; Hit description =similar to ribosomal protein L10A [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=59.6, E -value=9.1e-15, Copies=1"; Pfam description=Ribosomal protein L1p/L10e family
  misc_feature (27)..(38): Xaa can be any naturally occurring amino acid
  misc_feature (154)..(154): Xaa can be any naturally occurring amino acid
KMQVCILGDQQHCDEANANNVPFMDVXXXXXXXXXXXXVKKLAKKYDAFLASEALIKQIPRLLGPGLNKAGKFPGLLSHQESMTQKIDEVKATIKFQMKKVLCLSVAVGHVGMNQDELVQNVHLSINFLVSLLKKHWQNVRSLHVKSSMGPPQXRLLFTHLNVGI

SEQ ID NO: 36717 - protein, 81 aa, Diabrotica virgifera
  misc_feature: Coding regions on vcDNA: vcDNA=SeqID_16414; Strand=+; Position=610-852
  misc_feature (32)..(45): Xaa can be any naturally occurring amino acid
KEKVSMFLISFLLITQKVFVLSKQLCLTKCTXXXXXXXXXXXXXXFKTNSNRAILYLYVSSSFVNAKYCSFELKKRENCAF

SEQ ID NO: 36718 - protein, 236 aa, Diabrotica virgifera
  misc_feature: Coding regions on vcDNA: vcDNA=SeqID_16415; Strand=-; Position=5-715
  misc_feature (27)..(40): Xaa can be any naturally occurring amino acid
  misc_feature (44)..(193): Xaa can be any naturally occurring amino acid
  misc_feature (197)..(223): Xaa can be any naturally occurring amino acid
  misc_feature (225)..(234): Xaa can be any naturally occurring amino acid
GGGLPRRKCDGHSNFISGRARAVYLIXXXXXXXXXXXXXXRIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTQXXXXXXXXXXXXXXXXXXXXXXXXXXXHXXXXXXXXXXRP

SEQ ID NO: 36719 - protein, 77 aa, Diabrotica virgifera
  misc_feature: Coding regions on vcDNA: vcDNA=SeqID_16416; Strand=+; Position=443-673
  misc_feature (13)..(20): Xaa can be any naturally occurring amino acid
RLNAVYWIFIFCXXXXXXXXIISPLHRLKIIVLDVYGPMLVLLSVSEELILHNPDAFFIDTDHTNDQKIEYECAIAH

SEQ ID NO: 36720 - protein, 74 aa, Diabrotica virgifera
  misc_feature: Coding regions on vcDNA: vcDNA=SeqID_16417; Strand=+; Position=305-529
  misc_feature (67)..(73): Xaa can be any naturally occurring amino acid
FFSNPEKTKVFIHFTCTLSLCLLIHFKPTSRQTTYLEIFRIAQNSITMPYSTVFFMNKLSFILSFKXXXXXXXQ

SEQ ID NO: 36721 - protein, 51 aa, Diabrotica virgifera
  misc_feature: Coding regions on vcDNA: vcDNA=SeqID_16418; Strand=+; Position=1-153
LITFPLTHRPTPPPRINADSFYFSFVYLVRISPFTPPPSTLLSLRLPLSTL

SEQ ID NO: 36722 - protein, 107 aa, Diabrotica virgifera
  misc_feature: Coding regions on vcDNA: vcDNA=SeqID_16419; Strand=-; Position=1-321
  misc_feature (17)..(25): Xaa can be any naturally occurring amino acid
  misc_feature (36)..(49): Xaa can be any naturally occurring amino acid
  misc_feature (51)..(107): Xaa can be any naturally occurring amino acid
GSHRFKLRSGKILKVEXXXXXXXXXNYNFNPTSRSXXXXXXXXXXXXXXVXXXXXXXXXXXXXXXXXXXXXXXXXXXXXXXXXXXXXXXXXXXXXXXXXXXXXXXXX

SEQ ID NO: 36723 - protein, 188 aa, Diabrotica virgifera
  misc_feature: Coding regions on vcDNA: vcDNA=SeqID_16420; Strand=-; Position=245-811
  misc_feature (21)..(27): Xaa can be any naturally occurring amino acid
  misc_feature (44)..(52): Xaa can be any naturally occurring amino acid
  misc_feature (63)..(77): Xaa can be any naturally occurring amino acid
  misc_feature (82)..(129): Xaa can be any naturally occurring amino acid
GGGPISPLEGKILGKGGMGGXXXXXXXLGKGGVFPKALNLGTPXXXXXXXXXNPAPDFNFGAXXXXXXXXXXXXXXXVPFKXXXXXXXXXXXXXXXXXXXXXXXXXXXXXXXXXXXXXXXXXXXXXXXXLFILTIESYTLCNSLLYNKQKGRLVNNTFVLNYYLQDDPNLWSFEVGIKIDKNQTESNK

SEQ ID NO: 36724 - protein, 72 aa, Diabrotica virgifera
  misc_feature: Coding regions on vcDNA: vcDNA=SeqID_16421; Strand=-; Position=27-242
MFFAFSPPPSPPSVLLFSLVSALPFRLSPVSWLSRCFLSKLFSLFSLVCRFMVCGFFLGGPRGKKKKGPLRG

SEQ ID NO: 36725 - protein, 184 aa, Diabrotica virgifera
  misc_feature: Coding regions on vcDNA: vcDNA=SeqID_16422; Strand=+; Position=166-715
  misc_feature: Homolog annotation: Hit_ID=CAB62280.1; Match level="QueryCoverage =88%, HitCoverage=87%, E-value=6e-21, Identity=36%"; Hit description =hydroxyproline-rich glycoprotein DZ-HRGP [Volvox carteri f. nagariensis]
  misc_feature: Gene Ontology Annotation: Molecular function=profilin binding; Cellular component=lamellipodium; Biological process=actin filament organization
  misc_feature (48)..(54): Xaa can be any naturally occurring amino acid
  misc_feature (66)..(66): Xaa can be any naturally occurring amino acid
  misc_feature (86)..(92): Xaa can be any naturally occurring amino acid
  misc_feature (105)..(105): Xaa can be any naturally occurring amino acid
  misc_feature (108)..(123): Xaa can be any naturally occurring amino acid
  misc_feature (171)..(171): Xaa can be any naturally occurring amino acid
TTRTTHLSYSTICYYLFLYTIIPTPRQTKNPPTPPNTINFVMTLPPLXXXXXXXPPKTLPSPPPPXPLSPPPHPPLSPPPPLAPIXXXXXXXPRSPPPYQTFSPXPPXXXXXXXXXXXXXXXXPPPPNLPHPSSTPTLLQYRHLLQSPTSPTPPTPTFPHYCPPRSAPPSXPQPRPPPTPPPPP

SEQ ID NO: 36726 - protein, 17 aa, Diabrotica virgifera
  misc_feature: Coding regions on vcDNA: vcDNA=SeqID_16423; Strand=+; Position=3-53
ILYTNYMTCLHIVFIEF

SEQ ID NO: 36727 - protein, 317 aa, Diabrotica virgifera
  misc_feature: Coding regions on vcDNA: vcDNA=SeqID_16424; Strand=-; Position=0-950
  misc_feature (1)..(307): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVGPREFAGP

SEQ ID NO: 36728 - protein, 69 aa, Diabrotica virgifera
  misc_feature: Coding regions on vcDNA: vcDNA=SeqID_16425; Strand=-; Position=8-217
SGLIGTGPRSGLSNYTDYRNYLKKRPSIHDLYTNERFKIRYFLLYGQVSRSKVNRKHFFMFKHCIVIYL

SEQ ID NO: 36729 - protein, 272 aa, Diabrotica virgifera
  misc_feature: Coding regions on vcDNA: vcDNA=SeqID_16426; Strand=+; Position=3-818
  misc_feature: Homolog annotation: Hit_ID=NP_650344.2; Match level="QueryCoverage =86%, HitCoverage=42%, E-value=5e-20, Identity=30%"; Hit description =CG31326-PA [Drosophila melanogaster] gb|AAN13598.1| CG31326-PA [Drosophila melanogaster]
  misc_feature: Gene Ontology Annotation: Molecular function=serine-type endopeptidase activity; Cellular component=extracellular; Biological process=Tl signaling pathway
  misc_feature (209)..(209): Xaa can be any naturally occurring amino acid
  misc_feature (248)..(249): Xaa can be any naturally occurring amino acid
  misc_feature (251)..(251): Xaa can be any naturally occurring amino acid
  misc_feature (258)..(258): Xaa can be any naturally occurring amino acid
ETRSDQHTLEKNKFNFNPTLPPNQFNFQPKPRPQKPATESSSDVYNENPFFTNGNIYNTGNNGQTPNTGSIVHTTRPTPPPFRPTPAPLRPTQTIPAIATHTEPPRPSEQSIDFPEDIELASKDSVQPVRPMDDVCGQSLTTNHLIFNGKLVPRGAYPWLVAVFQVKTTGVNYICSGSLISTKHIVTGAHCVEIDHRKLRPQEVLLILXKLNIHKWIPVRGEKIVEPESIHIHPDYESLTSDADIAVXXLXRSLKFTXYIRPVCLWMGDTDL

SEQ ID NO: 36730 - protein, 76 aa, Diabrotica virgifera
  misc_feature: Coding regions on vcDNA: vcDNA=SeqID_16427; Strand=-; Position=179-409
  misc_feature (9)..(14): Xaa can be any naturally occurring amino acid
HAVLRSPMXXXXXXASKILFQRCGRGLLATGVLPRRLIDIIPLYRPCFAAVGSPLLFYISILSNSWWNIRNFYWLQ

SEQ ID NO: 36731 - protein, 96 aa, Diabrotica virgifera
  misc_feature: Coding regions on vcDNA: vcDNA=SeqID_16428; Strand=-; Position=8-298
YFALYCKFVGMVIFLFLRRIVPFYRLLWYSAIKTVLSFISKASIAEERTVKLVWVEVPTGRRLWAWRPSYWRGELDCSRQRRIEACFESGKTHEGL

SEQ ID NO: 36732 - protein, 274 aa, Diabrotica virgifera
  misc_feature: Coding regions on vcDNA: vcDNA=SeqID_16429; Strand=-; Position=0-821
  misc_feature (1)..(21): Xaa can be any naturally occurring amino acid
  misc_feature (24)..(272): Xaa can be any naturally occurring amino acid
XXXXXXXXXXXXXXXXXXXXXPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRG

SEQ ID NO: 36733 - protein, 115 aa, Diabrotica virgifera
  misc_feature: Coding regions on vcDNA: vcDNA=SeqID_16430; Strand=+; Position=258-602
  misc_feature: Homolog annotation: Hit_ID=CAG08643.1; Match level="QueryCoverage =94%, HitCoverage=33%, E-value=2e-11, Identity=41%"; Hit description =unnamed protein product [Tetraodon nigroviridis]
NGTALPPSPPRSLTIHYFPILASHLSPPTHFTLLLPPPPFYIFSFLLPLISPTTNTLIAPPPPPLPTPSTNSHPSSPTSLFSIPPSLPSHSPSPLLPSLPPHTFSYPPLPSPLPI

SEQ ID NO: 36734 - protein, 54 aa, Diabrotica virgifera
  misc_feature: Coding regions on vcDNA: vcDNA=SeqID_16431; Strand=-; Position=1-162
  misc_feature (4)..(22): Xaa can be any naturally occurring amino acid
  misc_feature (25)..(43): Xaa can be any naturally occurring amino acid
  misc_feature (46)..(54): Xaa can be any naturally occurring amino acid
KNVXXXXXXXXXXXXXXXXXXXFLXXXXXXXXXXXXXXXXXXXLHXXXXXXXXX

SEQ ID NO: 36735 - protein, 197 aa, Diabrotica virgifera
  misc_feature: Coding regions on vcDNA: vcDNA=SeqID_16432; Strand=+; Position=2-595
  misc_feature: Homolog annotation: Hit_ID=XP_397016.1; Match level="QueryCoverage =98%, HitCoverage=36%, E-value=1e-42, Identity=44%"; Hit description =similar to ENSANGP00000024113 [Apis mellifera]
MFQQLLGFMAVLNYMQSIFEAAKTSINSNTASLILGGVQIISNIFSTLLVDRLGRKVLLLASNVGCTISLAALGAFFFCLENNYNTDSIFWLPILSLIVFFVSFNFGFGTLPLTVCGELFSSNIKAMAASLSTCVCLLLAFLVTLGFPYLSDAVGRPYTFWIFGITSVLSILFVVFIVPETKGKSFKEIQHVLEGRR

SEQ ID NO: 36736 - protein, 66 aa, Diabrotica virgifera; identical to SEQ ID NO: 26808
  misc_feature: Coding regions on vcDNA: vcDNA=SeqID_16433; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36737 - protein, 51 aa, Diabrotica virgifera
  misc_feature: Coding regions on vcDNA: vcDNA=SeqID_16434; Strand=+; Position=170-325
  misc_feature (21)..(29): Xaa can be any naturally occurring amino acid
FKKPLLERKRYSLLTIAKFLXXXXXXXXXKIFIIKYSYIINMKYLSRASLK

SEQ ID NO: 36738 - protein, 75 aa, Diabrotica virgifera
  misc_feature: Coding regions on vcDNA: vcDNA=SeqID_16435; Strand=-; Position=408-635
RNSSKDYYKFLWKWRMFYFSLFLKSSKGFSYFHHNLLNIIVMLSTSTAAHLIGTPKYFEKCLAGIFYKSHRFPPI

SEQ ID NO: 36739 - protein, 57 aa, Diabrotica virgifera; identical to SEQ ID NO: 32497
  misc_feature: Coding regions on vcDNA: vcDNA=SeqID_16436; Strand=-; Position=159-332
  misc_feature (1)..(12): Xaa can be any naturally occurring amino acid
  misc_feature (14)..(38): Xaa can be any naturally occurring amino acid

SEQ ID NO: 36740 - protein, 255 aa, Diabrotica virgifera
  misc_feature: Coding regions on vcDNA: vcDNA=SeqID_16437; Strand=+; Position=97-861
  misc_feature: Homolog annotation: Hit_ID=XP_310403.1; Match level="QueryCoverage =70%, HitCoverage=23%, E-value=6e-55, Identity=58%"; Hit description =ENSANGP00000018876 [Anopheles gambiae]
MTSVQERLQLKREPLDKWSVREQLCLASAVSRSGDQNWMSVSRALKPFGEPNRPSDWFHLKNCAAQYGMLLGNVETPKRKNKKASVDTGGETPPESILKRLSIERQAELKKLLAEEKAEYQKLQEDMVLLQSGKVSEEQLDKWCQEIEDEENQKEQESLTHSRWLKERELRKQEIEKVWRPSKTIMGQKRKSSDRLDNLIEQEHMDELMLQQQPQLNQQQQHHQIYSQPSETMKPCLSPLLTSLLKSPSQVPKTS

SEQ ID NO: 36741 - protein, 127 aa, Diabrotica virgifera
  misc_feature: Coding regions on vcDNA: vcDNA=SeqID_16438; Strand=-; Position=219-602
  misc_feature (14)..(25): Xaa can be any naturally occurring amino acid
ILTFKYFYSLDLQXXXXXXXXXXXXNFIKICSTKNHLCLSHGDTIYFLGYESYPRCLFLSDPLTFCNIHSRYTTLNHGLIAQVLDSRFKRLLKSNALPHLEPTQWKILSKSSVPDMTVNSCWLSSLL

SEQ ID NO: 36742 - protein, 32 aa, Diabrotica virgifera
  misc_feature: Coding regions on vcDNA: vcDNA=SeqID_16439; Strand=-; Position=1-96
  misc_feature (16)..(32): Xaa can be any naturally occurring amino acid
NPKRHAFNQQVKNMLXXXXXXXXXXXXXXXXX

SEQ ID NO: 36743 - protein, 23 aa, Diabrotica virgifera
  misc_feature: Coding regions on vcDNA: vcDNA=SeqID_16440; Strand=-; Position=1-69
  misc_feature (3)..(23): Xaa can be any naturally occurring amino acid
EVXXXXXXXXXXXXXXXXXXXXX

SEQ ID NO: 36744 - protein, 258 aa, Diabrotica virgifera
  misc_feature: Coding regions on vcDNA: vcDNA=SeqID_16441; Strand=+; Position=1-774
  misc_feature (3)..(227): Xaa can be any naturally occurring amino acid
  misc_feature (232)..(233): Xaa can be any naturally occurring amino acid
  misc_feature (235)..(254): Xaa can be any naturally occurring amino acid
YLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKSLXXFXXXXXXXXXXXXXXXXXXXXIYYI

SEQ ID NO: 36745 - protein, 53 aa, Diabrotica virgifera
  misc_feature: Coding regions on vcDNA: vcDNA=SeqID_16442; Strand=+; Position=1-162
  misc_feature (23)..(23): Xaa can be any naturally occurring amino acid
  misc_feature (27)..(27): Xaa can be any naturally occurring amino acid
  misc_feature (41)..(41): Xaa can be any naturally occurring amino acid
NDLKHGALAAVYTKDVFIVINSXKQAXTEQAYIRDDRVTNXCDIKLMNSYPKL

SEQ ID NO: 36746 - protein, 85 aa, Diabrotica virgifera
  misc_feature: Coding regions on vcDNA: vcDNA=SeqID_16443; Strand=-; Position=6-263
  misc_feature (33)..(41): Xaa can be any naturally occurring amino acid
FDYHQNFYQCSRNILFSYSMFCCIFSILNHFNXXXXXXXXXKNVKSLIRLVSRSSHIMTHCLRGEAFKANEPQYTNRADSWFESQ

SEQ ID NO: 36747 - protein, 317 aa, Diabrotica virgifera
  misc_feature: Coding regions on vcDNA: vcDNA=SeqID_16444; Strand=+; Position=3-953
  misc_feature: Homolog annotation: Hit_ID=EAA11747.2; Match level="QueryCoverage =99%, HitCoverage=42%, E-value=5e-71, Identity=46%"; Hit description =ENSANGP00000017704 [Anopheles gambiae str. PEST] ref|XP_556231.1| ENSANGP00000017704 [Anopheles gambiae st
  misc_feature: Gene Ontology Annotation: Molecular function=molecular_function unknown; Cellular component=integral to membrane; Biological process= biological_process unknown
  misc_feature (300)..(300): Xaa can be any naturally occurring amino acid
  misc_feature (309)..(309): Xaa can be any naturally occurring amino acid
SILVQALDRFYKRIESNTLCKDIDFANVAAEIVINAARKQCKSHLQILKMHFADSLTKIRQALTTPKLITQEESSKNLNELLNSLVITIVEKVKGVLQDLVIFLQPNINFAYKPQFKDSFCIDNVREGLIVCFLHHLTATARSFCTKVASDPKIPPTLLLLLSKFCVDFQNGHVHFILSQTDELFNINAQENLAVSNEIEITNAMQESAQELLNFFVRIQGLNCSQMLRKSVETRDWLNTIEPRTVRAVMKRVVEDISAIDSTVTQLYDDHGNNGTEHSSDSSRKAHSISLPKHQYRSNXSNYTSNPLXSALVSNMH

SEQ ID NO: 36748 - protein, 100 aa, Diabrotica virgifera
  misc_feature: Coding regions on vcDNA: vcDNA=SeqID_16445; Strand=+; Position=2-301
  misc_feature (6)..(11): Xaa can be any naturally occurring amino acid
  misc_feature (14)..(21): Xaa can be any naturally occurring amino acid
  misc_feature (31)..(58): Xaa can be any naturally occurring amino acid
  misc_feature (84)..(94): Xaa can be any naturally occurring amino acid
FLSGIXXXXXXRKXXXXXXXXLEFIVIALYXXXXXXXXXXXXXXXXXXXXXXXXXXXXSLGLAILIIIVRVYGNDYILTFFFMXXXXXXXXXXXHSCLIH

SEQ ID NO: 36749 - protein, 80 aa, Diabrotica virgifera
  misc_feature: Coding regions on vcDNA: vcDNA=SeqID_16446; Strand=-; Position=2-241
  misc_feature (5)..(14): Xaa can be any naturally occurring amino acid
  misc_feature (17)..(27): Xaa can be any naturally occurring amino acid
  misc_feature (37)..(44): Xaa can be any naturally occurring amino acid
  misc_feature (47)..(60): Xaa can be any naturally occurring amino acid
  misc_feature (66)..(79): Xaa can be any naturally occurring amino acid
PIIIXXXXXXXXXXPFXXXXXXXXXXXTNLAHTGLNXXXXXXXXSNXXXXXXXXXXXXXXPTSRSXXXXXXXXXXXXXXV

SEQ ID NO: 36750 - protein, 268 aa, Diabrotica virgifera
  misc_feature: Coding regions on vcDNA: vcDNA=SeqID_16447; Strand=-; Position=1-804
  misc_feature (3)..(205): Xaa can be any naturally occurring amino acid
  misc_feature (208)..(246): Xaa can be any naturally occurring amino acid
  misc_feature (248)..(268): Xaa can be any naturally occurring amino acid
NNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXXXXXXXX

SEQ ID NO: 36751 - protein, 125 aa, Diabrotica virgifera
  misc_feature: Coding regions on vcDNA: vcDNA=SeqID_16448; Strand=-; Position=20-397
  misc_feature (9)..(17): Xaa can be any naturally occurring amino acid
  misc_feature (70)..(79): Xaa can be any naturally occurring amino acid
  misc_feature (91)..(96): Xaa can be any naturally occurring amino acid
FNGHTLIKXXXXXXXXXRESRLDTEPELKCSLEAIDTQHTNTTVRRAAVVASSENSATALYQSTFARVNXXXXXXXXXXHIYTHIYTHIHXXXXXXAQQALKAHGLEFLHGFSPFSPVHGRSCPI

SEQ ID NO: 36752 - protein, 41 aa, Diabrotica virgifera
  misc_feature: Coding regions on vcDNA: vcDNA=SeqID_16449; Strand=-; Position=120-245
KSCFGHPVWITVLMFISLNGEFNNLSIIDYVITLRWMTSLV

SEQ ID NO: 36753 - protein, 69 aa, Diabrotica virgifera
  misc_feature: Coding regions on vcDNA: vcDNA=SeqID_16450; Strand=-; Position=193-402
NFTLISCLMLIVKSNNYMLVSRTMIVLFYYLFISSSLALYSKLFLSIALSTVIIIGTIVGSEQLEYSKN

SEQ ID NO: 36754 - protein, 118 aa, Diabrotica virgifera
  misc_feature: Coding regions on vcDNA: vcDNA=SeqID_16451; Strand=+; Position=127-483
  misc_feature (25)..(32): Xaa can be any naturally occurring amino acid
  misc_feature (105)..(118): Xaa can be any naturally occurring amino acid
ILTLLSIIYLDLSLRSVGATGHKSXXXXXXXXKVSSIGNERVALKRKFASFFGKKSRKGIALFGTFNEVNRYRLTIYFNCMCIVYVICKFDIFEVLRFEKNWFYXXXXXXXXXXXXXX

SEQ ID NO: 36755 - protein, 87 aa, Diabrotica virgifera
  misc_feature: Coding regions on vcDNA: vcDNA=SeqID_16452; Strand=-; Position=597-860
  misc_feature (28)..(28): Xaa can be any naturally occurring amino acid
RKRRREWNDHISRLTTNSVVRTSGDSSXIGRPRKLWNDNLLEAHRKTDRVMSIQKEEEDTLEQISSESKFHRNFDFSIHLSKIYIKR

SEQ ID NO: 36756 - protein, 235 aa, Diabrotica virgifera
  misc_feature: Coding regions on vcDNA: vcDNA=SeqID_16453; Strand=+; Position=2-709
  misc_feature (2)..(208): Xaa can be any naturally occurring amino acid
  misc_feature (215)..(225): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKYIGLIXXXXXXXXXXXIKRHVCLYQV

SEQ ID NO: 36757 - protein, 33 aa, Diabrotica virgifera
  misc_feature: Coding regions on vcDNA: vcDNA=SeqID_16454; Strand=+; Position=1-99
  misc_feature (1)..(16): Xaa can be any naturally occurring amino acid
  misc_feature (25)..(32): Xaa can be any naturally occurring amino acid
XXXXXXXXXXXXXXXXRHIFFTWLXXXXXXXXI

SEQ ID NO: 36758 - protein, 60 aa, Diabrotica virgifera
  misc_feature: Coding regions on vcDNA: vcDNA=SeqID_16455; Strand=+; Position=199-381
  misc_feature (20)..(27): Xaa can be any naturally occurring amino acid
TCESLLRICHGSPHSSENVXXXXXXXXCFEVHLLTFFHDSIYYIADLHRYFNKNIYYDVS

SEQ ID NO: 36759 - protein, 55 aa, Diabrotica virgifera
  misc_feature: Coding regions on vcDNA: vcDNA=SeqID_16456; Strand=-; Position=1-165
  misc_feature (4)..(19): Xaa can be any naturally occurring amino acid
  misc_feature (21)..(28): Xaa can be any naturally occurring amino acid
  misc_feature (32)..(43): Xaa can be any naturally occurring amino acid
  misc_feature (45)..(55): Xaa can be any naturally occurring amino acid
ISSXXXXXXXXXXXXXXXXAXXXXXXXXRRDXXXXXXXXXXXXQXXXXXXXXXXX

SEQ ID NO: 36760 - protein, 66 aa, Diabrotica virgifera; identical to SEQ ID NO: 26808
  misc_feature: Coding regions on vcDNA: vcDNA=SeqID_16457; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36761 - protein, 23 aa, Diabrotica virgifera
  misc_feature: Coding regions on vcDNA: vcDNA=SeqID_16458; Strand=-; Position=1-69
  misc_feature (11)..(23): Xaa can be any naturally occurring amino acid
SLINIVINISXXXXXXXXXXXXX

SEQ ID NO: 36762 - protein, 60 aa, Diabrotica virgifera
  misc_feature: Coding regions on vcDNA: vcDNA=SeqID_16459; Strand=-; Position=1-180
  misc_feature (21)..(27): Xaa can be any naturally occurring amino acid
THSDCQLSTVTHRYYRRSFLXXXXXXXSQFLLTILSLTFSFLSPKKGFCFSVSMCGGPNG

SEQ ID NO: 36763 - protein, 148 aa, Diabrotica virgifera
  misc_feature: Coding regions on vcDNA: vcDNA=SeqID_16460; Strand=+; Position=1-444
  misc_feature (3)..(10): Xaa can be any naturally occurring amino acid
  misc_feature (17)..(135): Xaa can be any naturally occurring amino acid
  misc_feature (137)..(145): Xaa can be any naturally occurring amino acid
ASXXXXXXXXLYYHHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXVYR

SEQ ID NO: 36764 - protein, 195 aa, Diabrotica virgifera
  misc_feature: Coding regions on vcDNA: vcDNA=SeqID_16461; Strand=+; Position=3-587
  misc_feature: Homolog annotation: Hit_ID=NP_610846.1; Match level="QueryCoverage =59%, HitCoverage=63%, E-value=6e-20, Identity=40%"; Hit description =CG4627-PA [Drosophila melanogaster] gb|AAF58408.1| CG4627-PA [Drosophila melanogaster]
LQTFKPTISKEISTACLISSNISNNRLINQNVRLFSSDQNNTQSSKSNFNTVYRLPFIKYFSVINRVKFYQTVLTGITIPTSFALNLMNLISTETFQVISIIGITGCISLYGAGHVTSKFIGFIYYDEERDVAKIAYVDFWGWRKDVEMPVSDIVPSEDIPFSVTNKLYMKFKRYSTPEVLKYNLRLGIIYDGEQ

SEQ ID NO: 36765 - protein, 66 aa, Diabrotica virgifera; identical to SEQ ID NO: 26808
  misc_feature: Coding regions on vcDNA: vcDNA=SeqID_16462; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36766 - protein, 47 aa, Diabrotica virgifera
  misc_feature: Coding regions on vcDNA: vcDNA=SeqID_16463; Strand=-; Position=1-141
  misc_feature (9)..(46): Xaa can be any naturally occurring amino acid
NLFLYPKKXXXXXXXXXXXXXXXXXXXXXXXXXXXXXXXXXXXXXXL

SEQ ID NO: 36767 - protein, 17 aa, Diabrotica virgifera
  misc_feature: Coding regions on vcDNA: vcDNA=SeqID_16464; Strand=-; Position=1-51
  misc_feature (1)..(12): Xaa can be any naturally occurring amino acid
XXXXXXXXXXXXIGVFS

SEQ ID NO: 36768 - protein, 145 aa, Diabrotica virgifera
  misc_feature: Coding regions on vcDNA: vcDNA=SeqID_16465; Strand=+; Position=495-929
  misc_feature (79)..(79): Xaa can be any naturally occurring amino acid
SISKPFLRCLKNTFHASISYTNRLHSCLFLDLRFASVQVVFFFRILTTSSFQVFFGLPFSPLFCTDASHTRFTCLLSLXLHKTQKDLSLFLSSICVFGSTCSSSLYMLFLILSRLVIPFTFHEYLMSIEFILFFDDLCSTQLSLP

SEQ ID NO: 36769 - protein, 78 aa, Diabrotica virgifera
  misc_feature: Coding regions on vcDNA: vcDNA=SeqID_16466; Strand=-; Position=168-404
  misc_feature (19)..(27): Xaa can be any naturally occurring amino acid
IYTMFLIYFGKRIGTNINXXXXXXXXXTRYLYLSPSIILSKLLCINRNFMSTKKSMLNFLTKLSEDISLLLQKVKKLN

SEQ ID NO: 36770 - protein, 174 aa, Diabrotica virgifera
  misc_feature: Coding regions on vcDNA: vcDNA=SeqID_16467; Strand=-; Position=287-811
  misc_feature: Homolog annotation: Hit_ID=CAA10770.1; Match level="QueryCoverage =82%, HitCoverage=42%, E-value=1e-21, Identity=34%"; Hit description =reverse transcriptase-like [Bos taurus]
  misc_feature (79)..(85): Xaa can be any naturally occurring amino acid
TPKIKTRIEIARASFVKLKKFLCCRDIRLELRLRMLRCYVFSTLLYGLEAWTLKQVHLNKLAAFEFWCYRRILRISWIXXXXXXXVTRRIGNQPEIILTIKRRKLEYLGHVMRGQKYSLLQLIMQGKIRGKRNVGRRRTSWLKNLREWFECSSAEIFRAAVNRVRIAMMISNLR

SEQ ID NO: 36771 - protein, 76 aa, Diabrotica virgifera
  misc_feature: Coding regions on vcDNA: vcDNA=SeqID_16468; Strand=+; Position=629-856
  misc_feature (19)..(25): Xaa can be any naturally occurring amino acid
  misc_feature (38)..(38): Xaa can be any naturally occurring amino acid
  misc_feature (57)..(62): Xaa can be any naturally occurring amino acid
  misc_feature (71)..(71): Xaa can be any naturally occurring amino acid
  misc_feature (75)..(75): Xaa can be any naturally occurring amino acid
KSEVYRMTPQDTYSKKLIXXXXXXXHNITENDEVEESXAKNKSNILIFSQESIGKRXXXXXXRSQGKNSMXFTEXR

SEQ ID NO: 36772 - protein, 72 aa, Diabrotica virgifera
  misc_feature: Coding regions on vcDNA: vcDNA=SeqID_16469; Strand=+; Position=209-427
  misc_feature (8)..(19): Xaa can be any naturally occurring amino acid
SGINNGNXXXXXXXXXXXXAASKLSKLISLAFIATSIFSFLLNYYYSDAANSPETTHRILQHCLHKWLRITL

SEQ ID NO: 36773 - protein, 89 aa, Diabrotica virgifera
  misc_feature: Coding regions on vcDNA: vcDNA=SeqID_16470; Strand=+; Position=52-321
  misc_feature: Homolog annotation: Hit_ID=NP_725375.1; Match level="QueryCoverage =98%, HitCoverage=22%, E-value=5e-33, Identity=79%"; Hit description =CG8553-PB, isoform B [Drosophila melanogaster] ref|NP_725374.1| CG8553-PA, isoform A [Drosophila
  misc_feature: Gene Ontology Annotation: Molecular function=ATP binding; Cellular component=cellular_component unknown; Biological process=protein modification
  misc_feature (63)..(68): Xaa can be any naturally occurring amino acid
VVTPLRHGGLCLVQTTDFFYPFVDDPYMMGKIACANVLSDLYAMGVTECDNMLMLLGVRTKMXXXXXXVDIPLILIGFKDSVHEADITV

SEQ ID NO: 36774 - protein, 78 aa, Diabrotica virgifera
  misc_feature: Coding regions on vcDNA: vcDNA=SeqID_16471; Strand=+; Position=590-826
PSTYRTSFSTDSTYIVLPPECSGDGTVWNCYLRPVIHYFATVPCFFLKLLQVLWSQRRPTVFLLIVLGSLLVQISVDK

SEQ ID NO: 36775 - protein, 103 aa, Diabrotica virgifera
  misc_feature: Coding regions on vcDNA: vcDNA=SeqID_16472; Strand=+; Position=266-577
  misc_feature (18)..(30): Xaa can be any naturally occurring amino acid
ISARVYYSPTLLSVLSSXXXXXXXXXXXXXFHLFLRATNSTFSPSGLSQNVAFRSLSLLDLSTWPVHIIRFAVAYYVFISIYGLEFIIVSSSSFSCLFASLPF

SEQ ID NO: 36776 - protein, 23 aa, Diabrotica virgifera
  misc_feature: Coding regions on vcDNA: vcDNA=SeqID_16473; Strand=-; Position=1-69
  misc_feature (1)..(23): Xaa can be any naturally occurring amino acid
XXXXXXXXXXXXXXXXXXXXXXX

SEQ ID NO: 36777 - protein, 268 aa, Diabrotica virgifera
  misc_feature: Coding regions on vcDNA: vcDNA=SeqID_16474; Strand=-; Position=1-804
  misc_feature (21)..(245): Xaa can be any naturally occurring amino acid
  misc_feature (248)..(268): Xaa can be any naturally occurring amino acid
KTIIIYKLYRSLVFKKIKLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXX

SEQ ID NO: 36778 - protein, 58 aa, Diabrotica virgifera
  misc_feature: Coding regions on vcDNA: vcDNA=SeqID_16475; Strand=-; Position=1-174
ICLEGVIDQGASVKILVHLDVERLLKFLCRNCPKTTQTTIFESSSPSKRSGTLFKQSK

SEQ ID NO: 36779 - protein, 124 aa, Diabrotica virgifera
  misc_feature: Coding regions on vcDNA: vcDNA=SeqID_16476; Strand=-; Position=26-400
  misc_feature (63)..(70): Xaa can be any naturally occurring amino acid
  misc_feature (109)..(115): Xaa can be any naturally occurring amino acid
ASLSSFGSHRPSSVRLWAPSPSALHDCVSCVVHRFGSFIAFLIMLSPSTDCVLILNSCLFPGXXXXXXXXTLSHFALWGHLVRLLVPVRLSRPFPRVLRPFLFYSLLKXXXXXXXLSEVVVQLR

SEQ ID NO: 36780 - protein, 277 aa, Diabrotica virgifera
  misc_feature: Coding regions on vcDNA: vcDNA=SeqID_16477; Strand=+; Position=76-906
  misc_feature: Homolog annotation: Hit_ID=EAA05292.3; Match level="QueryCoverage =100%, HitCoverage=42%, E-value=6e-62, Identity=47%"; Hit description= ENSANGP00000011209 [Anopheles gambiae str. PEST] ref|XP_564277.1| ENSANGP00000011209 [Anopheles gambiae s
MPLTDIIRRASTYILGPEEDTLKTPEYEDNEILFCKNICVHPPATARHDNDLHNPGYLTITTKVFIDQYNDTRRPTLFLTWIPNSSITKNTNLIGTPLKHYNKRYSLESLTSNDSNDFGIERHPVVEFKSTNPFLNYDDRDRLDMSDLSSEGSDKQGISINVDISNPEIEIIQTPDSVKDPGDYFEFSRSASVTSSDSQSNWLSTPEYLMQQHNLYFPDSASNSPILQPKQIHKCRRFSVDLSQMRSLRLFFSDNSCTCGQLVVASRESQYKILHFH

SEQ ID NO: 36781 - protein, 127 aa, Diabrotica virgifera
  misc_feature: Coding regions on vcDNA: vcDNA=SeqID_16478; Strand=+; Position=482-862
  misc_feature: Pfam annotation: Pfam_ID=Chitin_bind_4; Match level="Score=-2.5, E -value=0.024, Copies=1"; Pfam description=Insect cuticle protein
PKSLINSRSFRHNRLFRFEERDKEGVVKGHYGFYDKEGKLQVVHYDAHPHTGFQTQLPMELELPKEEANPVPFYAPEPSTDLRAPTESQEPDYYQVPIPYYELAAPIDTEWNPNNDPYYYYEVPAII

SEQ ID NO: 36782 - protein, 66 aa, Diabrotica virgifera; identical to SEQ ID NO: 26808
  misc_feature: Coding regions on vcDNA: vcDNA=SeqID_16479; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36783 - protein, 192 aa, Diabrotica virgifera
  misc_feature: Coding regions on vcDNA: vcDNA=SeqID_16480; Strand=-; Position=176-754
  misc_feature (5)..(16): Xaa can be any naturally occurring amino acid
  misc_feature (25)..(58): Xaa can be any naturally occurring amino acid
  misc_feature (62)..(163): Xaa can be any naturally occurring amino acid
  misc_feature (166)..(172): Xaa can be any naturally occurring amino acid
  misc_feature (174)..(185): Xaa can be any naturally occurring amino acid
QALHXXXXXXXXXXXXLSSIKLSYXXXXXXXXXXXXXXXXXXXXXXXXXXXXXXXXXXSYIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFKXXXXXXXDXXXXXXXXXXXXGFLAIVT

SEQ ID NO: 36784 - protein, 106 aa, Diabrotica virgifera
  misc_feature: Coding regions on vcDNA: vcDNA=SeqID_16481; Strand=-; Position=30-350
  misc_feature (81)..(87): Xaa can be any naturally occurring amino acid
MIWAQNEILYRLALTEGEKEHEWFGKYIYASLSHSPRPPLVFTATMEQSVTCLSMTKILASLCFNVLYYIEYILVEPLYNXXXXXXXGLIHNRSSFCINSDRVLII

SEQ ID NO: 36785 - protein, 186 aa, Diabrotica virgifera
  misc_feature: Coding regions on vcDNA: vcDNA=SeqID_16482; Strand=+; Position=1-560
  misc_feature: Homolog annotation: Hit_ID=XP_486434.1; Match level="QueryCoverage =97%, HitCoverage=90%, E-value=5e-53, Identity=49%"; Hit description =similar to hypothetical protein FLJ14345 [Mus musculus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=172.3, E-value =1e-48, Copies=6"; Pfam description=Zinc finger, C2H2 type
  misc_feature (150)..(150): Xaa can be any naturally occurring amino acid
  misc_feature (170)..(170): Xaa can be any naturally occurring amino acid
AETLKNHTGEKSDKCEICIKQFSQKGSLKRHLRLHTGEKPYKCEICFKQFNLEGNLKKHMRIHTGEMPYKCQICSKQFRESNNLKRHLRIHTGDKPYTCDICCKQFSQEGNLKNHLRIHTGEKSHKCEICFKQFNQEGHLKKHMRIHTRXMPYMCENCCKQFSQNGLLKXHLRMHIEEKSKLNQRI

SEQ ID NO: 36786 - protein, 261 aa, Diabrotica virgifera
  misc_feature: Coding regions on vcDNA: vcDNA=SeqID_16483; Strand=-; Position=81-866
  misc_feature (1)..(137): Xaa can be any naturally occurring amino acid
  misc_feature (141)..(200): Xaa can be any naturally occurring amino acid
  misc_feature (204)..(241): Xaa can be any naturally occurring amino acid
  misc_feature (244)..(253): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILKXXXXXXXXXXXXXXXXXXXXXXXXXXXXXXXXXXXXXXXXXXXXXXXXXXXXXXXXXXXXTISXXXXXXXXXXXXXXXXXXXXXXXXXXXXXXXXXXXXXXEVXXXXXXXXXXKIFSHDTN

SEQ ID NO: 36787 - protein, 77 aa, Diabrotica virgifera
  misc_feature: Coding regions on vcDNA: vcDNA=SeqID_16484; Strand=-; Position=0-230
  misc_feature (63)..(69): Xaa can be any naturally occurring amino acid
IINYLYNHYLNFFIPPIHSFFQFFLTFPIIIHILSHQKTFTPTSTFIILQLTSIYISSIYIWXXXXXXXNHHITTNS

SEQ ID NO: 36788 - protein, 62 aa, Diabrotica virgifera
  misc_feature: Coding regions on vcDNA: vcDNA=SeqID_16485; Strand=+; Position=50-235
CESLELPDYAGLCWIAVARCEGSFLYNTGETSCLIHSDIQLMIAEQIDKEICCDDSLWPLFT

SEQ ID NO: 36789 - protein, 187 aa, Diabrotica virgifera
  misc_feature: Coding regions on vcDNA: vcDNA=SeqID_16486; Strand=+; Position=3-566
  misc_feature: Homolog annotation: Hit_ID=BAC82199.1; Match level="QueryCoverage =97%, HitCoverage=90%, E-value=1e-52, Identity=42%"; Hit description =acaloleptin A precursor [Acalolepta luxuriosa]
  misc_feature: Pfam annotation: Pfam_ID=Coleoptericin; Match level="Score=-1.9, E -value=0.022, Copies=1"; Pfam description=Coleoptericin
SCGKVVHGPNRAKPLWHVGGSFRFPRSPKPEWEVNPGANGDGNGNTNAGIEVRNNGKDHDFQAGWSKVVHGPNRAKPTWHVGGSFRFPRSPKPEWEVNPGANGDGNGNTNAGIEVRNNGKDHDFQAGWSKVVHGPNRAKPTWHVGGSFRFPRSPKPEWEVNPGANGDGNGNPNAGVAVRNNGKDHDA

SEQ ID NO: 36790 - protein, 87 aa, Diabrotica virgifera
  misc_feature: Coding regions on vcDNA: vcDNA=SeqID_16487; Strand=-; Position=1-261
  misc_feature (68)..(68): Xaa can be any naturally occurring amino acid
PLAVPSFVSFRFLVLWGRCLRGLVVVVLRWVPPSLRLACLLRVLFRWRGSGAGWCCLALLVLVVPAGXAVSFLRGCSLGFAVLWPLK

SEQ ID NO: 36791 - protein, 262 aa, Diabrotica virgifera
  misc_feature: Coding regions on vcDNA: vcDNA=SeqID_16488; Strand=-; Position=0-785
  misc_feature (18)..(26): Xaa can be any naturally occurring amino acid
  misc_feature (36)..(44): Xaa can be any naturally occurring amino acid
  misc_feature (55)..(61): Xaa can be any naturally occurring amino acid
  misc_feature (65)..(144): Xaa can be any naturally occurring amino acid
  misc_feature (146)..(161): Xaa can be any naturally occurring amino acid
  misc_feature (164)..(197): Xaa can be any naturally occurring amino acid
  misc_feature (202)..(223): Xaa can be any naturally occurring amino acid
  misc_feature (225)..(235): Xaa can be any naturally occurring amino acid
  misc_feature (242)..(257): Xaa can be any naturally occurring amino acid
RGGCRVVKKSWGFWPKNXXXXXXXXXPFFFPPTLPXXXXXXXXXFCSLSTVKNPXXXXXXXGAGXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXPPXXXXXXXXXXXXXXXXXXXXXXXXXXXXXXXXXXGLPFXXXXXXXXXXXXXXXXXXXXXXFXXXXXXXXXXXFPVPQGXXXXXXXXXXXXXXXXLNYFP

SEQ ID NO: 36792 - protein, 45 aa, Diabrotica virgifera
  misc_feature: Coding regions on vcDNA: vcDNA=SeqID_16489; Strand=+; Position=15-152
RNFVKMESVISDFLTSTAFVFSLLIGASGLLILYYIKTFKQEAVI

SEQ ID NO: 36793 - protein, 82 aa, Diabrotica virgifera
  misc_feature: Coding regions on vcDNA: vcDNA=SeqID_16490; Strand=+; Position=1-246
GVLIATALNRGSPSQITADLKVTERNYEKLLKKMQDCVQAESGECLFDPYELNEPLQRAGPLMYAADVYPELKPSLTHGFEE

SEQ ID NO: 36794 - protein, 304 aa, Diabrotica virgifera
  misc_feature: Coding regions on vcDNA: vcDNA=SeqID_16491; Strand=-; Position=2-913
  misc_feature (9)..(21): Xaa can be any naturally occurring amino acid
  misc_feature (36)..(42): Xaa can be any naturally occurring amino acid
  misc_feature (63)..(70): Xaa can be any naturally occurring amino acid
  misc_feature (72)..(298): Xaa can be any naturally occurring amino acid
KKIVKAFLXXXXXXXXXXXXXGRFFFFNPRPSVANXXXXXXXGLFLPWPGSKSPRPFQINQGXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRASAQK

SEQ ID NO: 36795 - protein, 97 aa, Diabrotica virgifera
  misc_feature: Coding regions on vcDNA: vcDNA=SeqID_16492; Strand=-; Position=1-291
  misc_feature (53)..(53): Xaa can be any naturally occurring amino acid
  misc_feature (55)..(56): Xaa can be any naturally occurring amino acid
  misc_feature (81)..(81): Xaa can be any naturally occurring amino acid
  misc_feature (84)..(84): Xaa can be any naturally occurring amino acid
  misc_feature (87)..(87): Xaa can be any naturally occurring amino acid
  misc_feature (90)..(90): Xaa can be any naturally occurring amino acid
  misc_feature (95)..(95): Xaa can be any naturally occurring amino acid
IPESLVCGYYRFSTQNNVRCSFRAAPCPCWFARFVCRFFRSAGLFRRLFCFLXSXXCRLPFFLWLVCVPLRFLPLVRCPAXSCXCFXPSXGLAVXLP

SEQ ID NO: 36796 - protein, 85 aa, Diabrotica virgifera
  misc_feature: Coding regions on vcDNA: vcDNA=SeqID_16493; Strand=-; Position=124-381
SSQLTLIPSFPSFLSPSPSPTHDAAATHYPPRSLEHLSLSIPSPLQTIHTPIIHSNTLADLHNHNVPCPRNLLPILTYRQFLIQY

SEQ ID NO: 36797 - protein, 203 aa, Diabrotica virgifera
  misc_feature: Coding regions on vcDNA: vcDNA=SeqID_16494; Strand=+; Position=2-613
  misc_feature: Homolog annotation: Hit_ID=XP_536583.1; Match level="QueryCoverage =97%, HitCoverage=20%, E-value=2e-59, Identity=56%"; Hit description =PREDICTED: similar to DEAD (Asp-Glu-Ala-Asp) box polypeptide 10 [Canis familiaris]
  misc_feature: Gene Ontology Annotation: Molecular function=ATP dependent RNA helicase activity; Cellular component=nucleolus; Biological process =nucleobase, nucleoside, nucleotide and nucleic acid metabolism
  misc_feature: Pfam annotation: Pfam_ID=Helicase_C; Match level="Score=88.8, E-value= 1.5e-23, Copies=1"; Pfam description=Helicase conserved C-terminal domain
  misc_feature (19)..(31): Xaa can be any naturally occurring amino acid
LCAVHENSEYSTPKALSQXXXXXXXXXXXXXLWSFLKNHPNKKIMVFFSSCKQVKYFFEIFSKLRPGTSLMSLYGTLHQLRRMEIYESFCRKQSAILFCTDLAARGLDFPEVHWVVQVDCPEDPETYIHRVGRTARYHRGGESFLMLLPSEVKMVDKLKEKKIPVEKIEINPMKLNNPGKKMEAFLAKDPSLKDSAQRAFRFI

SEQ ID NO: 36798 - protein, 161 aa, Diabrotica virgifera
  misc_feature: Coding regions on vcDNA: vcDNA=SeqID_16495; Strand=+; Position=3-488
  misc_feature (11)..(11): Xaa can be any naturally occurring amino acid
FVRKTTITKTXSSSPFEETNKNIVDNESGKDGSKVIHKTITTHLGEQNNGESQQSLLSGHANEELGYGSSSTKTTIIKTSSSSSDVPSTLIHGTDNQHLFESGSGSRVIQTTVTKTSSSGSDHVGDRGQYILNGHEKNGIGYGNGSKVIETTVTKPPWREQ

SEQ ID NO: 36799 - protein, 31 aa, Diabrotica virgifera
  misc_feature: Coding regions on vcDNA: vcDNA=SeqID_16496; Strand=-; Position=1-93
LRASVVGSSGSFIPYEGVTSFSSKSSVLRLM

SEQ ID NO: 36800 - protein, 40 aa, Diabrotica virgifera
  misc_feature: Coding regions on vcDNA: vcDNA=SeqID_16497; Strand=-; Position=3-122
RGDGTRALKWWLNKRRIVPKATARSGRPFFYLPCLFELYK

SEQ ID NO: 36801 - protein, 124 aa, Diabrotica virgifera
  misc_feature: Coding regions on vcDNA: vcDNA=SeqID_16498; Strand=+; Position=2-376
LVRKHLLIFIVCLISTQLITCLPTSSNDGQHDIIEGNCANPDPEKIVYRDHVEKMAIPFIVRDNTNEWRGDANIFCVMVISEQDESKGSTARITEGGVDHHFITIELESGRGNALDYNIKIYAE

SEQ ID NO: 36802 - protein, 126 aa, Diabrotica virgifera
  misc_feature: Coding regions on vcDNA: vcDNA=SeqID_16499; Strand=+; Position=17-394
  misc_feature: Homolog annotation: Hit_ID=XP_313821.1; Match level="QueryCoverage =49%, HitCoverage=18%, E-value=2e-10, Identity=50%"; Hit description =ENSANGP00000003971 [Anopheles gambiae]
  misc_feature (30)..(32): Xaa can be any naturally occurring amino acid
  misc_feature (42)..(42): Xaa can be any naturally occurring amino acid
FKRLTGGGQGAFLKQHPSGQKTPKNTEAAXXXPAPAQPTRDXDEERRKKSEFLSSKQLISTQNVAPPYGQRRGWVPRSVTDFGDGCAFTHHPVASPLIHIPHHKPFFFIAPPFFFSDAPLEIINFF

SEQ ID NO: 36803 - protein, 44 aa, Diabrotica virgifera
  misc_feature: Coding regions on vcDNA: vcDNA=SeqID_16500; Strand=-; Position=70-204
KYSIMRIPRYAGLARIIDYTPIIFVVKKMKFVLKSKHKHSSGTL

SEQ ID NO: 36804 - protein, 127 aa, Diabrotica virgifera
  misc_feature: Coding regions on vcDNA: vcDNA=SeqID_16501; Strand=+; Position=116-496
  misc_feature: Homolog annotation: Hit_ID=CAB40406.1; Match level="QueryCoverage =84%, HitCoverage=67%, E-value=7e-44, Identity=74%"; Hit description =rubredoxin [Guillardia theta] ref|NP_113406.1| rubredoxin [Guillardia theta] pir||G90103 rubredoxin [impor
  misc_feature: Pfam annotation: Pfam_ID=Rubredoxin; Match level="Score=69.0, E-value= 1.3e-17, Copies=1"; Pfam description=Rubredoxin
KITLSTSTEEAEEIEDPETRKERERLAEIERLRAAEKFMEIDEGKFECQACGYMYEPEKGDRFAGVEPNTQFADLAEDFTCPACRSPKSQFKSVKKVIAGFAENQKYGLGGNSLTSGQKNSLIFGLL

SEQ ID NO: 36805 - protein, 132 aa, Diabrotica virgifera
  misc_feature: Coding regions on vcDNA: vcDNA=SeqID_16502; Strand=+; Position=59-457
  misc_feature: Homolog annotation: Hit_ID=XP_319438.1; Match level="QueryCoverage =82%, HitCoverage=46%, E-value=2e-26, Identity=51%"; Hit description =ENSANGP00000025378 [Anopheles gambiae]
  misc_feature: Gene Ontology Annotation: Cellular component=exosome (RNase complex); Biological process=rRNA processing
  misc_feature (17)..(17): Xaa can be any naturally occurring amino acid
TAPGQEGEKEKGRGTKXGPGLRQNEEKPNTLCVAQPGKLVYKEPNLYWVEGNRRRYIPKKGDLVVGVIIKKSGDTLKADIGTAEHAALSLLAFEGATKKQKPDVQVGDVVYARMKNAYLDTDPQLVRRTHAL

SEQ ID NO: 36806 - protein, 60 aa, Diabrotica virgifera
  misc_feature: Coding regions on vcDNA: vcDNA=SeqID_16503; Strand=-; Position=1-180
  misc_feature (17)..(17): Xaa can be any naturally occurring amino acid
  misc_feature (26)..(26): Xaa can be any naturally occurring amino acid
  misc_feature (33)..(35): Xaa can be any naturally occurring amino acid
  misc_feature (40)..(40): Xaa can be any naturally occurring amino acid
  misc_feature (47)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(56): Xaa can be any naturally occurring amino acid
SRSDYKTQKNRSKNRLXLQGNKYSLXNPSPPNXXXSKYSXTKRHKGXPPXSXSPXXRLLK

SEQ ID NO: 36807 - protein, 149 aa, Diabrotica virgifera
  misc_feature: Coding regions on vcDNA: vcDNA=SeqID_16504; Strand=+; Position=2-451
  misc_feature: Homolog annotation: Hit_ID=EAA04209.3; Match level="QueryCoverage =79%, HitCoverage=11%, E-value=8e-32, Identity=56%"; Hit description =ENSANGP00000015157 [Anopheles gambiae str. PEST] ref|XP_565204.1| ENSANGP00000015157 [Anopheles gambiae st
  misc_feature: Gene Ontology Annotation: Cellular component=synaptonemal complex; Biological process=female meiosis sister chromatid cohesion
  misc_feature (102)..(114): Xaa can be any naturally occurring amino acid
LKGAKRFALAFGEAPFKNREAITALHRAGIIFAVTASENISDDPTGPPPNLSFLEILTEFTNKLLKQDKRVVMGFLDKRITTGMPSSRGEDWQPLLLYRNSXXXXXXXXXXXXXKRAYGRKRHKSPDSDVEPDDLSRSRISRKFVWLRT

SEQ ID NO: 36808 - protein, 111 aa, Diabrotica virgifera
  misc_feature: Coding regions on vcDNA: vcDNA=SeqID_16505; Strand=-; Position=293-628
  misc_feature (11)..(20): Xaa can be any naturally occurring amino acid
FLISRTERKVXXXXXXXXXXAEENIFSGEKKTATSEQGFHFAIKKRDSENFIKISALLSLIGLVYTIRPEKGPNTCYTSLGKMTCFYPETIKNADVYFMKHTTLHSSFSEN

SEQ ID NO: 36809 - protein, 137 aa, Diabrotica virgifera
  misc_feature: Coding regions on vcDNA: vcDNA=SeqID_16506; Strand=+; Position=174-587
  misc_feature: Homolog annotation: Hit_ID=AAS54603.1; Match level="QueryCoverage =86%, HitCoverage=5%, E-value=5e-10, Identity=33%"; Hit description =AGR113Wp [Ashbya gossypii ATCC 10895] ref|NP_986779.1| AGR113Wp [Eremothecium gossypii]
  misc_feature (92)..(99): Xaa can be any naturally occurring amino acid
DDCIRNTLLSIISCDCKVSYETIVFLGSRLSPNSSYSDIFGLISLSNEFSFFQIRKGEKNELSRLERLVLFPPEGDFLNSSFKVNILLQSYXXXXXXXXLSLEADSMFIGRTALRISRVLFRNFHVKKAGKSFPILF

SEQ ID NO: 36810 - protein, 125 aa, Diabrotica virgifera
  misc_feature: Coding regions on vcDNA: vcDNA=SeqID_16507; Strand=+; Position=348-725
  misc_feature: Homolog annotation: Hit_ID=AAL29520.1; Match level="QueryCoverage =100%, HitCoverage=81%, E-value=2e-51, Identity=71%"; Hit description= cytochrome oxidase subunit III [Oxycheila nigroaenea]
  misc_feature: Pfam annotation: Pfam_ID=COX3; Match level="Score=58.8, E-value=5.8e -22, Copies=1"; Pfam description=Cytochrome c oxidase subunit III
  misc_feature (14)..(14): Xaa can be any naturally occurring amino acid
  misc_feature (23)..(23): Xaa can be any naturally occurring amino acid
  misc_feature (117)..(117): Xaa can be any naturally occurring amino acid
PPKGIQAFNPLEIXLTSGLTVTXAHHSLIENNFSQGLQGLIFTVTLGIYFTILQGYEYIESPFAISDSIYGSSFFIATGFHGLHVIIGTTFLLICLIRHYFNHFSSTHHFGFESTAXYWHFENVI

SEQ ID NO: 36811 - protein, 222 aa, Diabrotica virgifera
  misc_feature: Coding regions on vcDNA: vcDNA=SeqID_16508; Strand=+; Position=1-669
  misc_feature (4)..(181): Xaa can be any naturally occurring amino acid
PSRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMVINISINKIAYFSNKYRFNYGIRATFFFLWLLKKWLFLY

SEQ ID NO: 36812 - protein, 145 aa, Diabrotica virgifera
  misc_feature: Coding regions on vcDNA: vcDNA=SeqID_16509; Strand=+; Position=53-486
  misc_feature: Homolog annotation: Hit_ID=NP_650525.1; Match level="QueryCoverage =73%, HitCoverage=18%, E-value=2e-19, Identity=43%"; Hit description =CG6006-PA [Drosophila melanogaster] gb|AAF55281.1| CG6006-PA [Drosophila melanogaster]
  misc_feature: Gene Ontology Annotation: Molecular function=organic cation transporter activity; Cellular component=integral to plasma membrane; Biological process=transport
  misc_feature (3)..(4): Xaa can be any naturally occurring amino acid
  misc_feature (7)..(9): Xaa can be any naturally occurring amino acid
  misc_feature (91)..(91): Xaa can be any naturally occurring amino acid
  misc_feature (108)..(108): Xaa can be any naturally occurring amino acid
QKXXGSXXXEHYGLVLNLGNIGGNLYINSALQGVVEIPAIVISIYFLLKKGRRWPLSLTMITSGIACILTLPIYFLDSNLQWVITSLTMIXKFCISSSNATTPVFAAXELFPTPIQKYSALVLPMSHLGIVFMFGTIFGRYRFPF

SEQ ID NO: 36813 - protein, 159 aa, Diabrotica virgifera
  misc_feature: Coding regions on vcDNA: vcDNA=SeqID_16510; Strand=-; Position=80-559
  misc_feature: Homolog annotation: Hit_ID=AAN34653.1; Match level="QueryCoverage =84%, HitCoverage=33%, E-value=4e-20, Identity=38%"; Hit description =unknown [Drosophila melanogaster]
  misc_feature (97)..(97): Xaa can be any naturally occurring amino acid
LQRVGCYPENSDGEIGKLQAFVDALEFVKSIQEGHENTAITLVKSRLIGKARSLITTEDSIEKIIDTLKKNIKGDSPKLVIAKLNRKKQAHRDATTXATEIEELVEQLKTAYIAEGMPGDLVIKYAAEATVNTLTRNASSKRVPLWDCNFFLDAGERAE

SEQ ID NO: 36814 - protein, 102 aa, Diabrotica virgifera
  misc_feature: Coding regions on vcDNA: vcDNA=SeqID_16511; Strand=-; Position=581-889
  misc_feature (71)..(81): Xaa can be any naturally occurring amino acid
HNSLMASYLSKMFCQYFNCIIVEHSNAWWESRLTNALLVLTRHWSLCWLLRQRSRVRLCLTYPTFALFYGXXXXXXXXXXXKLLLALHNVTVNELVHFNLKM

SEQ ID NO: 36815 - protein, 62 aa, Diabrotica virgifera
  misc_feature: Coding regions on vcDNA: vcDNA=SeqID_16512; Strand=-; Position=3-188
  misc_feature (4)..(5): Xaa can be any naturally occurring amino acid
  misc_feature (13)..(13): Xaa can be any naturally occurring amino acid
  misc_feature (15)..(15): Xaa can be any naturally occurring amino acid
  misc_feature (31)..(31): Xaa can be any naturally occurring amino acid
  misc_feature (38)..(38): Xaa can be any naturally occurring amino acid
  misc_feature (43)..(44): Xaa can be any naturally occurring amino acid
  misc_feature (62)..(62): Xaa can be any naturally occurring amino acid
LLLXXSISQPSNXTXFTFPTTPKITYLPLLXYYPTTLXFTTQXXPTLKSVSPLTQSPFWVPX

SEQ ID NO: 36816 - protein, 99 aa, Diabrotica virgifera
  misc_feature: Coding regions on vcDNA: vcDNA=SeqID_16513; Strand=-; Position=3-299
  misc_feature: Homolog annotation: Hit_ID=ZP_00265872.1; Match level="QueryCoverage =98%, HitCoverage=25%, E-value=2e-38, Identity=82%"; Hit description =COG0578: Glycerol-3-phosphate dehydrogenase [Pseudomonas fluorescens PfO-1]
VDQVKGDDLPPALQDRRFKGKVYRLAELVIDVPSLIERLAQLAGDGLLAGEKIEPLMEDGTLAGLNVDGREIRAQRIVLSAGGGTADLLSALGLSQPAK

SEQ ID NO: 36817 - protein, 141 aa, Diabrotica virgifera
  misc_feature: Coding regions on vcDNA: vcDNA=SeqID_16514; Strand=+; Position=3-428
CPDSTYLLMKVVLIIGISGGCNCEELTKLTVDNIEDKGSHLLVTLPTHTENKPRKFIVINDTFGMDVLGFYYKYLSLRPANLTHNRLFLSYKKGKCTVHPVGVNSLSKIPREIATYLKLPDADIYTGHSFRRSAVTLLAHT

SEQ ID NO: 36818 - protein, 23 aa, Diabrotica virgifera
  misc_feature: Coding regions on vcDNA: vcDNA=SeqID_16515; Strand=-; Position=2-70
  misc_feature (13)..(13): Xaa can be any naturally occurring amino acid
PSSCVGLKGVPLXLFAGARGPSY

SEQ ID NO: 36819 - protein, 182 aa, Diabrotica virgifera
  misc_feature: Coding regions on vcDNA: vcDNA=SeqID_16516; Strand=+; Position=90-638
  misc_feature: Homolog annotation: Hit_ID=EAL33469.1; Match level="QueryCoverage =97%, HitCoverage=25%, E-value=5e-62, Identity=63%"; Hit description =GA18821-PA [Drosophila pseudoobscura]
  misc_feature: Gene Ontology Annotation: Molecular function=threonine-tRNA ligase activity; Cellular component=cytoplasm; Biological process=tRNA modification
  misc_feature: Pfam annotation: Pfam_ID=TGS; Match level="Score=79.7, E-value=7.7e -21, Copies=1"; Pfam description=TGS domain
  misc_feature (5)..(5): Xaa can be any naturally occurring amino acid
MSDNXQPAQNGGDSTAAKELKPRPEFIDNRLAIWDKLKAQYEAELAQKPEESIKVTLPDGKIIEGVSWKTTPYDIAKGISQGLADNTVIAKVNDVLWDLDRPLEVDCTLQLLKFDDEEAQAVFWHSSAHVLGEALERIYGGCLCYGPPIDSGYYYDMFLDSKGISHNKNQKNLSKLLYQMAK

SEQ ID NO: 36820 - protein, 83 aa, Diabrotica virgifera
  misc_feature: Coding regions on vcDNA: vcDNA=SeqID_16517; Strand=-; Position=136-387
GHLLSSCSTVSYRGLATITPILTLLAVALNNCIELRPYHYLKFRNQKILLRPTFLFPEILPWIMSLSREYFSIVIMWPRYSSF

SEQ ID NO: 36821 - protein, 62 aa, Diabrotica virgifera
  misc_feature: Coding regions on vcDNA: vcDNA=SeqID_16518; Strand=+; Position=1-186
  misc_feature (4)..(6): Xaa can be any naturally occurring amino acid
  misc_feature (8)..(10): Xaa can be any naturally occurring amino acid
  misc_feature (20)..(20): Xaa can be any naturally occurring amino acid
  misc_feature (22)..(22): Xaa can be any naturally occurring amino acid
  misc_feature (34)..(46): Xaa can be any naturally occurring amino acid
LKAXXXAXXXRRERPSTNPXGXNRAGQRRGNGHXXXXXXXXXXXXXECCRSLSSQSCFFNLF

SEQ ID NO: 36822 - protein, 262 aa, Diabrotica virgifera
  misc_feature: Coding regions on vcDNA: vcDNA=SeqID_16519; Strand=+; Position=85-871
  misc_feature: Homolog annotation: Hit_ID=EAL39852.1; Match level="QueryCoverage =93%, HitCoverage=73%, E-value=2e-71, Identity=58%"; Hit description =ENSANGP00000027407 [Anopheles gambiae str. PEST] ref|XP_556168.1| ENSANGP00000027407 [Anopheles gambiae st
  misc_feature: Gene Ontology Annotation: Molecular function=voltage-gated calcium channel activity; Cellular component=membrane; Biological process =biological_process unknown
  misc_feature: Pfam annotation: Pfam_ID=UPF0005; Match level="Score=-56.1, E-value =0.0053, Copies=1"; Pfam description=Uncharacterised protein family UPF000
  misc_feature (221)..(221): Xaa can be any naturally occurring amino acid
MSQWNKEQYPPPPGGQGYYGGQPGYGQPGYPPPQAGYPPQGGYPPQGGYPPQGGGYPTAPQPGYPPAGPQPGFQPPPPQYGADYAAGDEHVPFSSNATDNYGTGYNGGEDPEVKGFDFNDASIRRGFIRKVYSILSVQLLITLAFICWFVYHAPTRKYVQTHHALFYISLVMVIVALIALACCGELRRKAPANYIFLLIFTLAESFCLACASSTYKADAVXIAVGITAAVCLGLTLFAFQTRWEFTMMGGILFGAVLILFPL

SEQ ID NO: 36823 - protein, 25 aa, Diabrotica virgifera
  misc_feature: Coding regions on vcDNA: vcDNA=SeqID_16520; Strand=-; Position=2-76
  misc_feature (9)..(23): Xaa can be any naturally occurring amino acid
IVESVSSTXXXXXXXXXXXXXXXIK

SEQ ID NO: 36824 - protein, 206 aa, Diabrotica virgifera
  misc_feature: Coding regions on vcDNA: vcDNA=SeqID_16521; Strand=-; Position=133-755
  misc_feature: Homolog annotation: Hit_ID=S13329; Match level="QueryCoverage=92%, HitCoverage=19%, E-value=2e-44, Identity=45%"; Hit description =hypothetical protein 2 - fruit fly (Drosophila melanogaster)
  misc_feature (20)..(20): Xaa can be any naturally occurring amino acid
  misc_feature (40)..(40): Xaa can be any naturally occurring amino acid
RKNPVDQVGDRWLKKWKIKXNETKSTHISFHTKGKPKSPXISLNQVNIPHQNIVKYLGLHLDSKLNWKQHILKKKKQIELRVKEINWLIGRKSRLSIENKLLIYKTVIKPIWTYGIELWSCASKSNTKIIQRTQSKILCTIANAPWYISNQTLHTDLNIPLVSTVIQERANRHHEKLEDHPNQLMLPLLQPLNNRRLRRLWPIDLR

SEQ ID NO: 36825 - protein, 101 aa, Diabrotica virgifera
  misc_feature: Coding regions on vcDNA: vcDNA=SeqID_16522; Strand=+; Position=19-324
  misc_feature (74)..(81): Xaa can be any naturally occurring amino acid
SSIEQGIKLLMIAVLFLCIVVAINAVSECPDFPGVGVMKAGEQKPVQGTCNIATCHEDGSISMLTYVLKKLLRXXXXXXXXISLKCFAVKKQQMLVVANQM

SEQ ID NO: 36826 - protein, 89 aa, Diabrotica virgifera
  misc_feature: Coding regions on vcDNA: vcDNA=SeqID_16523; Strand=+; Position=498-767
  misc_feature (73)..(80): Xaa can be any naturally occurring amino acid
KEMHTLFTVIFFGTGEKVLDCSAQSSYILKVKIGNSVECRYNFTLRACPPYYFGILKILNNKYYVFFHNYYVXXXXXXXXLICFCWLFT

SEQ ID NO: 36827 - protein, 211 aa, Diabrotica virgifera
  misc_feature: Coding regions on vcDNA: vcDNA=SeqID_16524; Strand=+; Position=37-672
  misc_feature: Homolog annotation: Hit_ID=AAD17414.1; Match level="QueryCoverage =76%, HitCoverage=12%, E-value=2e-13, Identity=31%"; Hit description =copia-like retroelement pol polyprotein [Arabidopsis thaliana] pir||C84532 copia-like retroelement pol pol
  misc_feature: Pfam annotation: Pfam_ID=RVT_2; Match level="Score=-135.5, E-value =6.7e-06, Copies=1"; Pfam description=Reverse transcriptase (RNA -dependent
KSEPFYVTFSPKLLNIDSKNINIHESCKDNPHRSETLDHSDGQGCILSEISGQKEENEIFPDYTNGDVSEGEDLISVHDVSEGEDSVTVHDVSEGEQIAPTFGGRYPNRIRTARRDEDFEYSFLSVGPNDPKTYAEICERSDKSLWENAMAEEIESLSENNTWELVDRPINRNGVKGKWVYKLKHAIDGSKRYKARLVTHKVFTKSLAKEL

SEQ ID NO: 36828 - protein, 51 aa, Diabrotica virgifera
  misc_feature: Coding regions on vcDNA: vcDNA=SeqID_16525; Strand=+; Position=65-220
  misc_feature (25)..(31): Xaa can be any naturally occurring amino acid
RILTFIINQKRIKSKRTNFLSYCKXXXXXXXWRPTSKATYLTLINNSITPY

SEQ ID NO: 36829 - protein, 112 aa, Diabrotica virgifera
  misc_feature: Coding regions on vcDNA: vcDNA=SeqID_16526; Strand=+; Position=2-340
  misc_feature (10)..(11): Xaa can be any naturally occurring amino acid
  misc_feature (14)..(14): Xaa can be any naturally occurring amino acid
  misc_feature (24)..(24): Xaa can be any naturally occurring amino acid
  misc_feature (26)..(26): Xaa can be any naturally occurring amino acid
  misc_feature (34)..(34): Xaa can be any naturally occurring amino acid
  misc_feature (38)..(38): Xaa can be any naturally occurring amino acid
  misc_feature (41)..(41): Xaa can be any naturally occurring amino acid
  misc_feature (45)..(45): Xaa can be any naturally occurring amino acid
  misc_feature (47)..(48): Xaa can be any naturally occurring amino acid
  misc_feature (55)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (65)..(65): Xaa can be any naturally occurring amino acid
  misc_feature (72)..(72): Xaa can be any naturally occurring amino acid
GQGEGSHRQXXGQXGKGTPPGQNXEXGNHRTRAXDQGXPQXHPPXRXXQTPPGQXQQQXQXQQGXGSQQQQXPQQHPSGESLLEDQMNTNPNLEPNLQTTTWDNPPLKPLFG

SEQ ID NO: 36830 - protein, 88 aa, Diabrotica virgifera
  misc_feature: Coding regions on vcDNA: vcDNA=SeqID_16527; Strand=-; Position=2-265
  misc_feature (4)..(16): Xaa can be any naturally occurring amino acid
  misc_feature (26)..(35): Xaa can be any naturally occurring amino acid
  misc_feature (45)..(52): Xaa can be any naturally occurring amino acid
  misc_feature (55)..(68): Xaa can be any naturally occurring amino acid
  misc_feature (74)..(87): Xaa can be any naturally occurring amino acid
AADXXXXXXXXXXXXXYCYIFGPFVXXXXXXXXXXTNLAHTGLNXXXXXXXXSNXXXXXXXXXXXXXXPTSRSXXXXXXXXXXXXXXV

SEQ ID NO: 36831 - protein, 62 aa, Diabrotica virgifera
  misc_feature: Coding regions on vcDNA: vcDNA=SeqID_16528; Strand=+; Position=3-191
  misc_feature (14)..(21): Xaa can be any naturally occurring amino acid
  misc_feature (31)..(41): Xaa can be any naturally occurring amino acid
KRRPAAFFPVPFSXXXXXXXXSRLFYLLISXXXXXXXXXXXLRPHNSVECIRWVQFLCVRES

SEQ ID NO: 36832 - protein, 63 aa, Diabrotica virgifera
  misc_feature: Coding regions on vcDNA: vcDNA=SeqID_16529; Strand=-; Position=2-190
VFLSKSCGVYFSGLCTLDPKSPCLECSVAIRDWRMAQSLSSCFCFSPASICRYRIDSLLQPEK

SEQ ID NO: 36833 - protein, 90 aa, Diabrotica virgifera
  misc_feature: Coding regions on vcDNA: vcDNA=SeqID_16530; Strand=+; Position=14-286
MRAALLFKVNLIFHGKHIGKERGKNFFPWISGTTPNPYPLALKKELNFDSWINGPYNHGFQTEPLTGLNNILHKKPLYRELERRRVLPYL

SEQ ID NO: 36834 - protein, 203 aa, Diabrotica virgifera
  misc_feature: Coding regions on vcDNA: vcDNA=SeqID_16531; Strand=+; Position=70-681
  misc_feature: Homolog annotation: Hit_ID=XP_319657.1; Match level="QueryCoverage =89%, HitCoverage=39%, E-value=1e-29, Identity=39%"; Hit description =ENSANGP00000013916 [Anopheles gambiae]
  misc_feature: Gene Ontology Annotation: Cellular component=replication fork; Biological process=DNA replication
  misc_feature (108)..(114): Xaa can be any naturally occurring amino acid
MPEKMETERPTLKYQNFSEKFGEQPEDYNRQYCSIYLARLNEMEIILKNSIKHKWGDTYPIIKLHKLTEEDKDKCIVIGTLFKDQKLKPSILKELSEANQLVAETNPXXXXXXXDDSDKLFIEDEVQRYEIDGVPLSDVVTGITIALLGSDAGKGKFIAEDYVFAGLREQIEKPLFQEDNYIVFLSGLNLINCEKIMWKLGIG

SEQ ID NO: 36835 - protein, 55 aa, Diabrotica virgifera
  misc_feature: Coding regions on vcDNA: vcDNA=SeqID_16532; Strand=-; Position=474-641
NLCKCNFTDFFTFWQQSNLTITITITISTTLNLRKLRNPLCLITISDHIFATAQT

SEQ ID NO: 36836 - protein, 233 aa, Diabrotica virgifera
  misc_feature: Coding regions on vcDNA: vcDNA=SeqID_16533; Strand=-; Position=2-700
  misc_feature (203)..(214): Xaa can be any naturally occurring amino acid
  misc_feature (222)..(230): Xaa can be any naturally occurring amino acid
NFGQFMEMVMEFNQKQMSVKLKSLTLIFKSVLNEVKTAFDVLPDERSSHLRIIKRCKILLCSIKNLWMCFADENTENQSLCSKDVSHVEKTTLEQASKPIFGNVFLDHIISRGEDILKGRSILYKTTVRNATFKIPERSLQAQPSTNKLPLQERKLTNLRLTHLRNKTFINSSNRNKTNGELQMTDILKELNNLTNASLSTKXXXXXXXXXXXXLYLEMITXXXXXXXXXTDE

SEQ ID NO: 36837 - protein, 124 aa, Diabrotica virgifera
  misc_feature: Coding regions on vcDNA: vcDNA=SeqID_16534; Strand=-; Position=1-375
  misc_feature (56)..(101): Xaa can be any naturally occurring amino acid
  misc_feature (116)..(116): Xaa can be any naturally occurring amino acid
MRHQHNLLQRPHPVLPLRLQPLFHLHPLQLPPTAHHVRYFFTFPQLFSPFGSYRFXXXXXXXXXXXXXXXXXXXXXXXXXXXXXXXXXXXXXXXXXXXXXXVGRAPLSATKGKRPXPFLFASSP

SEQ ID NO: 36838 - protein, 131 aa, Diabrotica virgifera
  misc_feature: Coding regions on vcDNA: vcDNA=SeqID_16535; Strand=+; Position=1-393
PVRTTMMAAKLIYVSSVIYLCIATCYGAIPDPPIEVEITTDGKLDNRIDSRGPFESMLKSTDKSHQTFCPEVCQNSYCKNLVGVSKDKSCPIKRLPERGERTPKNCREIFETGNNVSGIYDTLPHHSLTPL

SEQ ID NO: 36839 - protein, 29 aa, Diabrotica virgifera
  misc_feature: Coding regions on vcDNA: vcDNA=SeqID_16536; Strand=-; Position=3-89
  misc_feature (21)..(21): Xaa can be any naturally occurring amino acid
NRLFKSLSSSFPKDLKGILLXIHPSVIRT

SEQ ID NO: 36840 - protein, 55 aa, Diabrotica virgifera
  misc_feature: Coding regions on vcDNA: vcDNA=SeqID_16537; Strand=+; Position=3-170
  misc_feature (8)..(8): Xaa can be any naturally occurring amino acid
  misc_feature (10)..(10): Xaa can be any naturally occurring amino acid
SSERRTSXRXEGTPFESNLEKITMETQGEAGLMEMVTSSLTGNRSSTDTVYRAEK

SEQ ID NO: 36841 - protein, 50 aa, Diabrotica virgifera
  misc_feature: Coding regions on vcDNA: vcDNA=SeqID_16538; Strand=+; Position=1-150
  misc_feature (10)..(10): Xaa can be any naturally occurring amino acid
  misc_feature (24)..(30): Xaa can be any naturally occurring amino acid
  misc_feature (34)..(43): Xaa can be any naturally occurring amino acid
SKPLNLNNLXMEGIPFKTPTLYMXXXXXXXIKEXXXXXXXXXXTTRHHGS

SEQ ID NO: 36842 - protein, 126 aa, Diabrotica virgifera
  misc_feature: Coding regions on vcDNA: vcDNA=SeqID_16539; Strand=+; Position=154-534
  misc_feature (100)..(107): Xaa can be any naturally occurring amino acid
CFYQLLRSKCNEGLPPRLGVEIFYYVLTAKVDKNIHSRRGTFCTFFLIELIVFDLFAIESVSFISKKSMFFYGILFYDSLNICRRKNFFKPSSWELNNLXXXXXXXXRSCDANLSILKRMAFFTKL

SEQ ID NO: 36843 - protein, 101 aa, Diabrotica virgifera
  misc_feature: Coding regions on vcDNA: vcDNA=SeqID_16540; Strand=-; Position=0-302
  misc_feature (22)..(22): Xaa can be any naturally occurring amino acid
  misc_feature (28)..(28): Xaa can be any naturally occurring amino acid
  misc_feature (40)..(40): Xaa can be any naturally occurring amino acid
  misc_feature (42)..(43): Xaa can be any naturally occurring amino acid
  misc_feature (51)..(54): Xaa can be any naturally occurring amino acid
  misc_feature (56)..(56): Xaa can be any naturally occurring amino acid
  misc_feature (58)..(59): Xaa can be any naturally occurring amino acid
  misc_feature (62)..(64): Xaa can be any naturally occurring amino acid
  misc_feature (74)..(74): Xaa can be any naturally occurring amino acid
  misc_feature (76)..(77): Xaa can be any naturally occurring amino acid
  misc_feature (80)..(82): Xaa can be any naturally occurring amino acid
  misc_feature (87)..(87): Xaa can be any naturally occurring amino acid
  misc_feature (90)..(92): Xaa can be any naturally occurring amino acid
WLLFWFRVPPAWVRSVASPVLXGSPAWXLWVLVFGLLRPXSXXLGSAPLLXXXXWXPXXSMXXXVPSSLPRAVXPXXVGXXXLPQRXPAXXXPSSSSPRVG

SEQ ID NO: 36844 - protein, 137 aa, Diabrotica virgifera
  misc_feature: Coding regions on vcDNA: vcDNA=SeqID_16541; Strand=-; Position=3-413
  misc_feature (4)..(30): Xaa can be any naturally occurring amino acid
  misc_feature (32)..(66): Xaa can be any naturally occurring amino acid
  misc_feature (70)..(89): Xaa can be any naturally occurring amino acid
  misc_feature (94)..(104): Xaa can be any naturally occurring amino acid
  misc_feature (110)..(123): Xaa can be any naturally occurring amino acid
  misc_feature (131)..(137): Xaa can be any naturally occurring amino acid
SNNXXXXXXXXXXXXXXXXXXXXXXXXXXXLXXXXXXXXXXXXXXXXXXXXXXXXXXXXXXXXXXXDYLXXXXXXXXXXXXXXXXXXXXFFNLXXXXXXXXXXXSRIPRXXXXXXXXXXXXXXPPILITFXXXXXXX

SEQ ID NO: 36845 - protein, 206 aa, Diabrotica virgifera
  misc_feature: Coding regions on vcDNA: vcDNA=SeqID_16542; Strand=+; Position=81-701
  misc_feature: Homolog annotation: Hit_ID=XP_310693.1; Match level="QueryCoverage =72%, HitCoverage=33%, E-value=7e-17, Identity=36%"; Hit description =ENSANGP00000020736 [Anopheles gambiae]
MCMVYKMLNFSVLKEHSSLAPSQVFNVLTKGLKKLGADSFSSQESVEDSFKKTEEDAEVLRSLVEPLNDQIKALKEKLRATDEQLQKCRECGHRQDELNTSEQSPHHTNLNATTATNTSFESNRLFICDMCSNYEAQLVREQKISKELETKVTAAEKAAERHKEELLKEIGFRKDMEEKWNEKKEEHKRQVAELTRTTECTEQDSE

SEQ ID NO: 36846 - protein, 170 aa, Diabrotica virgifera
  misc_feature: Coding regions on vcDNA: vcDNA=SeqID_16543; Strand=+; Position=1-510
  misc_feature: Homolog annotation: Hit_ID=NP_725337.1; Match level="QueryCoverage =87%, HitCoverage=2%, E-value=2e-58, Identity=71%"; Hit description =CG18076-PE, isoform E [Drosophila melanogaster] gb|AAM68561.1| CG18076-PE, isoform E [Drosophila
  misc_feature: Gene Ontology Annotation: Molecular function=structural constituent of cytoskeleton; Cellular component=cytoskeleton; Biological process= microtubule-based process
  misc_feature: Pfam annotation: Pfam_ID=efhand; Match level="Score=19.4, E-value =0.011, Copies=1"; Pfam description=EF hand
DPKKFVKGKGQIRVSLSGRDLLSPDPNLPHIGPRFPPAGSEPEFRSPRVKFLYDKWRHVWMLSWERQRELYDHLAYLKEKEKADNFSWDDWRKRFLKFMNYKKSRLTDLFRKMDKDNNELIPRDDFIEGIIKTKFDTSRLEMKHVADMFDENNRRLIDWKKLLAPLRPDW

SEQ ID NO: 36847 - protein, 55 aa, Diabrotica virgifera
  misc_feature: Coding regions on vcDNA: vcDNA=SeqID_16544; Strand=-; Position=3-167
DSNISETSSFLKIRVIFAIYNDKRNLLQRSHRNMFITNVYNVIFVHVLTLICPAR

SEQ ID NO: 36848 - protein, 67 aa, Diabrotica virgifera
  misc_feature: Coding regions on vcDNA: vcDNA=SeqID_16545; Strand=-; Position=1-201
KMINIGLTRSRVEAQVQRETSPDSRHRHSALFHFYYKRSLYCHIPNNSREFISQSFEHTKSIIFTTN

SEQ ID NO: 36849 - protein, 112 aa, Diabrotica virgifera
  misc_feature: Coding regions on vcDNA: vcDNA=SeqID_16546; Strand=-; Position=2-337
ALRAAVYVCCFCLRSCSNWCASIVQPAASPLFGNFLISSYNSCSSPSDCLGSHSVPQIAISTAVNQFLTKKLGFCKFSLKNCKADSTELLSFSFFEEPGSKCDNCGDNPADE

SEQ ID NO: 36850 - protein, 66 aa, Diabrotica virgifera
  misc_feature: Coding regions on vcDNA: vcDNA=SeqID_16547; Strand=-; Position=2-199
  misc_feature (9)..(18): Xaa can be any naturally occurring amino acid
  misc_feature (22)..(66): Xaa can be any naturally occurring amino acid
KSYVKYLWXXXXXXXXXXVNSXXXXXXXXXXXXXXXXXXXXXXXXXXXXXXXXXXXXXXXXXXXXX

SEQ ID NO: 36851 - protein, 99 aa, Diabrotica virgifera
  misc_feature: Coding regions on vcDNA: vcDNA=SeqID_16548; Strand=+; Position=13-309
  misc_feature: Homolog annotation: Hit_ID=AAH43974.1; Match level="QueryCoverage =78%, HitCoverage=17%, E-value=3e-19, Identity=64%"; Hit description =MGC53997 protein [Xenopus laevis]
  misc_feature: Gene Ontology Annotation: Molecular function=MHC class I protein binding; Cellular component=tubulin; Biological process=natural killer cell mediated cytolysis
  misc_feature (32)..(32): Xaa can be any naturally occurring amino acid
  misc_feature (45)..(45): Xaa can be any naturally occurring amino acid
  misc_feature (50)..(50): Xaa can be any naturally occurring amino acid
  misc_feature (56)..(56): Xaa can be any naturally occurring amino acid
SRGRIEESERALRQDRTETKKRETEHIQAGQXGNQTGAKPRETIXEEHGXDPTGAXQGDPDRQRERNNGNNNEAPGGKDAPRAIPGDSEPGTMDSVTSG

SEQ ID NO: 36852 - protein, 226 aa, Diabrotica virgifera
  misc_feature: Coding regions on vcDNA: vcDNA=SeqID_16549; Strand=-; Position=1-678
  misc_feature (6)..(207): Xaa can be any naturally occurring amino acid
VSVQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRRL

SEQ ID NO: 36853 - protein, 92 aa, Diabrotica virgifera
  misc_feature: Coding regions on vcDNA: vcDNA=SeqID_16550; Strand=-; Position=0-275
  misc_feature (87)..(87): Xaa can be any naturally occurring amino acid
VAGVWPFGSRGSWVGRLLWASSLCRQPALGCFVPGRPGFAPPGSFVSGCCGALFFARVVWFVFAFFVRVAPSFVLLQRAAPAVPGSXWFPRG

SEQ ID NO: 36854 - protein, 217 aa, Diabrotica virgifera
  misc_feature: Coding regions on vcDNA: vcDNA=SeqID_16551; Strand=+; Position=3-656
  misc_feature (2)..(183): Xaa can be any naturally occurring amino acid
  misc_feature (189)..(196): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFTKLXXXXXXXXLIKGFRNIFSPVYKNMSFCHK

SEQ ID NO: 36855 - protein, 134 aa, Diabrotica virgifera
  misc_feature: Coding regions on vcDNA: vcDNA=SeqID_16552; Strand=+; Position=62-463
  misc_feature: Homolog annotation: Hit_ID=CAB62280.1; Match level="QueryCoverage =96%, HitCoverage=88%, E-value=9e-12, Identity=37%"; Hit description =hydroxyproline-rich glycoprotein DZ-HRGP [Volvox carteri f. nagariensis]
RDQARKPPQGKAPATGKTGSTARASRKGKEKRTRTRPTDRHHTGAPEQAPPKNSPRHPPQPATRRATHTPPPTRDHRPPAPNHPTPHTAPHPRQGPPRTTTPHRPTNPPGAPSPHRSAPRPPTPAPTPRHRPHA

SEQ ID NO: 36856 - protein, 42 aa, Diabrotica virgifera
  misc_feature: Coding regions on vcDNA: vcDNA=SeqID_16553; Strand=-; Position=165-293
  misc_feature (4)..(6): Xaa can be any naturally occurring amino acid
RKEXXXQPSPPLHRPVFQPQAEESGILTSISHGFTNLVNYFG

SEQ ID NO: 36857 - protein, 56 aa, Diabrotica virgifera
  misc_feature: Coding regions on vcDNA: vcDNA=SeqID_16554; Strand=-; Position=2-169
  misc_feature (16)..(16): Xaa can be any naturally occurring amino acid
  misc_feature (48)..(48): Xaa can be any naturally occurring amino acid
ASSSSSSCTPSACASXAYSASISSSSPSATSSSPVSSSSSIKGSPPSXSSPSDAPY

SEQ ID NO: 36858 - protein, 119 aa, Diabrotica virgifera
  misc_feature: Coding regions on vcDNA: vcDNA=SeqID_16555; Strand=+; Position=13-369
  misc_feature (50)..(50): Xaa can be any naturally occurring amino acid
  misc_feature (53)..(53): Xaa can be any naturally occurring amino acid
  misc_feature (64)..(64): Xaa can be any naturally occurring amino acid
  misc_feature (90)..(90): Xaa can be any naturally occurring amino acid
  misc_feature (96)..(96): Xaa can be any naturally occurring amino acid
KGAGQGGTTGGAPFATGEDTQQSARTKGGHPAPRRRNPPTDTRKDEQERXSTXKPTATATAPEXDDKHPAPTTNADPRENDAKRPPTTPXDPPAHXAPPPQATPDPPATDGPPPPPTPA

SEQ ID NO: 36859 - protein, 105 aa, Diabrotica virgifera
  misc_feature: Coding regions on vcDNA: vcDNA=SeqID_16556; Strand=-; Position=1-315
SVYFIIIALYHVMYKGFILSLYNIVYILIYIIPLLWTLDVPLVQMEGLMLPPLPLPEIQVVQLLLLVSLMLPSNVLRHCSWSMEQIWYKIRCLRYTQGTKNLRTR

SEQ ID NO: 36860 - protein, 74 aa, Diabrotica virgifera
  misc_feature: Coding regions on vcDNA: vcDNA=SeqID_16557; Strand=-; Position=100-324
  misc_feature (42)..(50): Xaa can be any naturally occurring amino acid
  misc_feature (65)..(72): Xaa can be any naturally occurring amino acid
RQYKYQQYHTVFNGNRNKRHLIVSQIFQVYFLLVYITYLLNXXXXXXXXXYYSLLSFITPVVRTXXXXXXXXWR

SEQ ID NO: 36861 - protein, 283 aa, Diabrotica virgifera
  misc_feature: Coding regions on vcDNA: vcDNA=SeqID_16558; Strand=+; Position=13-861
  misc_feature: Homolog annotation: Hit_ID=AAC06038.1; Match level="QueryCoverage =97%, HitCoverage=54%, E-value=2e-76, Identity=48%"; Hit description =beta-glucosidase precursor [Spodoptera frugiperda]
  misc_feature: Gene Ontology Annotation: Cellular component=endoplasmic reticulum; Biological process=aging
  misc_feature: Pfam annotation: Pfam_ID=Glyco_hydro_1; Match level="Score=145.2, E -value=1.5e-40, Copies=1"; Pfam description=Glycosyl hydrolase family 1
  misc_feature (235)..(240): Xaa can be any naturally occurring amino acid
MKVILISLLLGLSLAEDPINNKKFPDDFLFGVASSAYQVEGAWNEDGKGESLWDHRVHTDPNFIEDNSTGDVACDSYHKIKEDVAILKELGVNHYRFSLSWTRILPTGLADEINVGGVIYYKNLISELKANNIIPLVTIYHWDLPQVFQDYGGFLNSSIVDWYSNYARVVFSLFGDDVKHWITINEPQQICSGGYGYGYFPPTIKSEDLLEFQCIHNLVKAHAKAWHIYDDEFRXXXXXXISITLDTSSYIPASNKSEDIEAADRMQHFTLGVYANPYLRWRL

SEQ ID NO: 36862 - protein, 44 aa, Diabrotica virgifera
  misc_feature: Coding regions on vcDNA: vcDNA=SeqID_16559; Strand=-; Position=63-197
  misc_feature (2)..(10): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(40): Xaa can be any naturally occurring amino acid
  misc_feature (44)..(44): Xaa can be any naturally occurring amino acid
FXXXXXXXXXDRNQPGSHRFXLRSCKIXKVEXXXXXXXXXNYKX

SEQ ID NO: 36863 - protein, 88 aa, Diabrotica virgifera
  misc_feature: Coding regions on vcDNA: vcDNA=SeqID_16560; Strand=+; Position=391-657
  misc_feature (15)..(37): Xaa can be any naturally occurring amino acid
TFLTQNWREVLCRRXXXXXXXXXXXXXXXXXXXXXXXSHLITVNNSDIKSQIIHYLLILHILLVFQYTFIHPSSFKPFQFNSITWYKK

SEQ ID NO: 36864 - protein, 175 aa, Diabrotica virgifera
  misc_feature: Coding regions on vcDNA: vcDNA=SeqID_16561; Strand=-; Position=48-575
  misc_feature: Homolog annotation: Hit_ID=NP_001005597.1; Match level="QueryCoverage= 79%, HitCoverage=52%, E-value=1e-47, Identity=65%"; Hit description =zgc:101858 [Danio rerio] gb|AAH81417.1| Zgc:101858 [Danio rerio]
  misc_feature: Gene Ontology Annotation: Molecular function=electron transporter activity; Cellular component=nucleus; Biological process =carbohydrate metabolism
  misc_feature: Pfam annotation: Pfam_ID=adh_short; Match level="Score=16.4, E-value =3.6e-07, Copies=1"; Pfam description=short chain dehydrogenase
MLYGLFCLESVKSHSITSGVENWKISATTSSMVSPGMFEMIRVCTPHLIKTQGAIVNISSVTGLRAFPGVLAYCISKSAVDQLTRCVALELASKQVRCNSVNPGVIDTILHKRSGLNDEQYKAFLEKSRLTHALGRAGTAEEVASGITFLASTDASFVTGNNFRIDGGRGIMCPR

SEQ ID NO: 36865 - protein, 122 aa, Diabrotica virgifera
  misc_feature: Coding regions on vcDNA: vcDNA=SeqID_16562; Strand=+; Position=2-370
  misc_feature (1)..(7): Xaa can be any naturally occurring amino acid
XXXXXXXKQYGQQSNQQGLHGYGEDDLGGVVGGHNSQRNVKVVKTTHTSGSYGSGQQQTGQEAFEDADEDVGGHSGRIVKVVKTTHTSGGYGSGGQEQLGQIKSYLRREPLLTGQQAFDEQY

SEQ ID NO: 36866 - protein, 185 aa, Diabrotica virgifera
  misc_feature: Coding regions on vcDNA: vcDNA=SeqID_16563; Strand=+; Position=36-590
  misc_feature: Homolog annotation: Hit_ID=XP_321429.1; Match level="QueryCoverage =80%, HitCoverage=61%, E-value=2e-41, Identity=60%"; Hit description =ENSANGP00000022064 [Anopheles gambiae]
  misc_feature: Gene Ontology Annotation: Molecular function=structural constituent of eye lens
  misc_feature: Pfam annotation: Pfam_ID=Chitin_bind_4; Match level="Score=107.4, E -value=3.5e-29, Copies=1"; Pfam description=Insect cuticle protein
VGILSWGSVVGQRWRRVAAPLAKAVIAEDFDHNPQYSFGYDVQDSLTGDSKSQVETRSGNVVQGSYSLTDPDGTRRTVDYSADDVNGFNAVVRKEPLVAKAVVAAPAVAKLAAPAVAYAAPVAKLAAPAFAYQAHAAPALAYSAPLAKYAAPAVAYTAPAGSKYSLRCSSSFRLSIHCSQLDLTA

SEQ ID NO: 36867 - protein, 128 aa, Diabrotica virgifera
  misc_feature: Coding regions on vcDNA: vcDNA=SeqID_16564; Strand=-; Position=4-390
  misc_feature: Homolog annotation: Hit_ID=CAE47497.1; Match level="QueryCoverage =94%, HitCoverage=38%, E-value=2e-11, Identity=29%"; Hit description =cathepsin L-like proteinase [Diabrotica virgifera virgifera]
  misc_feature (63)..(69): Xaa can be any naturally occurring amino acid
  misc_feature (95)..(95): Xaa can be any naturally occurring amino acid
PPRFPPQSKFKYPGNRGRSQKVPQPIFSPRGFVNFSRTETPLINPLFKFGPIFLTFDPDPWPXXXXXXXHNQNFGTPPHPRFFSLGSPKNPLFLXNPWGTNWGGKGFPRVLPGKNFFGFYPKNFFPQF

SEQ ID NO: 36868 - protein, 85 aa, Diabrotica virgifera
  misc_feature: Coding regions on vcDNA: vcDNA=SeqID_16565; Strand=-; Position=3-257
VFLFQWGIFNCRNLILSCPSSPPCMSFFASLRSMSLVIRSGVLVTEGKASRCVSSPWKTAWLIQDSFLGQDPQKSDRACCLLWLI

SEQ ID NO: 36869 - protein, 88 aa, Diabrotica virgifera
  misc_feature: Coding regions on vcDNA: vcDNA=SeqID_16566; Strand=+; Position=463-729
FPFLFQLVFTVFALNKPSFSSFTTDLAVSLFTLIRVYFERYITIFTVIRRQGPSVGIYGGVSPSRKPLSLAVPLLHRPIRHQLLQTKS

SEQ ID NO: 36870 - protein, 235 aa, Diabrotica virgifera
  misc_feature: Coding regions on vcDNA: vcDNA=SeqID_16567; Strand=-; Position=0-704
  misc_feature (10)..(17): Xaa can be any naturally occurring amino acid
  misc_feature (31)..(57): Xaa can be any naturally occurring amino acid
  misc_feature (59)..(72): Xaa can be any naturally occurring amino acid
  misc_feature (77)..(84): Xaa can be any naturally occurring amino acid
  misc_feature (86)..(147): Xaa can be any naturally occurring amino acid
  misc_feature (151)..(163): Xaa can be any naturally occurring amino acid
  misc_feature (169)..(192): Xaa can be any naturally occurring amino acid
  misc_feature (199)..(228): Xaa can be any naturally occurring amino acid
KKKKHTNFSXXXXXXXXPSLLPSPPLSSSLXXXXXXXXXXXXXXXXXXXXXXXXXXXSXXXXXXXXXXXXXXRRGGXXXXXXXXKXXXXXXXXXXXXXXXXXXXXXXXXXXXXXXXXXXXXXXXXXXXXXXXXXXXXXXXXXXXXXXGGVXXXXXXXXXXXXXGREGEXXXXXXXXXXXXXXXXXXXXXXXXKPTPPRXXXXXXXXXXXXXXXXXXXXXXXXXXXXXXLFPGGGG

SEQ ID NO: 36871 - protein, 64 aa, Diabrotica virgifera
  misc_feature: Coding regions on vcDNA: vcDNA=SeqID_16568; Strand=-; Position=373-567
TFELHLKIFRTTINKIQMFIYIAKLVSGCSTTFEFVLSLNPISSYVTVLELRLKNKHTPIVCFQ

SEQ ID NO: 36872 - protein, 255 aa, Diabrotica virgifera
  misc_feature: Coding regions on vcDNA: vcDNA=SeqID_16569; Strand=+; Position=1-765
  misc_feature: Pfam annotation: Pfam_ID=zf-AD; Match level="Score=17.6, E-value =0.001, Copies=1"; Pfam description=Zinc-finger associated domain (zf- AD)
ELLKKYIPGMYSIVRNLDLLLCEICFTNIETLSAFVGTINDTNEKIKAAKEATADKIDLTRLVQTNNNCQGKVSSACRLCLKIIFMPQIFLYENESNVLRHDLILEMCQICMISMDLELSEHPVMCWECWENLQICYSFKKSCLDIDKKITSYRTIFCLTKKDITENIFTEMCNYFSQNLDDDLIKLSRIIEKEDELLENCLDVSRYTLRNNVKREYKREDCSNNDKVCENKIMPKSNSKRRRNCFTEEDDNFLL

SEQ ID NO: 36873 - protein, 94 aa, Diabrotica virgifera
  misc_feature: Coding regions on vcDNA: vcDNA=SeqID_16570; Strand=-; Position=141-425
  misc_feature (71)..(77): Xaa can be any naturally occurring amino acid
SKRQRRKISMNLPKPDFSQLTTATVQRNTLRSVKRNAEQGPLRGHQSCFPTKAINPPTKAENQYTHCKLNXXXXXXXIIVGQLHDGTEPVGRAQ

SEQ ID NO: 36874 - protein, 97 aa, Diabrotica virgifera
  misc_feature: Coding regions on vcDNA: vcDNA=SeqID_16571; Strand=+; Position=60-353
  misc_feature (69)..(76): Xaa can be any naturally occurring amino acid
HLLASAENRTCSYGMESFGDSGNQINEHHGEPRIGELHNVDPFRAFRKNISWHGNIEVDSTSIDTDTLXXXXXXXXKVAVSPTDDDADCVELYDRFI

SEQ ID NO: 36875 - protein, 97 aa, Diabrotica virgifera
  misc_feature: Coding regions on vcDNA: vcDNA=SeqID_16572; Strand=+; Position=381-671
  misc_feature: Homolog annotation: Hit_ID=AAH77915.1; Match level="QueryCoverage =100%, HitCoverage=22%, E-value=4e-22, Identity=43%"; Hit description= Bcl6-prov protein [Xenopus laevis]
  misc_feature: Gene Ontology Annotation: Molecular function=transcriptional repressor activity; Cellular component=nucleus; Biological process =negative regulation of transcription from Pol II promoter
  misc_feature: Pfam annotation: Pfam_ID=zf-C2H2; Match level="Score=29.5, E-value =9.9e-06, Copies=2"; Pfam description=Zinc finger, C2H2 type
RTHWRVHSGEKPYEFIQANILKTHLRLHTGEQPYQCELCFMQIFQKGSLKAHLPVHTGEKLYKCGICFTRVFHRSSFKSHFRVHTGEKPKQFSRVNV

SEQ ID NO: 36876 - protein, 93 aa, Diabrotica virgifera
  misc_feature: Coding regions on vcDNA: vcDNA=SeqID_16573; Strand=+; Position=164-445
YCSKLKRPTSLSKLSVFCMFFLLIFWTTQFVCYFSMCNLLYQEYLRTLAKSLINTKSHECASNWTTKSCHSWYTLTDSQVIHKSLFPFPHFIK

SEQ ID NO: 36877 - protein, 338 aa, Diabrotica virgifera
  misc_feature: Coding regions on vcDNA: vcDNA=SeqID_16574; Strand=+; Position=48-1059
  misc_feature: Homolog annotation: Hit_ID=XP_320984.1; Match level="QueryCoverage =90%, HitCoverage=59%, E-value=1e-105, Identity=63%"; Hit description= ENSANGP00000019928 [Anopheles gambiae]
  misc_feature: Gene Ontology Annotation: Molecular function=RNA binding; Cellular component=nucleolus; Biological process=rRNA processing
  misc_feature (141)..(141): Xaa can be any naturally occurring amino acid
  misc_feature (236)..(236): Xaa can be any naturally occurring amino acid
  misc_feature (240)..(240): Xaa can be any naturally occurring amino acid
  misc_feature (259)..(259): Xaa can be any naturally occurring amino acid
  misc_feature (272)..(272): Xaa can be any naturally occurring amino acid
MTKLYVLFEHAAGYGVFKVEEFEEIGMLLPQLEAAVYDISRFNSIVKLVGFCPFRSAVTALENVNAISEGILPEELQQYLDVTIPKGSKKDKVTLGVSDPKLSAAITEALGINCSHIGVVPEVIRGIRAHFHHLIKGFTLXSSGVAQLGLGHSYSRAKIKFNVHRVDNMIIQSIALLDQLDKDINTFSMRIREWYSYHFPELVKIVPENYTYAQVAQFFRTGKFFQKNSGSSEKLXMDSXKAPAILDASRFSMGMGIKXINFLKFEMFPTKXVNFLPNFRKGVSKNFRTKMPKVVPILPTLIGRQGGGQGGLAPAGVPLQIFGKKKPPFLHRSKGLPF

SEQ ID NO: 36878 - protein, 219 aa, Diabrotica virgifera
  misc_feature: Coding regions on vcDNA: vcDNA=SeqID_16575; Strand=+; Position=36-695
  misc_feature: Homolog annotation: Hit_ID=XP_315308.1; Match level="QueryCoverage =78%, HitCoverage=83%, E-value=3e-58, Identity=69%"; Hit description =ENSANGP00000022432 [Anopheles gambiae]
  misc_feature: Gene Ontology Annotation: Molecular function=actin binding; Cellular component=troponin complex; Biological process=muscle development
  misc_feature: Pfam annotation: Pfam_ID=Troponin; Match level="Score=70.3, E-value =5.4e-18, Copies=1"; Pfam description=Troponin
  misc_feature (14)..(20): Xaa can be any naturally occurring amino acid
  misc_feature (67)..(76): Xaa can be any naturally occurring amino acid
  misc_feature (189)..(199): Xaa can be any naturally occurring amino acid
NTSNMADDERKKLXXXXXXXQAEIERKRAEVRARMEEASKAKKAKKGFMTPERKKKLRLLLRKKAAXXXXXXXXXXAAERRRIIEERCGKPKLVDDANEGSLKQVCEGYHRRIEDLENKKFDLEKEVEFRDFQISELNSQVNDLRGKFVKPTLKKVSKYQNKSPNFQKKAAEFNFPKPTQSWQEERIPXXXXXXXXXXXPLQKDSRLTEAGDGQRKSSF

SEQ ID NO: 36879 - protein, 275 aa, Diabrotica virgifera
  misc_feature: Coding regions on vcDNA: vcDNA=SeqID_16576; Strand=+; Position=3-826
  misc_feature: Homolog annotation: Hit_ID=CAI20820.1; Match level="QueryCoverage =98%, HitCoverage=35%, E-value=3e-48, Identity=37%"; Hit description =novel protein [Danio rerio]
  misc_feature (216)..(216): Xaa can be any naturally occurring amino acid
  misc_feature (221)..(221): Xaa can be any naturally occurring amino acid
KNYFDKLNTLQCTLQYFKVVQRIEGLSDELQVEVGKKDDERCVTIFANLTEISRNLADFCGQNLRNYLKDNIYFWHNILKEKLAKDFDEVLKLIKWPFVSANFSLVLPLPTHIQKLQTVCEFLLQIEIPSESSVPVVTTALLSNFQPLCLPIHLLVQPLRKRFMYHFYGARQTNRVDKPEWYLTQILTWIRDHQDFVEKYIQPIVEKLGLLHIEAXEFIRXLVQIAVEKLFSDLPNLQFDDFTFSHFIDEALGFDKELRETYEYPRHQPSILVVL

SEQ ID NO: 36880 - protein, 103 aa, Diabrotica virgifera
  misc_feature: Coding regions on vcDNA: vcDNA=SeqID_16577; Strand=+; Position=99-410
  misc_feature (33)..(38): Xaa can be any naturally occurring amino acid
  misc_feature (46)..(53): Xaa can be any naturally occurring amino acid
MPQAILPRPLENPCFEDDNKRQLKSYHENEVDXXXXXXVNPDDDEXXXXXXXXVDYDNAIVVNDQPHLPHFGSVSVVNSNDVHFGNKTVYKGPVTIKQFVSQK

SEQ ID NO: 36881 - protein, 136 aa, Diabrotica virgifera
  misc_feature: Coding regions on vcDNA: vcDNA=SeqID_16578; Strand=+; Position=1-408
  misc_feature (4)..(69): Xaa can be any naturally occurring amino acid
  misc_feature (78)..(98): Xaa can be any naturally occurring amino acid
  misc_feature (110)..(135): Xaa can be any naturally occurring amino acid
HNYXXXXXXXXXXXXXXXXXXXXXXXXXXXXXXXXXXXXXXXXXXXXXXXXXXXXXXXXXXXXXXXXXXGMSFKIKFXXXXXXXXXXXXXXXXXXXXXSFILIYYYSHFXXXXXXXXXXXXXXXXXXXXXXXXXXH

SEQ ID NO: 36882 - protein, 184 aa, Diabrotica virgifera
  misc_feature: Coding regions on vcDNA: vcDNA=SeqID_16579; Strand=+; Position=78-629
  misc_feature: Homolog annotation: Hit_ID=Q63699; Match level="QueryCoverage=97%, HitCoverage=59%, E-value=2e-56, Identity=61%"; Hit description=Cell division protein kinase 2 dbj|BAA05947.1| cyclin dependent kinase 2 -alpha [Rattus rattus]
  misc_feature: Gene Ontology Annotation: Molecular function=cyclin-dependent protein kinase activity; Cellular component=transcription factor complex; Biological process=G2/M transition of mitotic cell cycle
  misc_feature: Pfam annotation: Pfam_ID=Pkinase; Match level="Score=117.8, E-value =2.6e-32, Copies=1"; Pfam description=Protein kinase domain
MDKLDRFIKLAKAGEGTYGVVYKAKNKLTGKNVALKRIKLEKFYNKGDSEGVPPTAIREISLLKGLRHSSIVELLDVMQTTDKLYLVFEYLDLDLKRYLDNTRRPMEAELLRNYMKQLIEALAYLHSHRILHRDLKPQNLLVDKEGHIKLADFGLSRSFSLPTRTYTHEVGTISYRAPELLLGA

SEQ ID NO: 36883 - protein, 70 aa, Diabrotica virgifera; identical to SEQ ID NO: 28769
  misc_feature: Coding regions on vcDNA: vcDNA=SeqID_16580; Strand=-; Position=3-212
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36884 - protein, 44 aa, Diabrotica virgifera
  misc_feature: Coding regions on vcDNA: vcDNA=SeqID_16581; Strand=-; Position=420-554
MFNHSLLSLLLRLCNANLIPKSKAFALNTFVHRLFKNYLNRWYK

SEQ ID NO: 36885 - protein, 73 aa, Diabrotica virgifera
  misc_feature: Coding regions on vcDNA: vcDNA=SeqID_16582; Strand=+; Position=57-278
VYYKSPIPSASVKNFVETCNQQTARKNVKMFHRMKKDRDIDPMTAVGPLWTDLNGPSSIYRTTDIYRLECMLL

SEQ ID NO: 36886 - protein, 215 aa, Diabrotica virgifera
  misc_feature: Coding regions on vcDNA: vcDNA=SeqID_16583; Strand=+; Position=22-669
  misc_feature: Homolog annotation: Hit_ID=XP_316873.1; Match level="QueryCoverage =98%, HitCoverage=89%, E-value=3e-34, Identity=35%"; Hit description =ENSANGP00000013100 [Anopheles gambiae]
  misc_feature: Pfam annotation: Pfam_ID=DUF1370; Match level="Score=-65.4, E-value =0.028, Copies=1"; Pfam description=Protein of unknown function (DUF1370)
MALQKERFSKIPEDAVILTEEQALIYQTKLMSNWPNRKDVLGFKYGSLAIASASMLTGIYFNQHFRGMFRLLNYGQMSSYLPIAAVPTAISLFSHQQFVLGSLLLDRKQCPVCLQTRASAIQALGGCLLPLVLSPITSLALVHRYHTYDMPYITKEPRKAFQVLAKMFKPIKNVTFYLFLGHAFLASVVTYLEADSINTVDMKLALAEQEEEFRS

SEQ ID NO: 36887 - protein, 23 aa, Diabrotica virgifera
  misc_feature: Coding regions on vcDNA: vcDNA=SeqID_16584; Strand=-; Position=2-73
VKKFIGKKSCLNSLSFCSKMIKT

SEQ ID NO: 36888 - protein, 82 aa, Diabrotica virgifera
  misc_feature: Coding regions on vcDNA: vcDNA=SeqID_16585; Strand=-; Position=101-349
  misc_feature (12)..(21): Xaa can be any naturally occurring amino acid
  misc_feature (27)..(35): Xaa can be any naturally occurring amino acid
  misc_feature (63)..(73): Xaa can be any naturally occurring amino acid
QPYRRRFNSQCXXXXXXXXXXFYDCKXXXXXXXXXNTYLVKIFVSNYCSEIISLFHFSMCLRXXXXXXXXXXXIVLIKSFGK

SEQ ID NO: 36889 - protein, 163 aa, Diabrotica virgifera
  misc_feature: Coding regions on vcDNA: vcDNA=SeqID_16586; Strand=+; Position=171-662
  misc_feature: Homolog annotation: Hit_ID=NP_747420.1; Match level="QueryCoverage =77%, HitCoverage=89%, E-value=3e-39, Identity=64%"; Hit description =hypothetical protein PP5319 [Pseudomonas putida KT2440] gb|AAN70884.1| conserved hypothetical
  misc_feature: Pfam annotation: Pfam_ID=Lipoprotein_15; Match level="Score=139.0, E -value=1.1e-38, Copies=2"; Pfam description=Secreted repeat of unknown function
ITELLQSCDSNLVAWAILASLDYALGPNPDNHKRKVPMTHSTFSWKALLVTAALTLPTLAFAADPAMTKDGMLVDHKGMTLYTFAKDADGKSMCNDKCAANWPPLMAESTDKPMGKWTVITRDDQKSQWAYSGKPLYTFVMDKKAGDMTGEGKMDGAWKVAKP

SEQ ID NO: 36890 - protein, 65 aa, Diabrotica virgifera
  misc_feature: Coding regions on vcDNA: vcDNA=SeqID_16587; Strand=+; Position=523-720
IHLCKRFLGLYQCEEICRLFKTVVEILSCDRSEFYSMLQLPMNTCFVIFVYSFLVYCDFTYLFLE

SEQ ID NO: 36891 - protein, 84 aa, Diabrotica virgifera
  misc_feature: Coding regions on vcDNA: vcDNA=SeqID_16588; Strand=+; Position=1-255
  misc_feature: Homolog annotation: Hit_ID=NP_730693.1; Match level="QueryCoverage =71%, HitCoverage=8%, E-value=5e-19, Identity=75%"; Hit description =CG7421-PB, isoform B [Drosophila melanogaster] gb|AAF51789.2| CG7421- PB, isoform B [Drosophila
  misc_feature: Gene Ontology Annotation: Cellular component=nucleolus; Biological process=rRNA processing
  misc_feature: Pfam annotation: Pfam_ID=SRP40_C; Match level="Score=82.1, E-value =1.4e-21, Copies=1"; Pfam description=SRP40, C-terminal domain
QEDENEESELKIKKPKYDNFVKAGQNKSFDGNDKANARGSWGEKANYDLKHTRGKSFRHEKTKKKRGSYRGGTIDTSINSIKFD

SEQ ID NO: 36892 - protein, 228 aa, Diabrotica virgifera
  misc_feature: Coding regions on vcDNA: vcDNA=SeqID_16589; Strand=+; Position=101-784
  misc_feature (206)..(220): Xaa can be any naturally occurring amino acid
IIEMASRRSRIKGIANIPQRRKATNEENKLNLTESEAGENEKPSENKDAPLDNSNTGNSISNDAIEINLPKPEALTQIVKETFNNGVTNIKNEAQQNSKDCDKNLTPATEPPKPATEPPKPATEPPKPTNILKRKFIKAPVSLNAIKNRKKPYQESLEKGVDTQVNETVETNKNKVLGNFEQRSNNDLACTVNKEFIKNEERSAAXXXXXXXXXXXXXXXLFQKPVPL

SEQ ID NO: 36893 - protein, 80 aa, Diabrotica virgifera
  misc_feature: Coding regions on vcDNA: vcDNA=SeqID_16590; Strand=+; Position=383-625
  misc_feature (13)..(28): Xaa can be any naturally occurring amino acid
ASHILNFMINTHXXXXXXXXXXXXXXXXQSIHNGVMNYNVVLCTVLCTFICSFLYCLHFVLSIEVYIMLYISLTLSDLFL

SEQ ID NO: 36894 - protein, 122 aa, Diabrotica virgifera
  misc_feature: Coding regions on vcDNA: vcDNA=SeqID_16591; Strand=+; Position=221-586
  misc_feature (26)..(37): Xaa can be any naturally occurring amino acid
IRVQRFRAKKKLKRTYGFSNFKGGGXXXXXXXXXXXXGGGYKKTGGGFNNGRFNNFFGDNSYKNRKGGGYQNNFNGNNQGYGGNGGLRQGEGVNKKLRPGKKPFYGPHPFGGSRTPFGGGEF

SEQ ID NO: 36895 - protein, 167 aa, Diabrotica virgifera
  misc_feature: Coding regions on vcDNA: vcDNA=SeqID_16592; Strand=+; Position=3-506
  misc_feature: Homolog annotation: Hit_ID=ZP_00262844.1; Match level="QueryCoverage =98%, HitCoverage=94%, E-value=4e-75, Identity=82%"; Hit description =COG4539: Predicted membrane protein [Pseudomonas fluorescens PfO-1]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF962; Match level="Score=216.9, E-value=4e- 62, Copies=1"; Pfam description=Protein of unknown function (DUF962)
LSQYAAYHRDPRNIASHFIGIPLIVVAVAVLLSRPEWTVAGLWLSPAVLLALFSAWFYLRLELALGVLMTVLMGLSVWAGHVLAAQSTLVWLSSGIGMFVVGWVIQFVGHYYEGRKPAFVDDVSGLIVGPLFVVAELAFLVGLRHDLKRQIEERSGPVAVRHKNATA

SEQ ID NO: 36896 - protein, 260 aa, Diabrotica virgifera
  misc_feature: Coding regions on vcDNA: vcDNA=SeqID_16593; Strand=+; Position=1-783
  misc_feature: Homolog annotation: Hit_ID=XP_315477.1; Match level="QueryCoverage =98%, HitCoverage=11%, E-value=1e-100, Identity=68%"; Hit description= ENSANGP00000007087 [Anopheles gambiae]
FVRNNLLLYVEPHRKEALEKLARMRFKLQLHTVEDQRKPIQNQQTLVRSTQSKLRRLEKETYLVNKALEENPDDIELRQESDRLERLMYDCKNQLNAQSEELDMMLSCFKETQLLVNSRLATTRSDKPLTVVRANEICFKHAQWRLTEADGQIGIADLVLSNFLYTKNSKSDDSVEHLMELGYLRMTNLLPNEIYKEVICPTEIQFDMPIEHKKVLRIFCREKPPVGGISVKEIFEINLVPLTIGLTKKFYNTMMKFCFP

SEQ ID NO: 36897 - protein, 250 aa, Diabrotica virgifera
  misc_feature: Coding regions on vcDNA: vcDNA=SeqID_16594; Strand=+; Position=83-832
  misc_feature: Homolog annotation: Hit_ID=CAE67008.1; Match level="QueryCoverage =98%, HitCoverage=9%, E-value=4e-53, Identity=46%"; Hit description =Hypothetical protein CBG12408 [Caenorhabditis briggsae]
  misc_feature: Gene Ontology Annotation: Molecular function=molecular_function unknown; Cellular component=mitochondrion; Biological process=polar body extrusion after meiotic divisions
  misc_feature: Pfam annotation: Pfam_ID=ketoacyl-synt; Match level="Score=193.3, E -value=5.1e-55, Copies=1"; Pfam description=Beta-ketoacyl synthase, N- terminal dom
MEAPFDVVISGMSGRFPECYNVKEFQDAIFQGLNLATEDDRRFSTELKGLPHWIAKVPELDKFDASFFDIHYKQANFTDPRHRILLETVYESIVDAGYNPAELYGSKTGVYVGLANYTNMAEMRSVESNGYGNLGMALYGAANRISHAFNFRGPSLALDAACASSMYALIACFEKIRSGEIEHAVVCGTHLLLSPDENRDYKQLRVLSSDQYSRVFSKIRDGFVRAEGVATLFLSRKTNCRRMYATILGA

SEQ ID NO: 36898 - protein, 129 aa, Diabrotica virgifera
  misc_feature: Coding regions on vcDNA: vcDNA=SeqID_16595; Strand=-; Position=450-839
  misc_feature (1)..(10): Xaa can be any naturally occurring amino acid
  misc_feature (13)..(23): Xaa can be any naturally occurring amino acid
  misc_feature (36)..(41): Xaa can be any naturally occurring amino acid
  misc_feature (97)..(107): Xaa can be any naturally occurring amino acid
XXXXXXXXXXLFXXXXXXXXXXXILFLFIHPSFHLXXXXXXIILPNHVLNTTPTQNNQRPPDTIHLIQKNIFYITHSKKNILYFPIFNPKYFLLIIXXXXXXXXXXXLNLNTLNTYLNKPLLNNHNHYL

SEQ ID NO: 36899 - protein, 63 aa, Diabrotica virgifera
  misc_feature: Coding regions on vcDNA: vcDNA=SeqID_16596; Strand=-; Position=1-189
  misc_feature (4)..(62): Xaa can be any naturally occurring amino acid
QKNXXXXXXXXXXXXXXXXXXXXXXXXXXXXXXXXXXXXXXXXXXXXXXXXXXXXXXXXXXXK

SEQ ID NO: 36900 - protein, 66 aa, Diabrotica virgifera; identical to SEQ ID NO: 26808
  misc_feature: Coding regions on vcDNA: vcDNA=SeqID_16597; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36901 - protein, 186 aa, Diabrotica virgifera
  misc_feature: Coding regions on vcDNA: vcDNA=SeqID_16598; Strand=+; Position=32-592
  misc_feature: Homolog annotation: Hit_ID=AAG44630.1; Match level="QueryCoverage =90%, HitCoverage=23%, E-value=5e-56, Identity=69%"; Hit description =90-kDa heat shock protein HSP83 [Spodoptera frugiperda]
  misc_feature: Gene Ontology Annotation: Molecular function=molecular_function unknown; Cellular component=cellular_component unknown; Biological process=biological_process unknown
  misc_feature: Pfam annotation: Pfam_ID=HSP90; Match level="Score=-212.5, E-value=4e- 07, Copies=1"; Pfam description=Hsp90 protein
  misc_feature (6)..(17): Xaa can be any naturally occurring amino acid
  misc_feature (25)..(45): Xaa can be any naturally occurring amino acid
  misc_feature (47)..(54): Xaa can be any naturally occurring amino acid
  misc_feature (80)..(88): Xaa can be any naturally occurring amino acid
  misc_feature (115)..(122): Xaa can be any naturally occurring amino acid
  misc_feature (172)..(172): Xaa can be any naturally occurring amino acid
EPEEVXXXXXXXXXXXXPKIEDVGXXXXXXXXXXXXXXXXXXXXXYXXXXXXXXTKPIWTRNADDITQEEYGEFYKSLTXXXXXXXXXKHFSVEGQLEFRALLFVPRRVPFDLFXXXXXXXXIKLYVRRVFIMDNCEDLIPEYLNFIKGVVDSEDLPLNISREMVPQNKILXGIRKNLVKKCLELF

SEQ ID NO: 36902 - protein, 147 aa, Diabrotica virgifera
  misc_feature: Coding regions on vcDNA: vcDNA=SeqID_16599; Strand=+; Position=1-444
  misc_feature (2)..(38): Xaa can be any naturally occurring amino acid
  misc_feature (51)..(59): Xaa can be any naturally occurring amino acid
  misc_feature (86)..(93): Xaa can be any naturally occurring amino acid
CXXXXXXXXXXXXXXXXXXXXXXXXXXXXXXXXXXXXXGKFYMITKIETNXXXXXXXXXLDSRTFLKYKGGRGNTLIVSTDRPKGXXXXXXXXQGIWYIFYKKLGGLNITLDNLRDFGKSMGIKLIFFGKKNTRGKNRVKIRGKRGF

SEQ ID NO: 36903 - protein, 66 aa, Diabrotica virgifera; identical to SEQ ID NO: 26808
  misc_feature: Coding regions on vcDNA: vcDNA=SeqID_16600; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36904 - protein, 54 aa, Diabrotica virgifera
  misc_feature: Coding regions on vcDNA: vcDNA=SeqID_16601; Strand=-; Position=2-163
SSSLRVSQGLLREGKLQSECFDRFGDTNCGDVSWKSLYAINGSDGSSVNKGPKL

SEQ ID NO: 36905 - protein, 141 aa, Diabrotica virgifera
  misc_feature: Coding regions on vcDNA: vcDNA=SeqID_16602; Strand=+; Position=515-940
RLWIHVEDPSWNPVSSIIIIIFPQPLTSTGGLSLLHIFPLFPILCILIPFPTVFPSHPSTFLGSISVLSFSLVPIYEFLVPCYLYSKGYMSVPLHLVWAIFSGICHFDPQYPFGTYSFSYTTLSFIFFRYSNLLKYFSSMV

SEQ ID NO: 36906 - protein, 179 aa, Diabrotica virgifera
  misc_feature: Coding regions on vcDNA: vcDNA=SeqID_16603; Strand=+; Position=100-639
  misc_feature: Homolog annotation: Hit_ID=BAA97657.1; Match level="QueryCoverage =92%, HitCoverage=25%, E-value=2e-37, Identity=44%"; Hit description =ecdysteroid-inducible angiotensin-converting enzyme-related gene product [Bombyx mori]
  misc_feature: Gene Ontology Annotation: Molecular function=peptidyl-dipeptidase A activity; Cellular component=integral to membrane; Biological process=proteolysis and peptidolysis
MLFLSKRVTMVAVIAIILYFVLAASGKDPNIEEEEATAYNFIRVTNKKNEENLNKATIAEWNYASNITDYNLEISLNVSAEVAQQDKETWEQVKQFDWKRFSSTDLRRQFKSYSVIGSAALPEAEFKALKKHISDMESVYAQAKICDYNNKTNCDLALEPELTAILANSRDEKELKPYG

SEQ ID NO: 36907 - protein, 157 aa, Diabrotica virgifera
  misc_feature: Coding regions on vcDNA: vcDNA=SeqID_16604; Strand=+; Position=3-473
  misc_feature (1)..(5): Xaa can be any naturally occurring amino acid
  misc_feature (9)..(29): Xaa can be any naturally occurring amino acid
  misc_feature (108)..(115): Xaa can be any naturally occurring amino acid
XXXXXFFPXXXXXXXXXXXXXXXXXXXXXGGGPYVLPRAKKPQSWPGGTPPGGIPFLGKSPTTFPRGPEWGAVLTPVGGAPGGASPRGPNPLISPSTSSRGLLKGKSXXXXXXXXFLAFFFPAHRGSPRTFWKLPWKGGEGKGSLRVARKLPEIGKR

SEQ ID NO: 36908 - protein, 159 aa, Diabrotica virgifera
  misc_feature: Coding regions on vcDNA: vcDNA=SeqID_16605; Strand=-; Position=3-479
  misc_feature: Homolog annotation: Hit_ID=ZP_00263307.1; Match level="QueryCoverage =100%, HitCoverage=23%, E-value=3e-80, Identity=93%"; Hit description= COG1298: Flagellar biosynthesis pathway, component FlhA [Pseudomonas fluorescens PfO-1]
QNIIKVISQQEVARQQELLPSPARALETKELGWDDVTPIDMIGLEVGYRLIPLVDRNQGGQLLARIKGVRKKLSQDLGFLMPTVHIRDNLDLAPSAYRLTLMGVILAEAEIYPDRELAINPGQVFGSLNGITAKDPAFGLEAVWIEISQRSQAQSLGYT

SEQ ID NO: 36909 - protein, 77 aa, Diabrotica virgifera
  misc_feature: Coding regions on vcDNA: vcDNA=SeqID_16606; Strand=-; Position=3-233
  misc_feature (2)..(11): Xaa can be any naturally occurring amino acid
  misc_feature (15)..(22): Xaa can be any naturally occurring amino acid
  misc_feature (44)..(57): Xaa can be any naturally occurring amino acid
  misc_feature (64)..(76): Xaa can be any naturally occurring amino acid
SXXXXXXXXXXSFRXXXXXXXXDRNHPGSHRLNLRSGKILKVDXXXXXXXXXXXXXXSNIEVAXXXXXXXXXXXXXC

SEQ ID NO: 36910 - protein, 92 aa, Diabrotica virgifera
  misc_feature: Coding regions on vcDNA: vcDNA=SeqID_16607; Strand=-; Position=18-296
  misc_feature: Homolog annotation: Hit_ID=XP_397423.1; Match level="QueryCoverage =98%, HitCoverage=85%, E-value=3e-44, Identity=94%"; Hit description =similar to CG5827-PA [Apis mellifera]
  misc_feature: Pfam annotation: Pfam_ID=Ribosomal_L37ae; Match level="Score=208.6, E- value=1.2e-59, Copies=1"; Pfam description=Ribosomal L37ae protein family
MAKRTKKVGITGKYGTRYGASLRKMVKKMEITQHSKYSCSFCGKEAMKRSCVGIWSCKRCKRVVAGGAWVYSTTAAASVRSAVRRLREVKEQ

SEQ ID NO: 36911 - protein, 66 aa, Diabrotica virgifera; identical to SEQ ID NO: 26808
  misc_feature: Coding regions on vcDNA: vcDNA=SeqID_16608; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36912 - protein, 75 aa, Diabrotica virgifera
  misc_feature: Coding regions on vcDNA: vcDNA=SeqID_16609; Strand=-; Position=1-225
DYVFSTTFSDDLSFITFPFNFGINRYSGCCDSHRGGFVNIKSRLIVQRLLPRSDLQSATDRRKKLEEEGIRRRDG

SEQ ID NO: 36913 - protein, 233 aa, Diabrotica virgifera
  misc_feature: Coding regions on vcDNA: vcDNA=SeqID_16610; Strand=+; Position=104-802
  misc_feature: Homolog annotation: Hit_ID=XP_320960.1; Match level="QueryCoverage =92%, HitCoverage=40%, E-value=6e-43, Identity=42%"; Hit description =ENSANGP00000019855 [Anopheles gambiae]
MAMLLMVLSIAGSILLTPFLMLLVCIIFLASIGKSLGVRRLYVKTLLMIFEYGRKDIESSLNHRNKEVPEDIDEGYSEEITQSEKSAEEPPLANGLVNGGNNVISRDEGLIFVPEPPTSKTEEAVKEEKFKDYELSNVFEYVKAGVEAIIEDQVTSRFEAEELKNWNLLIRTNRGYEFISWKLTFLWLGGFFIRYFFLFPLRLIICCFGFLSLIISTFALSACPGRIWSKMGS

SEQ ID NO: 36914 - protein, 110 aa, Diabrotica virgifera
  misc_feature: Coding regions on vcDNA: vcDNA=SeqID_16611; Strand=-; Position=271-603
  misc_feature: Homolog annotation: Hit_ID=CAH59965.1; Match level="QueryCoverage =90%, HitCoverage=74%, E-value=1e-24, Identity=56%"; Hit description =cytochrome oxidase I [Hypolimnas bolina] emb|CAH59964.1| cytochrome oxidase I [Hypolimnas bolina] emb|CAH5
  misc_feature (1)..(9): Xaa can be any naturally occurring amino acid
  misc_feature (81)..(88): Xaa can be any naturally occurring amino acid
XXXXXXXXXRIGSPPPAGSKNDVFKFRSVNNIVIAPAKTGKDNRRRIAVITTAQTNRGIRSKVIPIGRILITVVIKLIAPXXXXXXXXCNLKIAKSTDGPPWAIFDDRGG

SEQ ID NO: 36915 - protein, 88 aa, Diabrotica virgifera
  misc_feature: Coding regions on vcDNA: vcDNA=SeqID_16612; Strand=+; Position=3-269
  misc_feature (3)..(24): Xaa can be any naturally occurring amino acid
  misc_feature (27)..(54): Xaa can be any naturally occurring amino acid
  misc_feature (77)..(83): Xaa can be any naturally occurring amino acid
PYXXXXXXXXXXXXXXXXXXXXXXGGXXXXXXXXXXXXXXXXXXXXXXXXXXXXLGITGNFFGEVKPKIKIATPRWXXXXXXXRHLFF

SEQ ID NO: 36916 - protein, 60 aa, Diabrotica virgifera
  misc_feature: Coding regions on vcDNA: vcDNA=SeqID_16613; Strand=+; Position=69-251
NELTYAMHSTFHRFSENTPSGSILRLGLHLVSRLSLTSYLVYDISSPSLCWANQSICLEI

SEQ ID NO: 36917 - protein, 110 aa, Diabrotica virgifera
  misc_feature: Coding regions on vcDNA: vcDNA=SeqID_16614; Strand=+; Position=3-332
  misc_feature (7)..(14): Xaa can be any naturally occurring amino acid
  misc_feature (55)..(61): Xaa can be any naturally occurring amino acid
  misc_feature (97)..(103): Xaa can be any naturally occurring amino acid
LLNLSYXXXXXXXXLFKYRQSKLNTWKEKRQTKREGGKNQKHPAQRKPGANNRNXXXXXXXKEKKPRSHKGQTTDPPPTPPEARGKTTPGTPGSNRXXXXXXXPAPRTPN

SEQ ID NO: 36918 - protein, 327 aa, Diabrotica virgifera
  misc_feature: Coding regions on vcDNA: vcDNA=SeqID_16615; Strand=+; Position=2-985
  misc_feature: Homolog annotation: Hit_ID=XP_317137.1; Match level="QueryCoverage =99%, HitCoverage=49%, E-value=9e-49, Identity=35%"; Hit description =ENSANGP00000018252 [Anopheles gambiae]
  misc_feature: Gene Ontology Annotation: Molecular function=molecular_function unknown; Biological process=reproduction
  misc_feature: Pfam annotation: Pfam_ID=DUF229; Match level="Score=41.5, E-value =7.6e-17, Copies=1"; Pfam description=Protein of unknown function (DUF229)
TCCYKTFWREDPDDDVADHKVRYSEDCQAFVNTTEVKEEFIKVTCSYNNRDIYTDLFAFVPVKNLSENVKNDLIQDESSLNILVLGLDAISRLNFHRQMPKTLSYLEQIGAVEMMGYNKVGDNTFPNLIPALTGKTVKEIENDCWPTKTHHFDKCPFIWKSYKQKGYVTAFDEDSSWVGTFNHIKNGFKKQPTDYAFNYFDFEAIRLLGNTGLETVEICQGARWVYKVHLNYLSNFVRTMEDNLLKYFGFFWQNSISHDDLNLPRIGDDHYYSMFKYFGKNGYFNITFLFVLSEHWNKKLVKIRKTFPGHGGKKRLPLPFCIFFPNW

SEQ ID NO: 36919 - protein, 92 aa, Diabrotica virgifera
  misc_feature: Coding regions on vcDNA: vcDNA=SeqID_16616; Strand=+; Position=1-279
YFCHTQQKSCTSGYEMKTVLLAFSVVTAISISALKVIERRLLYYIYFQGKLKVTMTVAVSCRLSFSVAKRDGRLKMRSCDDTTQRPISCLQL

SEQ ID NO: 36920 - protein, 40 aa, Diabrotica virgifera
  misc_feature: Coding regions on vcDNA: vcDNA=SeqID_16617; Strand=-; Position=1-120
  misc_feature (31)..(39): Xaa can be any naturally occurring amino acid
YSCYTNYKVCSTFKILHDLSLNRCEPGWFLXXXXXXXXXR

SEQ ID NO: 36921 - protein, 109 aa, Diabrotica virgifera
  misc_feature: Coding regions on vcDNA: vcDNA=SeqID_16618; Strand=+; Position=568-894
  misc_feature (36)..(43): Xaa can be any naturally occurring amino acid
  misc_feature (58)..(64): Xaa can be any naturally occurring amino acid
  misc_feature (83)..(93): Xaa can be any naturally occurring amino acid
AAKIFNPYVLENQFLTMGLVISYPKRFFCPHSKLIXXXXXXXXGLYPQIFRGGEILKXXXXXXXNPRAIFPYFRMEFFPNFYXXXXXXXXXXXWTLGHFFPLFFSLDFK

SEQ ID NO: 36922 - protein, 197 aa, Diabrotica virgifera
  misc_feature: Coding regions on vcDNA: vcDNA=SeqID_16619; Strand=+; Position=193-783
IYNYFKVSDCSMSRAQDLACLLKSLQLIAEACVKLQAEKAKFIWSNSSLRHAAESCSTACQKAPQFGGTNPPDLKDSIDRVSTVLHGLRVYTNVALGQKDTVTAISAEILKDTSNVLNKEDYKRPPQLKPEVLDSNNKVYTIELTEDDKKLLKRLDMEHRAKLIKEKDREENKDLSTREKEVKAKPVKEKEAAQITA

SEQ ID NO: 36923 - protein, 46 aa, Diabrotica virgifera
  misc_feature: Coding regions on vcDNA: vcDNA=SeqID_16620; Strand=-; Position=2-139
  misc_feature (3)..(10): Xaa can be any naturally occurring amino acid
  misc_feature (13)..(26): Xaa can be any naturally occurring amino acid
  misc_feature (32)..(45): Xaa can be any naturally occurring amino acid
LNXXXXXXXXSNXXXXXXXXXXXXXXPTSRSXXXXXXXXXXXXXXV

SEQ ID NO: 36924 - protein, 94 aa, Diabrotica virgifera
  misc_feature: Coding regions on vcDNA: vcDNA=SeqID_16621; Strand=+; Position=160-444
PFLKGPIASKLNLPCSYLLVDFLLLMQRTAYLLDCHTDIECALLFLLPGYRICTGHNLTIPSASSAYSAYSQARIQGGFNGVNCPLLEISLGVY

SEQ ID NO: 36925 - protein, 233 aa, Diabrotica virgifera
  misc_feature: Coding regions on vcDNA: vcDNA=SeqID_16622; Strand=+; Position=1-699
  misc_feature: Homolog annotation: Hit_ID=XP_394430.1; Match level="QueryCoverage =100%, HitCoverage=22%, E-value=1e-117, Identity=88%"; Hit description=similar to CG7915-PA [Apis mellifera]
  misc_feature: Pfam annotation: Pfam_ID=Arm; Match level="Score=25.9, E-value =0.00012, Copies=1"; Pfam description=Armadillo/beta-catenin-like repeat
DHSRVGTGILEHLFKHSEETCSDVVRLGGLDALLFECRKSDVETLRHCAGALANLSLYGGTENQEAMIKRKVPMWLFPLAFHTDDNIKYYACLAITVLVANPEIEAEVLQSGTLGLVEPFVTTHNPSEFAKSNLAHAHGQSKTWLKNLVPVLSSKREEARNLAAFHFCMEAGIKKQQGNTNMFSEIGAIESLKKVASCPNAVASKYAAPALRLIGEEVPHKLSQQVPLWSVED

SEQ ID NO: 36926 - protein, 98 aa, Diabrotica virgifera
  misc_feature: Coding regions on vcDNA: vcDNA=SeqID_16623; Strand=+; Position=2-298
  misc_feature: Homolog annotation: Hit_ID=AAL91655.1; Match level="QueryCoverage =78%, HitCoverage=15%, E-value=5e-10, Identity=41%"; Hit description =cytochrome P450 [Anopheles gambiae]
  misc_feature (14)..(20): Xaa can be any naturally occurring amino acid
GVIFIGRPVFEFRXXXXXXXGKDALNTLLAFTLDELSLNENIQKRLREEITENVRKINGITYDGLLEIKYLKGSVNEIVKKYPPIPYIDIMPLSEYTC

SEQ ID NO: 36927 - protein, 282 aa, Diabrotica virgifera
  misc_feature: Coding regions on vcDNA: vcDNA=SeqID_16624; Strand=+; Position=1-846
  misc_feature: Homolog annotation: Hit_ID=XP_392460.1; Match level="QueryCoverage =87%, HitCoverage=1%, E-value=1e-31, Identity=36%"; Hit description =similar to BMKETTIN [Apis mellifera]
TSHTSHKLYEQRDRHVQLEPFPFKPEPEKPRAKVAPPPSPSKFIKGGFRESDYESDYERRVNTTWSSNQEPQYKPVHPVLTPTKQHGQQYGRTPTPPTEFERPQAFGSSRPKFEPIKPETKPIPKHVVYKPKPMSAAPSDYVAQKGLVLQPGPPPEFGYTQGPTKTQYYKSTVSAPYTNAIQHETSNLVHFNESTENCHRTMSVQQTHKVIKFGDKYKKEGKLEPFPFQAGPEKPRRATSVPPPPTPTKFIPGDFRESDYESEVESSRIKQKWTPHGADDRN

SEQ ID NO: 36928 - protein, 208 aa, Diabrotica virgifera
  misc_feature: Coding regions on vcDNA: vcDNA=SeqID_16625; Strand=+; Position=52-675
IALAMEFKVEIKEECIEYNQKDIESQLSTSIDLETFKNEKEDNSEMGLKAEIKEEIADGCPEYIDSQQCISQDLEDSVKADEVNSVSAAPVSKAVEPLPVAVMPPSATMAPKTQSTILPTSAKDQDVDLRQLPAMMTKKRSSTEISEDVSMPAKKTKTQIFDKLFGDEDTDLRQQLDINTEQRPKIPLHRLFRIRYQTKNASPKRGSP

SEQ ID NO: 36929 - protein, 131 aa, Diabrotica virgifera
  misc_feature: Coding regions on vcDNA: vcDNA=SeqID_16626; Strand=+; Position=1-396
  misc_feature: Homolog annotation: Hit_ID=AAT38514.1; Match level="QueryCoverage =77%, HitCoverage=20%, E-value=6e-17, Identity=42%"; Hit description =antennae-rich cytochrome P450 [Phyllopertha diversa]
  misc_feature (109)..(125): Xaa can be any naturally occurring amino acid
LKVDGPKPMPFYGNFYDIVKMKSTIAQSLKQLYDYTDAPYVGIYVFDKPVLLLRSPELIGDILVKDSHLFLDKTIVMPKHNVLTQNFLFFQTMPKWKENRTKFTPCFSXXXXXXXXXXXXXXXXXLEPIYC

SEQ ID NO: 36930 - protein, 178 aa, Diabrotica virgifera
  misc_feature: Coding regions on vcDNA: vcDNA=SeqID_16627; Strand=+; Position=65-598
  misc_feature: Homolog annotation: Hit_ID=NP_443160.1; Match level="QueryCoverage =55%, HitCoverage=12%, E-value=1e-14, Identity=39%"; Hit description =SET and MYND domain containing 4 [Homo sapiens] gb|AAH35077.1| SET and MYND domain containing 4
  misc_feature (145)..(155): Xaa can be any naturally occurring amino acid
MDCLLAYYNEKFTKIDGNIFDVFSKFYNLDLTPVDSWLENQFKNKVAKDNRTSIHYRKEGNKCYAQKNLLRSLEFYTKSLCNATPGSREYGLALANRSAVSFEMKEYENCLKDIDLCFKTDYPVDLIPKIYFRKADCFVETGQKXXXXXXXXXXXKFLSITLVDDRDKHFEKFKTDEK

SEQ ID NO: 36931 - protein, 169 aa, Diabrotica virgifera
  misc_feature: Coding regions on vcDNA: vcDNA=SeqID_16628; Strand=+; Position=183-689
  misc_feature (13)..(37): Xaa can be any naturally occurring amino acid
  misc_feature (39)..(60): Xaa can be any naturally occurring amino acid
  misc_feature (67)..(90): Xaa can be any naturally occurring amino acid
  misc_feature (126)..(140): Xaa can be any naturally occurring amino acid
  misc_feature (153)..(166): Xaa can be any naturally occurring amino acid
NYAVIPKVIYSYXXXXXXXXXXXXXXXXXXXXXXXXXPXXXXXXXXXXXXXXXXXXXXXXSIGSSRXXXXXXXXXXXXXXXXXXXXXXXXLPPLHSQFSIKKLNDYATFTPGKIPAAIPIYPGGRXXXXXXXXXXXXXXXGEKNVAKFFFKPXXXXXXXXXXXXXXPLP

SEQ ID NO: 36932 - protein, 77 aa, Diabrotica virgifera
  misc_feature: Coding regions on vcDNA: vcDNA=SeqID_16629; Strand=-; Position=2-232
  misc_feature (2)..(10): Xaa can be any naturally occurring amino acid
  misc_feature (13)..(22): Xaa can be any naturally occurring amino acid
  misc_feature (34)..(41): Xaa can be any naturally occurring amino acid
  misc_feature (44)..(57): Xaa can be any naturally occurring amino acid
  misc_feature (63)..(76): Xaa can be any naturally occurring amino acid
SXXXXXXXXXVLXXXXXXXXXXIETNLAHTGLNXXXXXXXXSNXXXXXXXXXXXXXXPTSRSXXXXXXXXXXXXXXV

SEQ ID NO: 36933 - protein, 81 aa, Diabrotica virgifera
  misc_feature: Coding regions on vcDNA: vcDNA=SeqID_16630; Strand=-; Position=604-849
SVMIHVSTAMLLYRMFHCENKLRLTVERGHLGGLKNTTLNESYPINNKDTGCLIYFATFLIGSQLFNHTVYLPHTWQANII

SEQ ID NO: 36934 - protein, 84 aa, Diabrotica virgifera
  misc_feature: Coding regions on vcDNA: vcDNA=SeqID_16631; Strand=-; Position=47-301
  misc_feature (41)..(48): Xaa can be any naturally occurring amino acid
SRTSSIVKITVHLLDEIFSMFTKNFHKSSTVTIVMVAFRCXXXXXXXXKIVRLYFFYDLHKIWNVMYIFLQFIHISLAEDVNIS

SEQ ID NO: 36935 - protein, 165 aa, Diabrotica virgifera
  misc_feature: Coding regions on vcDNA: vcDNA=SeqID_16632; Strand=+; Position=1-495
  misc_feature: Homolog annotation: Hit_ID=XP_316460.1; Match level="QueryCoverage =95%, HitCoverage=71%, E-value=2e-54, Identity=59%"; Hit description =ENSANGP00000025056 [Anopheles gambiae]
  misc_feature: Gene Ontology Annotation: Cellular component=endoplasmic reticulum; Biological process=aging
  misc_feature: Pfam annotation: Pfam_ID=Glyco_hydro_1; Match level="Score=-117.3, E -value=8.2e-13, Copies=1"; Pfam description=Glycosyl hydrolase family 1
EEFPKDFLFGIASSAYQIEGGYNADGKGESIYDYYTKTKHARFYNNSNGNIACDSYHKWRADVRLLKDLGVQFYRFSISWSRVLPKGYSNKVNPDGLRYYNDLINELKKNGIEPMVTLYHNDLPMPLQEIGGWTNPYTAYYFEDYARYMFSYFGDRVKYWNNNGN

SEQ ID NO: 36936 - protein, 93 aa, Diabrotica virgifera
  misc_feature: Coding regions on vcDNA: vcDNA=SeqID_16633; Strand=+; Position=21-302
  misc_feature (76)..(82): Xaa can be any naturally occurring amino acid
VYLTGFHRCLCFHTLRAQPNLDLECLILTFRLLLRQLTKDIVKYDEATIGVFFWLLLSTKSASGDSGGTQFVKMEXXXXXXXTSVCYYCLYLS

SEQ ID NO: 36937 - protein, 44 aa, Diabrotica virgifera
  misc_feature: Coding regions on vcDNA: vcDNA=SeqID_16634; Strand=-; Position=1-132
  misc_feature (1)..(8): Xaa can be any naturally occurring amino acid
  misc_feature (11)..(18): Xaa can be any naturally occurring amino acid
  misc_feature (35)..(35): Xaa can be any naturally occurring amino acid
XXXXXXXXSNXXXXXXXXPIINLIQHRGRNLYYRXELSNKITLL

SEQ ID NO: 36938 - protein, 122 aa, Diabrotica virgifera
  misc_feature: Coding regions on vcDNA: vcDNA=SeqID_16635; Strand=+; Position=635 -1003
  misc_feature (17)..(35): Xaa can be any naturally occurring amino acid
  misc_feature (51)..(60): Xaa can be any naturally occurring amino acid
KFSQGYRNERIDTPSPXXXXXXXXXXXXXXXXXXXQGKIFPGQNNLQIFYXXXXXXXXXXSKRTPGLTTRGWGRLTSFYRGPQNSISLGRRFSNGRGGEKPRGVPHFNSPWSTFPPFPRGGE

SEQ ID NO: 36939 - protein, 261 aa, Diabrotica virgifera
  misc_feature: Coding regions on vcDNA: vcDNA=SeqID_16636; Strand=+; Position=27-809
  misc_feature: Homolog annotation: Hit_ID=NP_611335.1; Match level="QueryCoverage =78%, HitCoverage=45%, E-value=5e-44, Identity=42%"; Hit description =CG5190-PA [Drosophila melanogaster] gb|AAF57683.1| CG5190-PA [Drosophila melanogaster]
MFLMSKTFNIISRTVAGTSNTKIVKIIFPFISERQNTSINYVKRHCSTVANKEEDINYNDVTNGDKELEHKLKVLMLEAEVMRQEGKAVPEHNFLREKHWKEILNLSSRSARQKYLEYLFKLSKRKENQKAKKEEKRLAFEEYLSKKEAEPKKEETLEEFALKYDLQHNNLFLRIYETTINQLYNNRLIQAMQFGQKLVIDCGYDVNMTKRENMNCAKQFMLLFAENRLHDDPFDIHFCNADKKSDLIKQFYKYVPTIDEP

SEQ ID NO: 36940 - protein, 217 aa, Diabrotica virgifera
  misc_feature: Coding regions on vcDNA: vcDNA=SeqID_16637; Strand=+; Position=21-674
  misc_feature: Homolog annotation: Hit_ID=AAO15464.1; Match level="QueryCoverage =93%, HitCoverage=99%, E-value=3e-91, Identity=79%"; Hit description =60S ribosomal protein L15 [Spodoptera frugiperda]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L15e; Match level="Score=368.1, E -value=1.2e-107, Copies=1"; Pfam description=Ribosomal L15
  misc_feature (81)..(93): Xaa can be any naturally occurring amino acid
  misc_feature (126)..(132): Xaa can be any naturally occurring amino acid
  misc_feature (204)..(204): Xaa can be any naturally occurring amino acid
MGAYKYIQELYRKKQSDVLRFLLRVRVWQYRQLTKLHRTPRPSRPDKARRMGYRAKQGFVIYRIRVRRGGRKRPVPKGATXXXXXXXXXXXXXPVRNLQAIAEERVGRRCGGLRVLNSYWVAQDSXXXXXXXILVDPSHNAIRKDPKINWIVNSVHKHRELRGKTSSGKSSRGLGKGHRYSQTKGGSRRAAWLRRNSLQLRRKXTNKIYGLILLHES

SEQ ID NO: 36941 - protein, 175 aa, Diabrotica virgifera
  misc_feature: Coding regions on vcDNA: vcDNA=SeqID_16638; Strand=-; Position=1-523
  misc_feature: Homolog annotation: Hit_ID=NP_883918.1; Match level="QueryCoverage =97%, HitCoverage=16%, E-value=9e-61, Identity=70%"; Hit description =putative DNA polymerase III alpha chain [Bordetella parapertussis 12822] emb|CAE36941.1| putative
  misc_feature: Pfam annotation: Pfam_ID=PHP_N; Match level="Score=22.1, E-value =0.00011, Copies=1"; Pfam description=PHP domain N-terminal region
  misc_feature (13)..(13): Xaa can be any naturally occurring amino acid
MPVGTFSFLQGAXSHPEELAARAAELGYAALAITDECSLAGVVRAHMEAKTQKLPLIIGATFRLRAGPEAAPLDLTLLAQTREGYGNLSELITLARTRAPKGEYRLAPEDFTAPPPGYEHLRHLPECLAILSPVYGDDPDRMARQARWLAATFPHRAWVGLTLLYRSRDDLHRAA

SEQ ID NO: 36942 - protein, 145 aa, Diabrotica virgifera
  misc_feature: Coding regions on vcDNA: vcDNA=SeqID_16639; Strand=+; Position=154-588
  misc_feature: Homolog annotation: Hit_ID=XP_314275.1; Match level="QueryCoverage =82%, HitCoverage=47%, E-value=7e-17, Identity=42%"; Hit description =ENSANGP00000025264 [Anopheles gambiae]
WAPQSLKSKVMGTPEFETCRIIVTDLNLPLTPAEFLKKYEDKVWIELQRPELLPGVKDVVKLFHKHDVPIAIATSSREPIMKMKTKPHRELINLFPPCRLWQFRPRSQKLQSPAPDIFFSAGITISHINHHPFQAPRSQRPSPRP

SEQ ID NO: 36943 - protein, 130 aa, Diabrotica virgifera
  misc_feature: Coding regions on vcDNA: vcDNA=SeqID_16640; Strand=+; Position=62-454
  misc_feature: Homolog annotation: Hit_ID=AAV91386.1; Match level="QueryCoverage =90%, HitCoverage=54%, E-value=2e-53, Identity=88%"; Hit description =ribosomal protein L1 [Lonomia obliqua]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L1; Match level="Score=-9.8, E -value=1.3e-09, Copies=1"; Pfam description=Ribosomal protein L1p/L10e family
  misc_feature (1)..(8): Xaa can be any naturally occurring amino acid
XXXXXXXXVKKLAKKYDAFLASEALIKQIPRLLGPGLNKAGKFPGLLSHQESMTQKIDEVKATIKFQMKKVLCLSVAVGHESMNQDELVQNVHLSINFLGSLVKKHWRNVRPLHVKSSMGHPQRVYLHVL

SEQ ID NO: 36944 - protein, 124 aa, Diabrotica virgifera
  misc_feature: Coding regions on vcDNA: vcDNA=SeqID_16641; Strand=-; Position=115-489
SIYHLSTSDEEEVPLEKKKFLKSIKKVKKKFGRPEKLCLQMVFSIDQVKVILVMMKVTVQKSHHLRLRLYWAPRTQFNLIKDIGMSRNRFESLRNNLHNMYLMTFEISSQMSTPTRLITINFGK

SEQ ID NO: 36945 - protein, 86 aa, Diabrotica virgifera
  misc_feature: Coding regions on vcDNA: vcDNA=SeqID_16642; Strand=-; Position=9-269
LHLALVGSSLNIQSFLFVVHHLPTSLRAKQFLHGSSTTSLTSNTIALLCVQISHSCSACPCRLVSGSLFTFSTITDPKALDSHYGG

SEQ ID NO: 36946 - protein, 135 aa, Diabrotica virgifera
  misc_feature: Coding regions on vcDNA: vcDNA=SeqID_16643; Strand=+; Position=2-409
  misc_feature: Homolog annotation: Hit_ID=EAL39934.1; Match level="QueryCoverage =92%, HitCoverage=16%, E-value=7e-09, Identity=26%"; Hit description =ENSANGP00000028171 [Anopheles gambiae str. PEST] ref|XP_556470.1| ENSANGP00000028171 [Anopheles gambiae st
  misc_feature (57)..(63): Xaa can be any naturally occurring amino acid
  misc_feature (116)..(116): Xaa can be any naturally occurring amino acid
SFSEDNLGTIITNSEGIAATWKQYCEILFHSDHEDVNLEEINDEKEPHILKSEIETXXXXXXXRKSRGEDGITAEALKEMGDIGVEVMFKLCNEIWNTGKWPDDWCKFTFIPIYKXGSPTDCNNYRTIALISPRK

SEQ ID NO: 36947 - protein, 66 aa, Diabrotica virgifera; identical to SEQ ID NO: 26808
  misc_feature: Coding regions on vcDNA: vcDNA=SeqID_16644; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36948 - protein, 144 aa, Diabrotica virgifera
  misc_feature: Coding regions on vcDNA: vcDNA=SeqID_16645; Strand=-; Position=1-432
NYPPGASLYITDEALATEYERDNHTTVTGSQGNVIPTTNQPAWPAWCFKAIFPKLIMSNLQQSGYGPQVGRRNPESHIGKPISLMDSGGGKSSTRTNKRKRKKKECNRIHIATYNIRSMAQDEKLYKLEKELTKIKWDIVGLSE

SEQ ID NO: 36949 - protein, 60 aa, Diabrotica virgifera
  misc_feature: Coding regions on vcDNA: vcDNA=SeqID_16646; Strand=-; Position=122-304
KEILTKGGLLRFFSSYFLRHISYGFGSPLTAFRTSHLVCLLQQVLVDGEYVWFQNNLRLC

SEQ ID NO: 36950 - protein, 70 aa, Diabrotica virgifera
  misc_feature: Coding regions on vcDNA: vcDNA=SeqID_16647; Strand=-; Position=17-229
IMTETSQQNIFVRLNSYCVKRTSESKLPHEKTLSRSKFLQCETALRDLPPSTVNILFKKRKRYNIYEDPI

SEQ ID NO: 36951 - protein, 228 aa, Diabrotica virgifera
  misc_feature: Coding regions on vcDNA: vcDNA=SeqID_16648; Strand=+; Position=49-736
  misc_feature: Homolog annotation: Hit_ID=XP_393722.1; Match level="QueryCoverage =100%, HitCoverage=85%, E-value=3e-64, Identity=50%"; Hit description= similar to ENSANGP00000020357 [Apis mellifera]
  misc_feature: Gene Ontology Annotation: Molecular function=snoRNA binding; Cellular component=small nucleolar ribonucleoprotein complex; Biological process=rRNA processing
  misc_feature (161)..(170): Xaa can be any naturally occurring amino acid
  misc_feature (185)..(185): Xaa can be any naturally occurring amino acid
MAQCKIHNIRFYNPEPQGIRCMKIQNSTKKLALCRTDATIEIWNLQETWFLERTLAPSTENFSVEDIVWCDNRLFSVGLHGLLIEYNLSKLCIENRWAVTGEAAHCLDINNTNSKIAIGTEQGYLNIFSVNKDGVYFEKFLDKQEGRIMCLKFDATGDFIXXXXXXXXXXWNVQSGHAISKMTTXRVETNKPTIVWCIDITDDFTVIGGDPRGKLAFWDGKVGSKTKS

SEQ ID NO: 36952 - protein, 46 aa, Diabrotica virgifera
  misc_feature: Coding regions on vcDNA: vcDNA=SeqID_16649; Strand=+; Position=45-185
  misc_feature (38)..(44): Xaa can be any naturally occurring amino acid
PAYFNDSYVQLPKMLPTSLDPRHYVIINEPTAVVIAHXXXXXXXGD

SEQ ID NO: 36953 - protein, 23 aa, Diabrotica virgifera
  misc_feature: Coding regions on vcDNA: vcDNA=SeqID_16650; Strand=-; Position=2-70
LLNICNMMQSSLRKGSAYVEQVS

SEQ ID NO: 36954 - protein, 99 aa, Diabrotica virgifera
  misc_feature: Coding regions on vcDNA: vcDNA=SeqID_16651; Strand=-; Position=71-370
  misc_feature: Homolog annotation: Hit_ID=NP_610363.1; Match level="QueryCoverage =90%, HitCoverage=55%, E-value=3e-30, Identity=66%"; Hit description =CG14757-PA [Drosophila melanogaster] gb|AAF59116.2| CG14757-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=TPR_div1; Match level="Score=116.6, E-value =6e-32, Copies=1"; Pfam description=TPR repeat region
GAKRLREGARLLYQSRKRGMLENDLLLSTFVAKHLKAFDKEQLEKYDRLINGPSNDWELYYWATNMKETPEEYNHDVMDLLKVHCQNLHKESRIRQPDL

SEQ ID NO: 36955 - protein, 48 aa, Diabrotica virgifera
  misc_feature: Coding regions on vcDNA: vcDNA=SeqID_16652; Strand=-; Position=41-187
IIKHHRPKKVQNFFIYYNNGKKIWKIVPIYLWKLFLYPIYNFCDQPNR

SEQ ID NO: 36956 - protein, 48 aa, Diabrotica virgifera
  misc_feature: Coding regions on vcDNA: vcDNA=SeqID_16653; Strand=+; Position=1-147
  misc_feature: Homolog annotation: Hit_ID=NP_610939.2; Match level="QueryCoverage =100%, HitCoverage=33%, E-value=1e-14, Identity=85%"; Hit description= CG8415-PA [Drosophila melanogaster] gb|EAL26343.1| GA21060-PA [Drosophila
  misc_feature: Gene Ontology Annotation: Cellular component=cytosolic ribosome (sensu Eukarya); Biological process=protein biosynthesis
  misc_feature (39)..(45): Xaa can be any naturally occurring amino acid
ENDEVLVAGFGRKGHAVGDIPGVRFKVVKVANVSLLALXXXXXXXPRS

SEQ ID NO: 36957 - protein, 24 aa, Diabrotica virgifera
  misc_feature: Coding regions on vcDNA: vcDNA=SeqID_16654; Strand=+; Position=1-72
  misc_feature (4)..(10): Xaa can be any naturally occurring amino acid
PHIXXXXXXXGGRSRSKTSQSFLK

SEQ ID NO: 36958 - protein, 102 aa, Diabrotica virgifera
  misc_feature: Coding regions on vcDNA: vcDNA=SeqID_16655; Strand=-; Position=48-353
GNSKEDVDFWEFKQQGLNYLFHYDALEDKAFYLSLENRAQCQDTDVWYTEEGYIVSTKPLKSKDMESKGLALRTKGGVKGGVKGGAIKAGASVSHDYFTVRT

SEQ ID NO: 36959 - protein, 126 aa, Diabrotica virgifera
  misc_feature: Coding regions on vcDNA: vcDNA=SeqID_16656; Strand=+; Position=2-382
  misc_feature: Homolog annotation: Hit_ID=NP_987686.1; Match level="QueryCoverage =86%, HitCoverage=19%, E-value=2e-12, Identity=32%"; Hit description =Acyl-CoA synthetases (AMP-forming)/AMP-acid ligases II related protein [Methanococcus
ELGMEPKDRIGMMIHNSVESIVANFACIRGGFVAVNLNPALQPRELEHCMKITQMKCLIIVDRYKVFNILGILQKVIPEIEDTVYNPIEAKEFPHFKRVVMIDDQLHKGTCCFKSEIAMANATRQK

SEQ ID NO: 36960 - protein, 76 aa, Diabrotica virgifera
  misc_feature: Coding regions on vcDNA: vcDNA=SeqID_16657; Strand=-; Position=3-230
  misc_feature (14)..(22): Xaa can be any naturally occurring amino acid
  misc_feature (33)..(41): Xaa can be any naturally occurring amino acid
  misc_feature (43)..(56): Xaa can be any naturally occurring amino acid
  misc_feature (63)..(75): Xaa can be any naturally occurring amino acid
KYLEFRYMFSPIRXXXXXXXXXGNQPGSHRFKXXXXXXXXXEXXXXXXXXXXXXXXSNIEVAXXXXXXXXXXXXXC

SEQ ID NO: 36961 - protein, 66 aa, Diabrotica virgifera; identical to SEQ ID NO: 26808
  misc_feature: Coding regions on vcDNA: vcDNA=SeqID_16658; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 36962 - protein, 52 aa, Diabrotica virgifera
  misc_feature: Coding regions on vcDNA: vcDNA=SeqID_16659; Strand=+; Position=3-161
  misc_feature (2)..(2): Xaa can be any naturally occurring amino acid
  misc_feature (4)..(4): Xaa can be any naturally occurring amino acid
TXLXEGKRGPLLHSYFIQVLILRNVFPSAGNYSLFSPESIDIIPPRATPRHE

SEQ ID NO: 36963 - protein, 156 aa, Diabrotica virgifera
  misc_feature: Coding regions on vcDNA: vcDNA=SeqID_16660; Strand=+; Position=93-560
  misc_feature (14)..(21): Xaa can be any naturally occurring amino acid
IFLRMTLKITFYYXXXXXXXXRSNILPFYNMLLFLPTHYTYHVLSHPHPHPTFTSPNLRPTPLQPLSISTILKNQLSLIKRIPPPSFSSLLIQHHAPFPLSPPPPPLAYRSHPACAARLPPSRPPSPPSPLSLFFGTLQLNRFRLLTPPSLPFPSS

SEQ ID NO: 36964 - protein, 96 aa, Diabrotica virgifera
  misc_feature: Coding regions on vcDNA: vcDNA=SeqID_16661; Strand=+; Position=45-335
SLYILFFLSDIGNNVEKFYPEPFFAEYFRFKSFERNFLFKNDTFCEWPFYFSGECMTLYAETYYLWILHVVIDIGVRQVLELETDRLKNLTKFRLK

SEQ ID NO: 36965 - protein, 41 aa, Diabrotica virgifera
  misc_feature: Coding regions on vcDNA: vcDNA=SeqID_16662; Strand=+; Position=1-123
  misc_feature (34)..(41): Xaa can be any naturally occurring amino acid
LKSDHPNQPHGRIKRKEDRLNRCCLYSLYIQNIXXXXXXXX

SEQ ID NO: 36966 - protein, 93 aa, Diabrotica virgifera
  misc_feature: Coding regions on vcDNA: vcDNA=SeqID_16663; Strand=+; Position=55-333
  misc_feature (83)..(83): Xaa can be any naturally occurring amino acid
FLGRKKEEGKDFKRKTPAARASRKARGKTHEKAGNRNNNRTPRNPKDTQPRHKPEGTKGAANGNDPGTTNTGAAATEGKQAKXTENAEGARTT

SEQ ID NO: 36967 - protein, 108 aa, Diabrotica virgifera
  misc_feature: Coding regions on vcDNA: vcDNA=SeqID_16664; Strand=+; Position=380-703
  misc_feature: Homolog annotation: Hit_ID=NP_573129.1; Match level="QueryCoverage =97%, HitCoverage=23%, E-value=2e-18, Identity=44%"; Hit description =CG4420-PA [Drosophila melanogaster] gb|AAF48614.1| CG4420-PA [Drosophila melanogaster]
  misc_feature: Pfam annotation: Pfam_ID=ubiquitin; Match level="Score=36.6, E-value =7.2e-08, Copies=1"; Pfam description=Ubiquitin family
  misc_feature (58)..(58): Xaa can be any naturally occurring amino acid
MKVTVTTLTDFIFVLDVSEDLELENFKAFCEIESGFPASEIAIAFNGMPLMDNKKSLXDFGINDGDAVILQHIQSESQMDQSGNLDFSNIEIPNTTNNTRKPPRKRRP

SEQ ID NO: 36968 - protein, 71 aa, Diabrotica virgifera
  misc_feature: Coding regions on vcDNA: vcDNA=SeqID_16665; Strand=+; Position=51-266
  misc_feature: Homolog annotation: Hit_ID=CAE47499.1; Match level="QueryCoverage =76%, HitCoverage=17%, E-value=7e-25, Identity=92%"; Hit description =cathepsin L-like proteinase [Diabrotica virgifera virgifera]
  misc_feature: Gene Ontology Annotation: Molecular function=lysosomal cysteine-type endopeptidase; Cellular component=extracellular space; Biological process=proteolysis and peptidolysis
  misc_feature (61)..(61): Xaa can be any naturally occurring amino acid
LSHEFLINHAVLAVGYGSENGKDFWLIKNSWDTYWGEAGYLRLVRGTNQCGINEVADYPLXYLTVYIMKHE

SEQ ID NO: 36969 - protein, 128 aa, Diabrotica virgifera
  misc_feature: Coding regions on vcDNA: vcDNA=SeqID_16666; Strand=-; Position=29-412
  misc_feature: Homolog annotation: Hit_ID=XP_394621.1; Match level="QueryCoverage =74%, HitCoverage=7%, E-value=7e-12, Identity=40%"; Hit description =similar to ENSANGP00000019991 [Apis mellifera]
RPIYAVQPGDPTATEPVQRGGEKKPFDKKLYRLKKYSNKYKLQQWEDNRKKAVLRDFYKIKSPKESVDVSTIYNDPRYKDSDEELDAESEQTTNQNVPVTKPEEAESTLKREPQKKYNPIQRNSDQDE

SEQ ID NO: 36970 - protein, 44 aa, Diabrotica virgifera
  misc_feature: Coding regions on vcDNA: vcDNA=SeqID_16667; Strand=-; Position=1-132
GEGGGEGVGEARWGDGRCRWVMVDRIIGTECKGLESIICEKMYK

SEQ ID NO: 36971 - protein, 103 aa, Diabrotica virgifera
  misc_feature: Coding regions on vcDNA: vcDNA=SeqID_16668; Strand=+; Position=157-465
  misc_feature: Homolog annotation: Hit_ID=CAA46283.1; Match level="QueryCoverage =100%, HitCoverage=41%, E-value=1e-12, Identity=38%"; Hit description= extensin [Volvox carteri] pir||S22697 extensin - Volvox carteri (fragment)
  misc_feature (37)..(44): Xaa can be any naturally occurring amino acid
  misc_feature (50)..(56): Xaa can be any naturally occurring amino acid
AGPLTPPPPRFLNAAEPFYQPVNSPPTHLYLRSTFSXXXXXXXXPPYASXXXXXXXPPPPPPPPTPTPPPLPISPPCPPPTPSTSSPLPLPVPPLLCPPSSPP

SEQ ID NO: 36972 - protein, 181 aa, Diabrotica virgifera
  misc_feature: Coding regions on vcDNA: vcDNA=SeqID_16669; Strand=+; Position=2-547
  misc_feature: Homolog annotation: Hit_ID=XP_313462.1; Match level="QueryCoverage =100%, HitCoverage=23%, E-value=9e-81, Identity=83%"; Hit description= ENSANGP00000019635 [Anopheles gambiae]
  misc_feature: Pfam annotation: Pfam_ID=ABC2_membrane; Match level="Score=-19.7, E -value=0.022, Copies=1"; Pfam description=ABC-2 type transporter
ALTSSALIIERMEGLLDRSWVAGVTPSEILFSHVITQFVVMCGQTTLVLIFMIIVFQVECKGDIFLVVVITILQGLCGMCFGFVISAICELERNAIQLALGSFYPTLLLSGVIWPIEGMPTVLRYISTFLPLTLATTSLRSMMTRGWSIGEPDVYYGFIATIVWIVLFLTISLLVLRSKRG

SEQ ID NO: 36973 - protein, 124 aa, Diabrotica virgifera
  misc_feature: Coding regions on vcDNA: vcDNA=SeqID_16670; Strand=+; Position=3-377
  misc_feature: Homolog annotation: Hit_ID=XP_311106.1; Match level="QueryCoverage =97%, HitCoverage=19%, E-value=9e-57, Identity=81%"; Hit description =ENSANGP00000022469 [Anopheles gambiae]
  misc_feature: Gene Ontology Annotation: Molecular function=chromatin binding; Cellular component=integral to membrane; Biological process=anti -apoptosis
DLWSGGVSEKPLPGSILGPTFACIIATQFSYSRRGDRFWYELPNQPSSFTPEQLQEIRKVRLARLICDNTDLIDTVQLYPMVLPDHEINPRVPCKSGIIPSLDLSKWAHFPHEHAFQLNDILGK

SEQ ID NO: 36974 - protein, 51 aa, Diabrotica virgifera
  misc_feature: Coding regions on vcDNA: vcDNA=SeqID_16671; Strand=+; Position=3-155
WATMMGAAARARGFFLAGKSIENVGSESLKSETYYMHPFCNALPKLLHRSV

SEQ ID NO: 36975 - protein, 130 aa, Diabrotica virgifera
  misc_feature: Coding regions on vcDNA: vcDNA=SeqID_16672; Strand=+; Position=18-407
  misc_feature: Homolog annotation: Hit_ID=XP_392382.1; Match level="QueryCoverage =80%, HitCoverage=9%, E-value=9e-25, Identity=52%"; Hit description =similar to Hypoxia-inducible factor 1 alpha (HIF-1 alpha) (HIF1 alpha) (ARNT interacting
  misc_feature: Gene Ontology Annotation: Molecular function=transcription factor activity; Cellular component=nucleus; Biological process =transcription from Pol II promoter
  misc_feature: Pfam annotation: Pfam_ID=HLH; Match level="Score=7.9, E-value=0.024, Copies=1"; Pfam description=Helix-loop-helix DNA-binding domain
TIEDSRNPPVLFHCQLQLGQNNEKRKEKSRNAARCRRSKETELYLDLASSLPFSSEQISQLDKASVMRLAISYLKIRNMMTAVPDFITSNETKSQEDSMAFLKSLDGYVMILSDEGDFGYIADTVHRISL

SEQ ID NO: 36976 - protein, 298 aa, Diabrotica virgifera
  misc_feature: Coding regions on vcDNA: vcDNA=SeqID_16673; Strand=-; Position=1-894
  misc_feature (42)..(291): Xaa can be any naturally occurring amino acid
REEQNEREKGVPQIRNYKSTRRAQSFIWIGLSNKIPLLSLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAQITFHY

SEQ ID NO: 36977 - protein, 238 aa, Diabrotica virgifera
  misc_feature: Coding regions on vcDNA: vcDNA=SeqID_16674; Strand=+; Position=89-805
  misc_feature: Homolog annotation: Hit_ID=NP_650144.1; Match level="QueryCoverage =90%, HitCoverage=18%, E-value=7e-18, Identity=29%"; Hit description =CG3532-PA [Drosophila melanogaster] gb|AAF54739.2| CG3532-PA [Drosophila melanogaster]
  misc_feature: Gene Ontology Annotation: Molecular function=structural constituent of cytoskeleton; Cellular component=hemidesmosome; Biological process=intermediate filament cytoskeleton organization and biogenesis
MESAVTNDTNKKSILENLTKEELVKKCTQLLQIAQKAKQSKSTLQEENSKLKAELNKKNTDPDPALQEYIDNLTQQKLNLVTDNQSLKTKNETLSKRIEEYEVQLKECEEKLNTCDNENTSYKRQIRRLTDENEQLIVDLETLEKQLAIAKEKVSDEANLIDLSESKEKDEKRQELEKMLSISLEEIGLNDKIEVLKNNLGEKDKSILTISQELVLSKSLIEKFEGLNKKKEVHRSKE

SEQ ID NO: 36978 - protein, 139 aa, Diabrotica virgifera
  misc_feature: Coding regions on vcDNA: vcDNA=SeqID_16675; Strand=+; Position=249-668
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLPSHGQNTAAIQINQWAGETLYLIQKDMFLINR

SEQ ID NO: 36979 - protein, 104 aa, Diabrotica virgifera
  misc_feature: Coding regions on vcDNA: vcDNA=SeqID_16676; Strand=+; Position=438-749
  misc_feature (29)..(55): Xaa can be any naturally occurring amino acid
RYGTHPRPRNRNEYTLMPLTRINWRGSLXXXXXXXXXXXXXXXXXXXXXXXXXXXSHVAGSSYAVQLAWRGTPNGGLYSQGGPFQPPRDVLSDSPPFPPPLPHP

SEQ ID NO: 36980 - protein, 86 aa, Diabrotica virgifera
  misc_feature: Coding regions on vcDNA: vcDNA=SeqID_16677; Strand=-; Position=90-350
VDLDVVGLVVTFMVECICSVTASTILSTVLLIFIPIWESTDVGRRCSSAFLEDISAGMNDRKMPFNAFPISFELYGTMWCHLHRFS

SEQ ID NO: 36981 - protein, 81 aa, Diabrotica virgifera
  misc_feature: Coding regions on vcDNA: vcDNA=SeqID_16678; Strand=+; Position=322-567
NRPENLLCNSRIKLEIRLGLSKCYVWSTLLYAVETWTLKTSTVNKLEAFEMWIYRRILKISWTSHTSNEEVLHRIGKASES

SEQ ID NO: 36982 - protein, 351 aa, Diabrotica virgifera
  misc_feature: Coding regions on vcDNA: vcDNA=SeqID_16679; Strand=-; Position=0-1052
  misc_feature (11)..(41): Xaa can be any naturally occurring amino acid
  misc_feature (47)..(60): Xaa can be any naturally occurring amino acid
  misc_feature (64)..(79): Xaa can be any naturally occurring amino acid
  misc_feature (82)..(115): Xaa can be any naturally occurring amino acid
  misc_feature (133)..(133): Xaa can be any naturally occurring amino acid
  misc_feature (138)..(148): Xaa can be any naturally occurring amino acid
  misc_feature (161)..(175): Xaa can be any naturally occurring amino acid
  misc_feature (185)..(197): Xaa can be any naturally occurring amino acid
  misc_feature (204)..(216): Xaa can be any naturally occurring amino acid
  misc_feature (219)..(268): Xaa can be any naturally occurring amino acid
  misc_feature (270)..(270): Xaa can be any naturally occurring amino acid
  misc_feature (272)..(333): Xaa can be any naturally occurring amino acid
  misc_feature (335)..(348): Xaa can be any naturally occurring amino acid
SPPPLPLPPLXXXXXXXXXXXXXXXXXXXXXXXXXXXXXXXPLPPPXXXXXXXXXXXXXXPPSXXXXXXXXXXXXXXXXSPXXXXXXXXXXXXXXXXXXXXXXXXXXXXXXXXXXLPSPLPLPPLLLPPPPPXSSFPXXXXXXXXXXXSPPSLPSPSPSPXXXXXXXXXXXXXXXPPSPPLPPSXXXXXXXXXXXXXPLLSPLXXXXXXXXXXXXXPPXXXXXXXXXXXXXXXXXXXXXXXXXXXXXXXXXXXXXXXXXXXXXXXXXXPXSXXXXXXXXXXXXXXXXXXXXXXXXXXXXXXXXXXXXXXXXXXXXXXXXXXXXXXXXXXXXXXPXXXXXXXXXXXXXXPPL

SEQ ID NO: 36983 - protein, 178 aa, Diabrotica virgifera
  misc_feature: Coding regions on vcDNA: vcDNA=SeqID_16680; Strand=-; Position=110-646
  misc_feature: Homolog annotation: Hit_ID=NP_523984.1; Match level="QueryCoverage =100%, HitCoverage=24%, E-value=1e-52, Identity=55%"; Hit description= CG4978-PA [Drosophila melanogaster] gb|AAF50357.1| CG4978-PA [Drosophila melanogaster]
  misc_feature: Gene Ontology Annotation: Molecular function=nucleotide binding; Cellular component=replication fork; Biological process=DNA replication
  misc_feature (60)..(75): Xaa can be any naturally occurring amino acid
NSKHPPMETAALDMKVMRKYISMCKMKDPAIPEELTDFIVAAYVDLRKEARNSADMTFTXXXXXXXXXXXXXXXXRLRLSNVVEKDDVNEAIRLLEMSKDSLKHTLQNKGHRPPNINDKIYALITELAGDTKTVAVSSALEKCASKGYNPDQVDACIEEYEELNVWQVNQTRTKLTFI

SEQ ID NO: 36984 - protein, 165 aa, Diabrotica virgifera
  misc_feature: Coding regions on vcDNA: vcDNA=SeqID_16681; Strand=+; Position=2-499
  misc_feature (6)..(7): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(14): Xaa can be any naturally occurring amino acid
  misc_feature (23)..(24): Xaa can be any naturally occurring amino acid
  misc_feature (27)..(27): Xaa can be any naturally occurring amino acid
  misc_feature (29)..(29): Xaa can be any naturally occurring amino acid
  misc_feature (34)..(37): Xaa can be any naturally occurring amino acid
  misc_feature (43)..(44): Xaa can be any naturally occurring amino acid
  misc_feature (59)..(59): Xaa can be any naturally occurring amino acid
  misc_feature (64)..(64): Xaa can be any naturally occurring amino acid
  misc_feature (71)..(71): Xaa can be any naturally occurring amino acid
  misc_feature (76)..(76): Xaa can be any naturally occurring amino acid
  misc_feature (84)..(84): Xaa can be any naturally occurring amino acid
  misc_feature (100)..(100): Xaa can be any naturally occurring amino acid
  misc_feature (102)..(102): Xaa can be any naturally occurring amino acid
  misc_feature (104)..(104): Xaa can be any naturally occurring amino acid
  misc_feature (108)..(108): Xaa can be any naturally occurring amino acid
  misc_feature (113)..(113): Xaa can be any naturally occurring amino acid
  misc_feature (126)..(126): Xaa can be any naturally occurring amino acid
  misc_feature (132)..(132): Xaa can be any naturally occurring amino acid
  misc_feature (147)..(147): Xaa can be any naturally occurring amino acid
ILLLLXXTTXTXIXKTIFKNCSXXPFXNXLHNYXXXXKSKYSXXIYSTSIKNNILTVPXNNQNXNNFNLLXSMFQXNKITLKLXHPNTKTFQLQHILIIXKXKXLPFXIHTFXSTHHILLITPQHXSLPYKXLIHPPPPLLITFYYXPFKQLLIYPQTLLYQTTH

SEQ ID NO: 36985 - protein, 214 aa, Diabrotica virgifera
  misc_feature: Coding regions on vcDNA: vcDNA=SeqID_16682; Strand=+; Position=2-644
  misc_feature: Homolog annotation: Hit_ID=XP_392119.1; Match level="QueryCoverage =99%, HitCoverage=9%, E-value=1e-67, Identity=55%"; Hit description =similar to CG14723-PA [Apis mellifera]
  misc_feature: Gene Ontology Annotation: Molecular function=protein binding; Cellular component=1-phosphatidylinositol 3-kinase complex; Biological process=B-cell differentiation
  misc_feature: Pfam annotation: Pfam_ID=RhoGAP; Match level="Score=0.0, E-value=9.1e- 06, Copies=1"; Pfam description=RhoGAP domain
  misc_feature (197)..(197): Xaa can be any naturally occurring amino acid
IGLSEFSPVAIAGVFKKHLRELPDPLIPVQWYDKFLEAARKRNDQECTTLLKQLVEELPPHHKSTLRFIMGHLCRICQLEYARGNKSPPTVLIQVMCHILLRPPWERIIQVVYNTQAHNRIVELLLLSCDWGEKLPEFAAAPAVPPRKVSRMGSSVYHGMLDRDKDKLNAVLSLQDAEWYWGDIKREDVNEVLNDTXDGTFLVRDASNKCGEDT

SEQ ID NO: 36986 - protein, 178 aa, Diabrotica virgifera
  misc_feature: Coding regions on vcDNA: vcDNA=SeqID_16683; Strand=-; Position=3-536
  misc_feature (12)..(25): Xaa can be any naturally occurring amino acid
  misc_feature (32)..(44): Xaa can be any naturally occurring amino acid
  misc_feature (46)..(172): Xaa can be any naturally occurring amino acid
AQINGKILKVEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCLFVRT

SEQ ID NO: 36987 - protein, 53 aa, Diabrotica virgifera
  misc_feature: Coding regions on vcDNA: vcDNA=SeqID_16684; Strand=+; Position=23-184
ILSKICYVGTSYQMNKCLNATYQPLYNYFQWKVTFLISFYSHKSQFKLKLINL

SEQ ID NO: 36988 - protein, 56 aa, Diabrotica virgifera
  misc_feature: Coding regions on vcDNA: vcDNA=SeqID_16685; Strand=-; Position=245-415
ICRYNFFYYTFRNIHCAIKKKTYFIYVKIVYCKNSRTIFKEDMLFQNVTYTCNRSH

SEQ ID NO: 36989 - protein, 113 aa, Diabrotica virgifera
  misc_feature: Coding regions on vcDNA: vcDNA=SeqID_16686; Strand=+; Position=1-339
  misc_feature (1)..(53): Xaa can be any naturally occurring amino acid
  misc_feature (55)..(68): Xaa can be any naturally occurring amino acid
  misc_feature (74)..(87): Xaa can be any naturally occurring amino acid
  misc_feature (90)..(97): Xaa can be any naturally occurring amino acid
XXXXXXXXXXXXXXXXXXXXXXXXXXXXXXXXXXXXXXXXXXXXXXXXXXXXXNXXXXXXXXXXXXXXRPRCWXXXXXXXXXXXXXXVRXXXXXXXXVYTGASHGASYPHLLP

SEQ ID NO: 36990 - protein, 96 aa, Diabrotica virgifera
  misc_feature: Coding regions on vcDNA: vcDNA=SeqID_16687; Strand=-; Position=1-288
  misc_feature (3)..(3): Xaa can be any naturally occurring amino acid
  misc_feature (21)..(21): Xaa can be any naturally occurring amino acid
  misc_feature (24)..(24): Xaa can be any naturally occurring amino acid
  misc_feature (37)..(37): Xaa can be any naturally occurring amino acid
  misc_feature (52)..(53): Xaa can be any naturally occurring amino acid
  misc_feature (59)..(61): Xaa can be any naturally occurring amino acid
  misc_feature (68)..(68): Xaa can be any naturally occurring amino acid
  misc_feature (70)..(70): Xaa can be any naturally occurring amino acid
  misc_feature (75)..(76): Xaa can be any naturally occurring amino acid
  misc_feature (78)..(79): Xaa can be any naturally occurring amino acid
  misc_feature (88)..(88): Xaa can be any naturally occurring amino acid
  misc_feature (91)..(91): Xaa can be any naturally occurring amino acid
SGXVLVPRPLARPRRCVGVSXAVXGVLSVRRRALVCXGGSLLLLFRCSPLGXXASRSAXXXGPGSRPXPXSPALXXPXXLKRRPPVFXGSXLSPLG

SEQ ID NO: 36991 - protein, 49 aa, Diabrotica virgifera
  misc_feature: Coding regions on vcDNA: vcDNA=SeqID_16688; Strand=-; Position=1-147
  misc_feature (17)..(17): Xaa can be any naturally occurring amino acid
  misc_feature (42)..(42): Xaa can be any naturally occurring amino acid
SVCLAGGCQGSVVSFLXLVCRARFGWFGAGFFAGKSRPRSGXCSCRPPK

SEQ ID NO: 36992 - protein, 184 aa, Diabrotica virgifera
  misc_feature: Coding regions on vcDNA: vcDNA=SeqID_16689; Strand=+; Position=3-556
  misc_feature: Homolog annotation: Hit_ID=XP_317441.1; Match level="QueryCoverage =82%, HitCoverage=71%, E-value=3e-25, Identity=39%"; Hit description =ENSANGP00000022731 [Anopheles gambiae]
  misc_feature: Gene Ontology Annotation: Biological process=ecdysone biosynthesis
  misc_feature (172)..(172): Xaa can be any naturally occurring amino acid
LSALLKTATYSTAPFSTATNRDNFYQNIAGAQNDDTNPEGWENAKPFDSIPGPKPLPVLGNMWRFFPGAEFHNINTDKLFLLFQQRYGDVVHLGGIWGRRDKIFLYDTGDMEDMLRNTGPFPSRFIMDAIFYYRRKLRKDIYKGNLGLALLQGEEWYKLRKIVHPILMQPKXIQQYPPRMDGAT

SEQ ID NO: 36993 - protein, 52 aa, Diabrotica virgifera
  misc_feature: Coding regions on vcDNA: vcDNA=SeqID_16690; Strand=-; Position=517-675
NRGDMGQKWYGGKWTFSAKKFRYLLCRYYNSVFYIICISFCTIEETIKRQKV

SEQ ID NO: 36994 - protein, 45 aa, Diabrotica virgifera
  misc_feature: Coding regions on vcDNA: vcDNA=SeqID_16691; Strand=+; Position=1-135
  misc_feature (16)..(18): Xaa can be any naturally occurring amino acid
EIIYLGGILEGSFKVXXXDKVFLIILTIIMGEIQDFLILCIFRSL

SEQ ID NO: 36995 - protein, 83 aa, Diabrotica virgifera
  misc_feature: Coding regions on vcDNA: vcDNA=SeqID_16692; Strand=+; Position=1-249
  misc_feature (26)..(34): Xaa can be any naturally occurring amino acid
  misc_feature (40)..(62): Xaa can be any naturally occurring amino acid
FWPGPRAWRYIPRSLPFILSLISNSXXXXXXXXXKWVKKXXXXXXXXXXXXXXXXXXXXXXXFTNVVASDNVPSNRSNQKPKN

SEQ ID NO: 36996 - protein, 84 aa, Diabrotica virgifera
  misc_feature: Coding regions on vcDNA: vcDNA=SeqID_16693; Strand=+; Position=327-581
  misc_feature: Homolog annotation: Hit_ID=S36442; Match level="QueryCoverage=89%, HitCoverage=48%, E-value=7e-09, Identity=42%"; Hit description =reverse transcriptase-like protein - bovine (fragment)
HDNIRYADDTAILAENLQDLQTLLNLVSEASYRRGLKINISKTKWMAVGKINIDQGQLSLDGEELERVNHFKYLGSWLNCKLRL

SEQ ID NO: 36997 - protein, 27 aa, Diabrotica virgifera
  misc_feature: Coding regions on vcDNA: vcDNA=SeqID_16694; Strand=+; Position=1-84
  misc_feature (7)..(13): Xaa can be any naturally occurring amino acid
FCPTKGXXXXXXXEIETTLGSHRSKLT

SEQ ID NO: 36998 - protein, 81 aa, Diabrotica virgifera
  misc_feature: Coding regions on vcDNA: vcDNA=SeqID_16695; Strand=-; Position=119-364
CYLIPFSCYLCVKPVLYNLITCIPYVSDSMTVSLSQQKNKQKMLHTVFSKTQYFLSYWQLQIRNFLTIFNSFLQISQKMCI

SEQ ID NO: 36999 - protein, 52 aa, Diabrotica virgifera
  misc_feature: Coding regions on vcDNA: vcDNA=SeqID_16696; Strand=-; Position=1-156
RVGRVVLRCGGGKRNWGCRCWSLWCLPGVLGPCLLSRKSPSGGWGSLRGSPL

SEQ ID NO: 37000 - protein, 51 aa, Diabrotica virgifera
  misc_feature: Coding regions on vcDNA: vcDNA=SeqID_16697; Strand=-; Position=1-153
  misc_feature (1)..(25): Xaa can be any naturally occurring amino acid
  misc_feature (27)..(39): Xaa can be any naturally occurring amino acid
  misc_feature (41)..(51): Xaa can be any naturally occurring amino acid
XXXXXXXXXXXXXXXXXXXXXXXXXHXXXXXXXXXXXXXDXXXXXXXXXXX

SEQ ID NO: 37001 - protein, 62 aa, Diabrotica virgifera
  misc_feature: Coding regions on vcDNA: vcDNA=SeqID_16698; Strand=-; Position=34-222
RNPRFVFLSRKRRHSSFDCCDHGSFTSFVYLIFHSFIFIGPANTQKVNCESKTSTCLVLAKV

SEQ ID NO: 37002 - protein, 48 aa, Diabrotica virgifera
  misc_feature: Coding regions on vcDNA: vcDNA=SeqID_16699; Strand=+; Position=94-237
KYHIYNDLNCIYLTSLDLLLPTPISLILDISSDEHTKSTTFPIHPSIP

SEQ ID NO: 37003 - protein, 122 aa, Diabrotica virgifera
  misc_feature: Coding regions on vcDNA: vcDNA=SeqID_16700; Strand=-; Position=1-366
  misc_feature (8)..(119): Xaa can be any naturally occurring amino acid
DGHWGGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRK

SEQ ID NO: 37004 - protein, 87 aa, Diabrotica virgifera
  misc_feature: Coding regions on vcDNA: vcDNA=SeqID_16701; Strand=+; Position=245-508
IFYNSSIFTRLMVRVRLSCHVIVRCPLLFWVHPKTFLYGKESSQIFLDLIYFYDLYPGVSKNLLNAFLPTKFHILLHQTPILLYYIC

SEQ ID NO: 37005 - protein, 54 aa, Diabrotica virgifera
  misc_feature: Coding regions on vcDNA: vcDNA=SeqID_16702; Strand=-; Position=1-162
  misc_feature (11)..(19): Xaa can be any naturally occurring amino acid
  misc_feature (22)..(38): Xaa can be any naturally occurring amino acid
  misc_feature (41)..(54): Xaa can be any naturally occurring amino acid
SQFFFIRPFVXXXXXXXXXLCXXXXXXXXXXXXXXXXXARXXXXXXXXXXXXXX

SEQ ID NO: 37006 - protein, 22 aa, Diabrotica virgifera
  misc_feature: Coding regions on vcDNA: vcDNA=SeqID_16703; Strand=+; Position=1-66
DAPCTRSTPSRRVSSVHPISCS

SEQ ID NO: 37007 - protein, 152 aa, Diabrotica virgifera
  misc_feature: Coding regions on vcDNA: vcDNA=SeqID_16704; Strand=+; Position=1-456
  misc_feature: Homolog annotation: Hit_ID=XP_317635.1; Match level="QueryCoverage =93%, HitCoverage=15%, E-value=4e-38, Identity=57%"; Hit description =ENSANGP00000002266 [Anopheles gambiae]
PECSNQNNLHQMNSAEEIVENLPKVWKVLIELLSHQTGPTNVLTDETSDEDPCYKKVDTPKGPSLVLSVSQTFIRLKDLILEKKSLEKETAHLKHLNGHLENRLQDQEKRLELVQTELSKTWLVVGKLQKQHQMLHTQEKILRYQLAHTIRL

SEQ ID NO: 37008 - protein, 85 aa, Diabrotica virgifera
  misc_feature: Coding regions on vcDNA: vcDNA=SeqID_16705; Strand=-; Position=1-255
SDRKLFRRGRRRLSGQRQFGKSGVLRKIPSIEYMQDRLRQFRQAASSHCMASSMASFITSSFISIISEYFSNSKDVPSIRRTAAG

SEQ ID NO: 37009 - protein, 45 aa, Diabrotica virgifera
  misc_feature: Coding regions on vcDNA: vcDNA=SeqID_16706; Strand=+; Position=319-453
AFFLLYTPYLNEENTATPANSENTPTKHDSSLNTVTPCKGITSFK

SEQ ID NO: 37010 - protein, 70 aa, Diabrotica virgifera
  misc_feature: Coding regions on vcDNA: vcDNA=SeqID_16707; Strand=-; Position=1-210
  misc_feature (63)..(63): Xaa can be any naturally occurring amino acid
VVGVSFLFVCVWSCWCRPRLFGFVRALLCFQPFVLRWVGPPLCSLWVVRSPLRSQKGPPLFLXSPLVPPK

SEQ ID NO: 37011 - protein, 106 aa, Diabrotica virgifera
  misc_feature: Coding regions on vcDNA: vcDNA=SeqID_16708; Strand=+; Position=3-320
  misc_feature: Homolog annotation: Hit_ID=XP_311953.1; Match level="QueryCoverage =96%, HitCoverage=8%, E-value=1e-25, Identity=53%"; Hit description =ENSANGP00000011008 [Anopheles gambiae]
  misc_feature: Gene Ontology Annotation: Molecular function=ATP-binding cassette (ABC) transporter activity; Cellular component=membrane; Biological process=transport
  misc_feature (71)..(77): Xaa can be any naturally occurring amino acid
SVEDVVFSDFCREIGVKNIRQYEDRELRAQEERKKKRLEFEKQINRITSNLDFERSRDTQNNVSRWERTVXXXXXXXEACKKQEIKHRDEIDKDLQQVEQLKGSRF

SEQ ID NO: 37012 - protein, 43 aa, Diabrotica virgifera
  misc_feature: Coding regions on vcDNA: vcDNA=SeqID_16709; Strand=-; Position=1-129
  misc_feature (9)..(9): Xaa can be any naturally occurring amino acid
  misc_feature (18)..(18): Xaa can be any naturally occurring amino acid
  misc_feature (33)..(35): Xaa can be any naturally occurring amino acid
  misc_feature (38)..(38): Xaa can be any naturally occurring amino acid
GCYFPSFVXGAPAGCGAXGRFLWLASLKRGVPXXXSFXLFRLK

SEQ ID NO: 37013 - protein, 131 aa, Diabrotica virgifera
  misc_feature: Coding regions on vcDNA: vcDNA=SeqID_16710; Strand=-; Position=3-395
  misc_feature: Homolog annotation: Hit_ID=ZP_00124068.1; Match level="QueryCoverage =99%, HitCoverage=54%, E-value=6e-35, Identity=62%"; Hit description =COG1802: Transcriptional regulators [Pseudomonas syringae pv. syringae B728a]
  misc_feature: Pfam annotation: Pfam_ID=GntR; Match level="Score=37.0, E-value=5.7e -08, Copies=1"; Pfam description=Bacterial regulatory proteins, gntR f
  misc_feature (65)..(100): Xaa can be any naturally occurring amino acid
MTDGPLLLPTLRQVSRDTLQDQVYRQIREALMSGRFQPGQKLTIRGLAEALGSSPMPVREALQRXXXXXXXXXXXXXXXXXXXXXXXXXXXXXXXXXXXXGLLAEKAVLLLKKADLEEISDLCQQMQQAAV

SEQ ID NO: 37014 - protein, 230 aa, Diabrotica virgifera
  misc_feature: Coding regions on vcDNA: vcDNA=SeqID_16711; Strand=-; Position=3-693
  misc_feature: Homolog annotation: Hit_ID=AAT76628.1; Match level="QueryCoverage =97%, HitCoverage=14%, E-value=7e-43, Identity=37%"; Hit description =polyprotein [Candida glabrata]
  misc_feature: Pfam annotation: Pfam_ID=RVT_1; Match level="Score=139.6, E-value =7.3e-39, Copies=1"; Pfam description=Reverse transcriptase (RNA -dependent D
  misc_feature (11)..(11): Xaa can be any naturally occurring amino acid
IVAKKPYRCSXEDKKEIEFQIGHLLKANLIEESSCLFAAPVTLALKKDEGSKTRLCIDFRELNKLIVPEPQPFPLIDEILTKTRNAKFFTTLDINSAFWCIPVRNKDKYKTAFVTQDDHWQWKCLPFGLKTSPAIFQRILSNIIRKHNLNPFCINYIDDILIFSVSFEEHLEHIARLMEAILEEGFRLKLLKCNFAREEVKYLGHIVGNNSVRPLHDNLISIRNFPAPDT

SEQ ID NO: 37015 - protein, 163 aa, Diabrotica virgifera
  misc_feature: Coding regions on vcDNA: vcDNA=SeqID_16712; Strand=-; Position=3-491
  misc_feature: Homolog annotation: Hit_ID=EAL44741.1; Match level="QueryCoverage =86%, HitCoverage=75%, E-value=8e-23, Identity=36%"; Hit description =hypothetical protein 244.t00012 [Entamoeba histolytica HM-1:IMSS]
  misc_feature: Gene Ontology Annotation: Molecular function=poly(A) binding; Cellular component=nucleus; Biological process=regulation of transcription from Pol II promoter
  misc_feature (6)..(20): Xaa can be any naturally occurring amino acid
  misc_feature (98)..(111): Xaa can be any naturally occurring amino acid
DDNGGXXXXXXXXXXXXXXXASKEDEYALDEDDDQDHDEDDDQAETEEADDGDTEEVDQKDQEDEGDEDEEDDIKASREKRDISEEKLSNDADDDDEXXXXXXXXXXXXXXQDLDDKDGDEEDQEDEDQASNENDDTADTDDAKETEQDEDDGTDDNVKAADT

SEQ ID NO: 37016 - protein, 238 aa, Diabrotica virgifera
  misc_feature: Coding regions on vcDNA: vcDNA=SeqID_16713; Strand=+; Position=1-717
FVRTDISETKKAEVFVAVECLKADITKIKSINQSLQNLKEVTNYIEQLPKPELLAAVGNDVQTLMKQIQTFKVDNEAIYIVEKYTETLKQAIVDVVNQDRTDTTERLEKSIGSRPIEGDIGQSIRNINSRIKEIVVKEEEKVTKSLQIEELIQTKPTMEVSGIKLSEKFNQDHRKFNQKQQRKLLYLKNLPTTLKGVNSYAATISEHAGTSTGYFTRTTILSPPILLAPWTQILLIPQ

SEQ ID NO: 37017 - protein, 223 aa, Diabrotica virgifera
  misc_feature: Coding regions on vcDNA: vcDNA=SeqID_16714; Strand=+; Position=34-706
  misc_feature: Homolog annotation: Hit_ID=AAV91360.1; Match level="QueryCoverage =97%, HitCoverage=94%, E-value=4e-50, Identity=50%"; Hit description =heat shock protein 1 [Lonomia obliqua]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=114.4, E-value =2.8e-31, Copies=1"; Pfam description=Hsp20/alpha crystallin family
  misc_feature (164)..(164): Xaa can be any naturally occurring amino acid
MSMVPLLFRDWWDEEDLMRPSRLLDQQFGLGLRRDDLLNSIRDIPRRSALSSRYIRPWATSTALQRQDSGSTITQDQNKFQERVSSNYHEDTTLGNQLESESIRMEEKSQDFEVILDVQQFAPNEITVKTNGNSILVEGKHEEKQDEHGYIMRHFVRRYVLPQXTMPENVVSSLSSDGGLTVSAPKKSEKTVTSERVIPIPQTGPAKNTVTPRCKSSPNPNHK

SEQ ID NO: 37018 - protein, 150 aa, Diabrotica virgifera
  misc_feature: Coding regions on vcDNA: vcDNA=SeqID_16715; Strand=+; Position=147-599
  misc_feature: Homolog annotation: Hit_ID=XP_392895.1; Match level="QueryCoverage =86%, HitCoverage=9%, E-value=1e-18, Identity=40%"; Hit description =similar to ENSANGP00000016747 [Apis mellifera]
TFNLRGWVWQTCKADGSFDVHGERQWCSKNLVSLKGLREWQQMVKEINQRLEFLNIKQIHGQTELQIDEKPLVLKMIIAGAFYPNFFIREQNANEVDDKQLVRAVGGRDPYRSVYLTGMDSQQPGPVYIRVIKSLFQNENDRNTNIFHRV

SEQ ID NO: 37019 - protein, 280 aa, Diabrotica virgifera
  misc_feature: Coding regions on vcDNA: vcDNA=SeqID_16716; Strand=+; Position=1-844
  misc_feature: Homolog annotation: Hit_ID=XP_214319.2; Match level="QueryCoverage =99%, HitCoverage=50%, E-value=9e-82, Identity=55%"; Hit description =similar to myo-inositol 1-phosphate synthase A1 [Rattus norvegicus]
  misc_feature: Gene Ontology Annotation: Molecular function=inositol-3-phosphate synthase activity; Cellular component=cellular_component unknown; Biological process=myo-inositol metabolism
  misc_feature: Pfam annotation: Pfam_ID=Inos-1-P_synth; Match level="Score=33.5, E -value=5.8e-12, Copies=1"; Pfam description=Myo-inositol-1-phosphate synthase
  misc_feature (239)..(239): Xaa can be any naturally occurring amino acid
VVNSDKVKYTDNFIETKYTYQYNKARKNGDVIEVTPISEKLVLKTSRKIPKLGVMLVGWGGNNGSTFTAAVIANKLGLTWPTKKGIQEANWYGSLTQAATVSLGDDVFVPFSKLLPMVDPDDIVIGGWDISSANLAESMERAQVLEPVLQQQLKPHMQTLKPKPSVYIPEFIAANQKSRADHVIKGTRQEQLEHICHDIAEFKDANNLDKIIILWTANTECFSDVLDGVTDTAENIKIXSLTMTAIYPPSTLFAYAAIANGCTYIKRISHRNNHLFPGNY

SEQ ID NO: 37020 - protein, 119 aa, Diabrotica virgifera
  misc_feature: Coding regions on vcDNA: vcDNA=SeqID_16717; Strand=-; Position=1-357
KVKKLPPPPPSTIKGKSSFFLPKTSSGTSLKSEDSASSKDEPKQTQNNKEKEADKKSTTNNKPKGGLSAFFSKTSSSSSVKSENGIKREYSTISSQPSEVEELMEVDFQESSEKVIVDS

SEQ ID NO: 37021 - protein, 253 aa, Diabrotica virgifera
  misc_feature: Coding regions on vcDNA: vcDNA=SeqID_16718; Strand=+; Position=1-762
  misc_feature: Homolog annotation: Hit_ID=XP_395220.1; Match level="QueryCoverage =98%, HitCoverage=30%, E-value=1e-110, Identity=75%"; Hit description= similar to CG8155-PA [Apis mellifera]
  misc_feature: Gene Ontology Annotation: Molecular function=Rab GTPase activator activity; Cellular component=cellular_component unknown; Biological process=signal transduction
  misc_feature: Pfam annotation: Pfam_ID=TBC; Match level="Score=-25.5, E-value=7.4e -06, Copies=1"; Pfam description=TBC domain
IMYAKELRSVIYFGGIEPSLRKVVWKHLLNVYPSGMTGKERMDYIKKKASEYVNLKETWKTAIAQGQVAGELAYTTGMVRKDVLRTDRHHPFYAGSDDNQNIASLFNILTTYALNHPKVSYCQGMSDLASPLLVTMNDEAHAYICFCALMQRLCTNFMIDGIAMTQKFTHLAEGILYYDPEFYNYLKIHQADDLLFCYRWVLLEMKREFAFEDSLRMLEVLWSSLPAIPAEKELQMVETMFPPTISTPPIVHL

SEQ ID NO: 37022 - protein, 43 aa, Diabrotica virgifera
  misc_feature: Coding regions on vcDNA: vcDNA=SeqID_16719; Strand=+; Position=27-155
QAIHFTIQINIFIERRLIETRLLSWKLILSFNYKNFQNKEIHN

SEQ ID NO: 37023 - protein, 66 aa, Diabrotica virgifera
  misc_feature: Coding regions on vcDNA: vcDNA=SeqID_16720; Strand=-; Position=2-199
  misc_feature (4)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFVXXXXXXXXXXTTLAHTGLNXXXXXXXXSNXXXXXXXXXXXXXXPTSRSXXXXXXXXXXXXXXV

SEQ ID NO: 37024 - protein, 69 aa, Diabrotica virgifera
  misc_feature: Coding regions on vcDNA: vcDNA=SeqID_16721; Strand=-; Position=148-357
  misc_feature: Homolog annotation: Hit_ID=NP_732748.1; Match level="QueryCoverage =95%, HitCoverage=11%, E-value=1e-17, Identity=68%"; Hit description =CG5374-PB, isoform B [Drosophila melanogaster] ref|NP_524450.2| CG5374-PA, isoform A [Drosophila
  misc_feature: Gene Ontology Annotation: Molecular function=chaperone activity; Cellular component=cytosol; Biological process=protein folding
VGVDLMEGAVRDSRKAGVVEPTMSKIKSLKVATEAPISILRIGDMIKLDSEQRGGKSYQQAMESGELYD

SEQ ID NO: 37025 - protein, 87 aa, Diabrotica virgifera
  misc_feature: Coding regions on vcDNA: vcDNA=SeqID_16722; Strand=+; Position=50-313
NLSLSVAERNNYFTVELNHCLILRNHRSFFRPIHLFSSTFSCIIRQSMVFMSSNYMAKVFCSSSMVFMSSNYMAKVLPFIMFMSRRS

SEQ ID NO: 37026 - protein, 88 aa, Diabrotica virgifera
  misc_feature: Coding regions on vcDNA: vcDNA=SeqID_16723; Strand=+; Position=14-277
  misc_feature (1)..(1): Xaa can be any naturally occurring amino acid
  misc_feature (6)..(59): Xaa can be any naturally occurring amino acid
XEIASXXXXXXXXXXXXXXXXXXXXXXXXXXXXXXXXXXXXXXXXXXXXXXXXXXXXXXEKKAKKNMNNTKKIRGLYNNEKTTNQPQN

SEQ ID NO: 37027 - protein, 78 aa, Diabrotica virgifera
  misc_feature: Coding regions on vcDNA: vcDNA=SeqID_16724; Strand=-; Position=665-901
  misc_feature (2)..(9): Xaa can be any naturally occurring amino acid
KXXXXXXXXSRYKAAFFLIPTPTSTHKMGFSREKLDQQSDFRNFHGPPKLQSLSTKLKKTFKKTPNFRISPVYLVNGL

SEQ ID NO: 37028 - protein, 64 aa, Diabrotica virgifera
  misc_feature: Coding regions on vcDNA: vcDNA=SeqID_16725; Strand=-; Position=1-195
  misc_feature (43)..(43): Xaa can be any naturally occurring amino acid
  misc_feature (47)..(49): Xaa can be any naturally occurring amino acid
  misc_feature (55)..(55): Xaa can be any naturally occurring amino acid
  misc_feature (57)..(58): Xaa can be any naturally occurring amino acid
  misc_feature (60)..(60): Xaa can be any naturally occurring amino acid
LMQGFLFHSIFSEYSKLSLNLLVVANLQHQPKTLFPVSCFFAXSFPXXXVKVAPXLXXPXPFRS

SEQ ID NO: 37029 - protein, 45 aa, Diabrotica virgifera
  misc_feature: Coding regions on vcDNA: vcDNA=SeqID_16726; Strand=-; Position=21-158
RSLILRSSCFSRNLENMVVLKGLVGRCEANGVDPFWIFDAKSAHC

SEQ ID NO: 37030 - protein, 170 aa, Diabrotica virgifera
  misc_feature: Coding regions on vcDNA: vcDNA=SeqID_16727; Strand=+; Position=3-512
  misc_feature (87)..(94): Xaa can be any naturally occurring amino acid
KLCFDVFVIVATRDEMKYLGKNTSGTEGMEREVTDKIEKLADINRSPVERSPRRIASITEMLKNQGQKDTTEQKVIPGRLKQNLNIXXXXXXXXQSQPKISSLRKSQSLESPSDEDISDSKDVISEPATKTLSYKDSPPKDEEKPVNFDEPDNVNILESITKERVRIPVK

SEQ ID NO: 37031 - protein, 74 aa, Diabrotica virgifera
  misc_feature: Coding regions on vcDNA: vcDNA=SeqID_16728; Strand=+; Position=226-447
  misc_feature: Homolog annotation: Hit_ID=XP_319541.1; Match level="QueryCoverage =82%, HitCoverage=7%, E-value=6e-13, Identity=58%"; Hit description =ENSANGP00000002068 [Anopheles gambiae]
  misc_feature (13)..(13): Xaa can be any naturally occurring amino acid
  misc_feature (56)..(56): Xaa can be any naturally occurring amino acid
MSDKMSKATGTSXLYATWVDRTPANCIPRLCSLTLTRIIILKPLGSDLAAVSIAAXMQSPKRILRPNELLLTPP

SEQ ID NO: 37032 - protein, 51 aa, Diabrotica virgifera
  misc_feature: Coding regions on vcDNA: vcDNA=SeqID_16729; Strand=+; Position=43-198
  misc_feature (15)..(22): Xaa can be any naturally occurring amino acid
IKMAAIYFNEYYVVXXXXXXXXDIIVQCVNGYLKTHVYIYNYCFNTEDLKI

SEQ ID NO: 37033 - protein, 68 aa, Diabrotica virgifera
  misc_feature: Coding regions on vcDNA: vcDNA=SeqID_16730; Strand=+; Position=135-341
MGNAEVGRRIYILDGSDFPELRTGIKEFFVSEGIFNICFIGNVVVNNVCKAISVLFILLLLLFCCINS

SEQ ID NO: 37034 - protein, 98 aa, Diabrotica virgifera
  misc_feature: Coding regions on vcDNA: vcDNA=SeqID_16731; Strand=+; Position=49-342
  misc_feature: Homolog annotation: Hit_ID=EAL49477.1; Match level="QueryCoverage =100%, HitCoverage=40%, E-value=6e-14, Identity=41%"; Hit description= hypothetical protein 42.t00003 [Entamoeba histolytica HM-1:IMSS]
  misc_feature: Gene Ontology Annotation: Molecular function=molecular_function unknown; Cellular component=cellular_component unknown; Biological process=N-linked glycosylation
  misc_feature (34)..(41): Xaa can be any naturally occurring amino acid
EEEDKTLEDERLKKEEKLQRIKKEEEDKRLEEDXXXXXXXXLDRKKKEQEEKELEEKKVREKEMAEKEEELQRLQKEEDDKKQEEEILRKEKEELEED

SEQ ID NO: 37035 - protein, 82 aa, Diabrotica virgifera
  misc_feature: Coding regions on vcDNA: vcDNA=SeqID_16732; Strand=+; Position=14-259
  misc_feature: Homolog annotation: Hit_ID=BAC29030.1; Match level="QueryCoverage =81%, HitCoverage=21%, E-value=5e-15, Identity=49%"; Hit description =unnamed protein product [Mus musculus]
MQKVLRGGTQIRLLSTTVDSQEMAHFKKYVNYWWDEFGRVKPLHAMNKIRIPWIRDSLISGKRVEDPALPLKGYSVLDVGCG

SEQ ID NO: 37036 - protein, 18 aa, Diabrotica virgifera
  misc_feature: Coding regions on vcDNA: vcDNA=SeqID_16733; Strand=-; Position=1-54
PPPQKKPKTPPQIKKTRK

SEQ ID NO: 37037 - protein, 45 aa, Diabrotica virgifera
  misc_feature: Coding regions on vcDNA: vcDNA=SeqID_16734; Strand=-; Position=62-199
KFLKPIICRLQKLAIAATFLYRPIVLSFLVAVTDRFYCITKKDEM

SEQ ID NO: 37038 - protein, 76 aa, Diabrotica virgifera
  misc_feature: Coding regions on vcDNA: vcDNA=SeqID_16735; Strand=-; Position=3-230
  misc_feature (55)..(64): Xaa can be any naturally occurring amino acid
IKPDLWVIFPSPIKIRARGRCMHNTNTIIFVKQNVLKQNLQGISFQNCSNITVNXXXXXXXXXXRILNRYLHMCGR

SEQ ID NO: 37039 - protein, 106 aa, Diabrotica virgifera
  misc_feature: Coding regions on vcDNA: vcDNA=SeqID_16736; Strand=+; Position=320-640
WHPMWHAQCPISSRLSNCRWSCFHIVKERSLTVDAEPADETISETTADIDNVNQPNITTILPLNNIINTTNLGDIPINLNNTNNAEYTFNLWTNWSLHTLPMVDWN

SEQ ID NO: 37040 - protein, 85 aa, Diabrotica virgifera
  misc_feature: Coding regions on vcDNA: vcDNA=SeqID_16737; Strand=+; Position=3-257
  misc_feature (5)..(5): Xaa can be any naturally occurring amino acid
  misc_feature (9)..(9): Xaa can be any naturally occurring amino acid
CGRKXETKXKASDIYSDDSDSDNDDDEKSSSSPQRPTIADSVRSRSRSRSRSESSSSSSYRRPEERDIPHPPIISPRSQKVSIIF

SEQ ID NO: 37041 - protein, 147 aa, Diabrotica virgifera
  misc_feature: Coding regions on vcDNA: vcDNA=SeqID_16738; Strand=+; Position=3-446
  misc_feature: Homolog annotation: Hit_ID=XP_311350.1; Match level="QueryCoverage =98%, HitCoverage=43%, E-value=5e-68, Identity=86%"; Hit description =ENSANGP00000021363 [Anopheles gambiae]
  misc_feature: Gene Ontology Annotation: Molecular function=calcium ion binding; Cellular component=intracellular; Biological process=regulation of cell shape
  misc_feature (117)..(125): Xaa can be any naturally occurring amino acid
TRHKILCADFLEMNYDKVFNHYQRLLNSENYVTRRQSLKLLGELLLDRHNFTVMTRYISNPDNLKLMMNMLKERSRNIQFEAFHVFKVFVANPNKPKPILDILLRNQEKLVEFLMRXXXXXXXXXQFNDEKAYLIRQIKELKPIPGH

SEQ ID NO: 37042 - protein, 107 aa, Diabrotica virgifera
  misc_feature: Coding regions on vcDNA: vcDNA=SeqID_16739; Strand=+; Position=1-324
PTRPPGPNQTTQVVPPQTAGGAATGGSVASNVGGGLGDGSASAASRNDQGQVYQDSYVSFLNQTPGGNQAARGRGRGPHSNGNPFSSGASIPSLGPQPGTGTADITA

SEQ ID NO: 37043 - protein, 32 aa, Diabrotica virgifera
  misc_feature: Coding regions on vcDNA: vcDNA=SeqID_16740; Strand=-; Position=2-97
  misc_feature (18)..(31): Xaa can be any naturally occurring amino acid
NNIAAAPIINFNPTSRSXXXXXXXXXXXXXXV

SEQ ID NO: 37044 - protein, 30 aa, Diabrotica virgifera
  misc_feature: Coding regions on vcDNA: vcDNA=SeqID_16741; Strand=+; Position=3-92
CNSVICDGNNEVIHEPLCHAEHELRLTLAQ

SEQ ID NO: 37045 - protein, 55 aa, Diabrotica virgifera
  misc_feature: Coding regions on vcDNA: vcDNA=SeqID_16742; Strand=-; Position=1-165
YTSSYLIIYIFFFKFPKLKTFKLIFLENGVSYRLKARVTPSTRLPHNLIIQYQKL

SEQ ID NO: 37046 - protein, 80 aa, Diabrotica virgifera
  misc_feature: Coding regions on vcDNA: vcDNA=SeqID_16743; Strand=+; Position=47-286
PAPPYSLDTHIPRIPSSPNLLICCSGILCTNMSLSSTSQILCKGTTAIISRCFSLHKLPETHKPTSSRLVWTLYKKNLIP

SEQ ID NO: 37047 - protein, 144 aa, Diabrotica virgifera
  misc_feature: Coding regions on vcDNA: vcDNA=SeqID_16744; Strand=+; Position=224-656
  misc_feature: Homolog annotation: Hit_ID=AAV34856.1; Match level="QueryCoverage =98%, HitCoverage=46%, E-value=3e-30, Identity=50%"; Hit description =ribosomal protein SA [Bombyx mori]
  misc_feature: Gene Ontology Annotation: Molecular function=structural constituent of ribosome; Cellular component=cytosolic small ribosomal subunit (sensu Eukarya); Biological process=ribosomal small subunit assembly and maintenance
  misc_feature: Pfam annotation: Pfam_ID=Ribosomal_S2; Match level="Score=-19.0, E -value=6.2e-06, Copies=1"; Pfam description=Ribosomal protein S2
  misc_feature (59)..(59): Xaa can be any naturally occurring amino acid
  misc_feature (120)..(120): Xaa can be any naturally occurring amino acid
LKILMYNPVIDAIEHPDGFPRLSSHHYDQRADLRVAAPTEPTPIVGRLTPAVFTHQIHXVFMEPLLLIFPDPAFDHLPIPEDSYYNLPDIALSNTDSPLHLADIAIPVNYYLSHSIAVLXRLLYRKDLRLKRIMPRQTKWNEVS

SEQ ID NO: 37048 - protein, 62 aa, Diabrotica virgifera
  misc_feature: Coding regions on vcDNA: vcDNA=SeqID_16745; Strand=-; Position=0-185
  misc_feature (3)..(22): Xaa can be any naturally occurring amino acid
  misc_feature (25)..(61): Xaa can be any naturally occurring amino acid
KKXXXXXXXXXXXXXXXXXXXXYHXXXXXXXXXXXXXXXXXXXXXXXXXXXXXXXXXXXXXT

SEQ ID NO: 37049 - protein, 66 aa, Diabrotica virgifera; identical to SEQ ID NO: 26808
  misc_feature: Coding regions on vcDNA: vcDNA=SeqID_16746; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37050 - protein, 40 aa, Diabrotica virgifera
  misc_feature: Coding regions on vcDNA: vcDNA=SeqID_16747; Strand=+; Position=521-643
SISLILRLYLQFSSLCIFILYLCSEMYISTRYIIMYWLTG

SEQ ID NO: 37051 - protein, 76 aa, Diabrotica virgifera
  misc_feature: Coding regions on vcDNA: vcDNA=SeqID_16748; Strand=+; Position=436-666
YLTGLSIYKYVLNFASFRLLPNTTSFLIRISKSTASRTPTLNKNLLHLISLFRLLLRTKLLKVVQSCQCYSYLISS

SEQ ID NO: 37052 - protein, 267 aa, Diabrotica virgifera
  misc_feature: Coding regions on vcDNA: vcDNA=SeqID_16749; Strand=+; Position=114-914
  misc_feature: Homolog annotation: Hit_ID=EAA12537.3; Match level="QueryCoverage =82%, HitCoverage=62%, E-value=5e-13, Identity=25%"; Hit description =ENSANGP00000010401 [Anopheles gambiae str. PEST] ref|XP_555376.1| ENSANGP00000010401 [Anopheles gambiae st
  misc_feature: Pfam annotation: Pfam_ID=Trypsin; Match level="Score=37.4, E-value =4.1e-08, Copies=1"; Pfam description=Trypsin
MTPAIVCDILVIMCFVHSVLATNNINNNLQQIDFGLEEEQDFPYQVSVHLNYNNQFVCGAVVIAEDQVLTLAHCLYYDWGGLLPPIIISVNSGGKMLNTEEYESFSVSDIRFHKEFNTSEMKYDLAVLDIPVKLMSKNSPIIPIGLQSDSMPSRYDNCIAIGWNNVSANQEVIDVILTDCNIETSTKMCAKHKAQNETLCNMPGSLLVCSSTLVGIMSVVPGCDSTNQISLFESARHDKDLLISSAASVARRVSINTNMDLQFLQYL

SEQ ID NO: 37053 - protein, 66 aa, Diabrotica virgifera
  misc_feature: Coding regions on vcDNA: vcDNA=SeqID_16750; Strand=-; Position=2-199
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFVLKYTDKIKIESNLAHTRVNXXXXXXXXSTXXXXXXXXXXXXXXPTSRSXXXXXXXXXXXXXXV

SEQ ID NO: 37054 - protein, 102 aa, Diabrotica virgifera
  misc_feature: Coding regions on vcDNA: vcDNA=SeqID_16751; Strand=+; Position=388-696
KPDYINHVIRNILTVSKLVALILLDIFDIYLIEIFLIFSPSPVSLFDFFIFVFAMSFIFSSFLKKEDYWCCKNTHLKSEVIVSKNERSMPNLFLDFMLFLCM

SEQ ID NO: 37055 - protein, 66 aa, Diabrotica virgifera
  misc_feature: Coding regions on vcDNA: vcDNA=SeqID_16752; Strand=-; Position=1-198
  misc_feature (3)..(14): Xaa can be any naturally occurring amino acid
  misc_feature (23)..(30): Xaa can be any naturally occurring amino acid
  misc_feature (33)..(40): Xaa can be any naturally occurring amino acid
  misc_feature (48)..(48): Xaa can be any naturally occurring amino acid
  misc_feature (52)..(64): Xaa can be any naturally occurring amino acid
PFXXXXXXXXXXXXNLGSHRFKXXXXXXXXSNXXXXXXXXPIINLIHXRGRXXXXXXXXXXXXXLL

SEQ ID NO: 37056 - protein, 119 aa, Diabrotica virgifera
  misc_feature: Coding regions on vcDNA: vcDNA=SeqID_16753; Strand=+; Position=1-360
KMFKLVVLFGLAAVVAARPSGWETPVVSYSLPAVAVPAAVSSTYRRDVINKPVIAYSAHPVVAAPVVHNVVSSPVLPLSAAATHSFRSDLVSSPWVVAHEAPALLAEPVWPAAASIHPW

SEQ ID NO: 37057 - protein, 20 aa, Diabrotica virgifera
  misc_feature: Coding regions on vcDNA: vcDNA=SeqID_16754; Strand=-; Position=1-60
  misc_feature (3)..(19): Xaa can be any naturally occurring amino acid
NHXXXXXXXXXXXXXXXXXL

SEQ ID NO: 37058 - protein, 66 aa, Diabrotica virgifera; identical to SEQ ID NO: 26808
  misc_feature: Coding regions on vcDNA: vcDNA=SeqID_16755; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37059 - protein, 244 aa, Diabrotica virgifera
  misc_feature: Coding regions on vcDNA: vcDNA=SeqID_16756; Strand=+; Position=1-733
  misc_feature: Homolog annotation: Hit_ID=AAF87760.1; Match level="QueryCoverage =100%, HitCoverage=55%, E-value=3e-92, Identity=73%"; Hit description= cytochrome oxidase subunit I [Diabrotica virgifera zeae]
  misc_feature: Pfam annotation: Pfam_ID=COX1; Match level="Score=-133.0, E-value=1e -06, Copies=1"; Pfam description=Cytochrome C and Quinol oxidase polyp
  misc_feature (21)..(21): Xaa can be any naturally occurring amino acid
  misc_feature (56)..(56): Xaa can be any naturally occurring amino acid
  misc_feature (73)..(73): Xaa can be any naturally occurring amino acid
  misc_feature (76)..(82): Xaa can be any naturally occurring amino acid
  misc_feature (109)..(115): Xaa can be any naturally occurring amino acid
  misc_feature (129)..(129): Xaa can be any naturally occurring amino acid
  misc_feature (137)..(153): Xaa can be any naturally occurring amino acid
  misc_feature (182)..(182): Xaa can be any naturally occurring amino acid
  misc_feature (198)..(205): Xaa can be any naturally occurring amino acid
  misc_feature (226)..(226): Xaa can be any naturally occurring amino acid
FGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFIXNIVSSIGSLISLIGVXXXXXXXXEAFSFQRKRLRPLRITSSIEXLQFNPPAEHRYSELPILS

SEQ ID NO: 37060 - protein, 262 aa, Diabrotica virgifera
  misc_feature: Coding regions on vcDNA: vcDNA=SeqID_16757; Strand=+; Position=24-809
  misc_feature: Homolog annotation: Hit_ID=AAB60897.1; Match level="QueryCoverage =96%, HitCoverage=46%, E-value=4e-35, Identity=33%"; Hit description =luciferase sp|Q27757|LUCI_PHOPE Luciferin 4-monooxygenase (Luciferase)
  misc_feature: Gene Ontology Annotation: Molecular function=molecular_function unknown
MVTEDDNFIIYGPRPSEPLPKDCLGKFVLNNLINNPTNEVMLNVQSGQCISYSQILQETCNLAESLRKYGCTQDTIIGLCSENHLKFFVPLLAATCLGSVIVPINPAYVHDELRHVLNLTQPRILFCSKLTLSKFSKDEYTFIEKIICIDSDVPNVETAEEFVSKQLNRKSVDPKRFEMFSGNPETHLTAIMTSSGTTGLPKGVMLTDHNFEARILQFRDSVYKGAYAIVDGKFTTTSKGTFGIMPFYHGAGIVLALACIAQ

SEQ ID NO: 37061 - protein, 321 aa, Diabrotica virgifera
  misc_feature: Coding regions on vcDNA: vcDNA=SeqID_16758; Strand=-; Position=0-962
  misc_feature (6)..(301): Xaa can be any naturally occurring amino acid
HLVERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRRLS

SEQ ID NO: 37062 - protein, 18 aa, Diabrotica virgifera
  misc_feature: Coding regions on vcDNA: vcDNA=SeqID_16759; Strand=+; Position=1-54
YTSVLYQTQMLQIVLWIT

SEQ ID NO: 37063 - protein, 278 aa, Diabrotica virgifera
  misc_feature: Coding regions on vcDNA: vcDNA=SeqID_16760; Strand=+; Position=2-835
  misc_feature: Homolog annotation: Hit_ID=XP_397114.1; Match level="QueryCoverage =99%, HitCoverage=48%, E-value=3e-44, Identity=36%"; Hit description =similar to Myosin heavy chain, skeletal muscle, adult 1 (Myosin heavy chain IIx/d) (MyHC-IIx/d)
TIKQLSTEIAELQTEVDGLKQTEFQTSEDNIRLTEDLESERQKNIKLELELFELKKEHEQTLRVMEMMKKEMKELQMLEEEHRTNLTNLKKESDAHKREKNVLKHQSTLILQGLNESEGSDNYLLLLQEIEDLKRTLEDERNKHDEEVTILQERLEDQDNNAQIEVLEERLKLVESELQTATERAERAEEKLKAPPAPPPPPPPPLPPMLPPLSLPASDPPAVPLRRRRSKVALSDLAESIGVQENTPSDKKPAAAPGVNEDIINAIKAGQFTLREGQ

SEQ ID NO: 37064 - protein, 68 aa, Diabrotica virgifera
  misc_feature: Coding regions on vcDNA: vcDNA=SeqID_16761; Strand=-; Position=1-204
  misc_feature (10)..(11): Xaa can be any naturally occurring amino acid
  misc_feature (14)..(14): Xaa can be any naturally occurring amino acid
  misc_feature (25)..(32): Xaa can be any naturally occurring amino acid
  misc_feature (35)..(47): Xaa can be any naturally occurring amino acid
  misc_feature (54)..(66): Xaa can be any naturally occurring amino acid
YWSFRTKIYXXIKXRNHAGSHRLNXXXXXXXXRTXXXXXXXXXXXXXIQHRGRXXXXXXXXXXXXXLL

SEQ ID NO: 37065 - protein, 201 aa, Diabrotica virgifera
  misc_feature: Coding regions on vcDNA: vcDNA=SeqID_16762; Strand=-; Position=2-604
  misc_feature: Homolog annotation: Hit_ID=XP_317842.1; Match level="QueryCoverage =98%, HitCoverage=51%, E-value=1e-62, Identity=54%"; Hit description =ENSANGP00000014909 [Anopheles gambiae]
  misc_feature: Pfam annotation: Pfam_ID=DUF829; Match level="Score=58.9, E-value =1.4e-14, Copies=1"; Pfam description=Eukaryotic protein of unknown functio
MLKPWQFLWPTKGTQMVAKDIVKFLDVNASYSPLLLHGFSVAAYLWGEALVLMSAERQKYDHIINRIVGQVWDSAADVTEIPVGFPKAVFPNNSVLQNTLKQYILYHLKTFDKTVTVHYVRSSQMFHTNIVRAPALVFVSKSDPIGSETSNRRVTDNWENMGMQVTFKTWENTPHVGHYQAHPKEYLSELNSFLGSLNIKQ

SEQ ID NO: 37066 - protein, 41 aa, Diabrotica virgifera
  misc_feature: Coding regions on vcDNA: vcDNA=SeqID_16763; Strand=+; Position=3-128
  misc_feature (2)..(10): Xaa can be any naturally occurring amino acid
  misc_feature (13)..(13): Xaa can be any naturally occurring amino acid
  misc_feature (22)..(22): Xaa can be any naturally occurring amino acid
  misc_feature (26)..(34): Xaa can be any naturally occurring amino acid
  misc_feature (38)..(39): Xaa can be any naturally occurring amino acid
TXXXXXXXXXDNXDCDLDVGLXFIIXXXXXXXXXVDFXXFT

SEQ ID NO: 37067 - protein, 42 aa, Diabrotica virgifera
  misc_feature: Coding regions on vcDNA: vcDNA=SeqID_16764; Strand=-; Position=2-127
  misc_feature (2)..(13): Xaa can be any naturally occurring amino acid
LXXXXXXXXXXXXPTWLYSGLNSDHVKFYLDVGLKFIAATPI

SEQ ID NO: 37068 - protein, 272 aa, Diabrotica virgifera
  misc_feature: Coding regions on vcDNA: vcDNA=SeqID_16765; Strand=+; Position=35-850
  misc_feature: Homolog annotation: Hit_ID=XP_392194.1; Match level="QueryCoverage =76%, HitCoverage=28%, E-value=3e-35, Identity=38%"; Hit description =similar to CG8660-PD [Apis mellifera]
  misc_feature (169)..(179): Xaa can be any naturally occurring amino acid
  misc_feature (219)..(225): Xaa can be any naturally occurring amino acid
MKFFKVLTVLFLVAGIGTVCTAKVPSVFGVFFSNTNTKNEIQDNSVPEKDAKSDYSVIEDEFTKLRIEYIKNQILKKLRLKEKPTITISELPKPVKEYENLLPSQDMNLQSSYSDDFYGKTTQAIIFPYEDKARCSNTIRFPSACLPFQMPNDIHTSEVASAELWFHKXXXXXXXXXXXFVIYEVAHWDTKKSFQKTTPIAIQETSLTEGWLKIDVTYXXXXXXXFLESPVHAINVVCKTCDMEKNQSPISFTSELKPFLVIYTHSQQRRAM

SEQ ID NO: 37069 - protein, 258 aa, Diabrotica virgifera
  misc_feature: Coding regions on vcDNA: vcDNA=SeqID_16766; Strand=+; Position=3-779
  misc_feature (3)..(8): Xaa can be any naturally occurring amino acid
  misc_feature (14)..(79): Xaa can be any naturally occurring amino acid
  misc_feature (81)..(100): Xaa can be any naturally occurring amino acid
  misc_feature (108)..(113): Xaa can be any naturally occurring amino acid
  misc_feature (123)..(132): Xaa can be any naturally occurring amino acid
  misc_feature (136)..(154): Xaa can be any naturally occurring amino acid
  misc_feature (157)..(163): Xaa can be any naturally occurring amino acid
  misc_feature (168)..(181): Xaa can be any naturally occurring amino acid
  misc_feature (190)..(202): Xaa can be any naturally occurring amino acid
  misc_feature (215)..(234): Xaa can be any naturally occurring amino acid
FNXXXXXXLQVNTXXXXXXXXXXXXXXXXXXXXXXXXXXXXXXXXXXXXXXXXXXXXXXXXXXXXXXXXXXXXXXXXXXLXXXXXXXXXXXXXXXXXXXXIYSYLNIXXXXXXHILTDELKHXXXXXXXXXXPIKXXXXXXXXXXXXXXXXXXXLFXXXXXXXYTFTXXXXXXXXXXXXXXRISTTTIYXXXXXXXXXXXXXLLQTCLFAFNIKXXXXXXXXXXXXXXXXXXXXYSLVSLLTAGMNGWMLQKLSLHNL

SEQ ID NO: 37070 - protein, 57 aa, Diabrotica virgifera
  misc_feature: Coding regions on vcDNA: vcDNA=SeqID_16767; Strand=-; Position=0-170
  misc_feature (5)..(18): Xaa can be any naturally occurring amino acid
  misc_feature (20)..(20): Xaa can be any naturally occurring amino acid
  misc_feature (24)..(30): Xaa can be any naturally occurring amino acid
  misc_feature (33)..(56): Xaa can be any naturally occurring amino acid
KKMGXXXXXXXXXXXXXXIXYHPXXXXXXXNNXXXXXXXXXXXXXXXXXXXXXXXXA

SEQ ID NO: 37071 - protein, 106 aa, Diabrotica virgifera
  misc_feature: Coding regions on vcDNA: vcDNA=SeqID_16768; Strand=-; Position=205-525
  misc_feature (7)..(25): Xaa can be any naturally occurring amino acid
  misc_feature (28)..(34): Xaa can be any naturally occurring amino acid
  misc_feature (40)..(61): Xaa can be any naturally occurring amino acid
  misc_feature (63)..(87): Xaa can be any naturally occurring amino acid
GSWNEGXXXXXXXXXXXXXXXXXXXKKXXXXXXXRRPYRXXXXXXXXXXXXXXXXXXXXXXGXXXXXXXXXXXXXXXXXXXXXXXXXIRINYLRDNSVILLESSNR

SEQ ID NO: 37072 - protein, 80 aa, Diabrotica virgifera
  misc_feature: Coding regions on vcDNA: vcDNA=SeqID_16769; Strand=-; Position=2-241
  misc_feature (1)..(14): Xaa can be any naturally occurring amino acid
  misc_feature (17)..(27): Xaa can be any naturally occurring amino acid
  misc_feature (37)..(44): Xaa can be any naturally occurring amino acid
  misc_feature (47)..(60): Xaa can be any naturally occurring amino acid
  misc_feature (66)..(79): Xaa can be any naturally occurring amino acid
XXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 37073 - protein, 189 aa, Diabrotica virgifera
  misc_feature: Coding regions on vcDNA: vcDNA=SeqID_16770; Strand=+; Position=261-830
  misc_feature: Homolog annotation: Hit_ID=EAA15064.2; Match level="QueryCoverage =98%, HitCoverage=50%, E-value=1e-26, Identity=35%"; Hit description =ENSANGP00000019373 [Anopheles gambiae str. PEST] ref|XP_552883.1| ENSANGP00000019373 [Anopheles gambiae st
  misc_feature: Gene Ontology Annotation: Molecular function=molecular_function unknown
  misc_feature: Pfam annotation: Pfam_ID=DUF227; Match level="Score=26.7, E-value =1.6e-06, Copies=1"; Pfam description=Domain of unknown function (DUF227)
  misc_feature (17)..(25): Xaa can be any naturally occurring amino acid
  misc_feature (183)..(183): Xaa can be any naturally occurring amino acid
MSVKNIETLLELHIGEXXXXXXXXXTNLVNPGENYGGELFKIDVTLEDSDTQKEEVLHIVGKIIPADDNSQEIFNVQNTFKSEIGFYEKIVPALQNFQRKHKIEEILDIFPKFYGSRINLDGSEKVDRDGVLLLENLKIEGYDNLDRYIGYNLEDAKILLRDLAVFPITVVALKIKQPDVFNXEIKPFL

SEQ ID NO: 37074 - protein, 63 aa, Diabrotica virgifera
  misc_feature: Coding regions on vcDNA: vcDNA=SeqID_16771; Strand=-; Position=0-188
  misc_feature (9)..(24): Xaa can be any naturally occurring amino acid
  misc_feature (29)..(41): Xaa can be any naturally occurring amino acid
  misc_feature (48)..(61): Xaa can be any naturally occurring amino acid
SYFVNPPRXXXXXXXXXXXXXXXXVIILXXXXXXXXXXXXXSFLLKDXXXXXXXXXXXXXXPS

SEQ ID NO: 37075 - protein, 20 aa, Diabrotica virgifera
  misc_feature: Coding regions on vcDNA: vcDNA=SeqID_16772; Strand=-; Position=2-61
  misc_feature (1)..(8): Xaa can be any naturally occurring amino acid
  misc_feature (12)..(20): Xaa can be any naturally occurring amino acid
XXXXXXXXINNXXXXXXXXX

SEQ ID NO: 37076 - protein, 21 aa, Diabrotica virgifera
  misc_feature: Coding regions on vcDNA: vcDNA=SeqID_16773; Strand=-; Position=1-63
  misc_feature (1)..(20): Xaa can be any naturally occurring amino acid
XXXXXXXXXXXXXXXXXXXXF

SEQ ID NO: 37077 - protein, 54 aa, Diabrotica virgifera
  misc_feature: Coding regions on vcDNA: vcDNA=SeqID_16774; Strand=-; Position=295-459
ISKSTVDVSTISRNLSSIFVTDFARYQHSMFDPALYSFYNGQVMAGTHLIFDHT

SEQ ID NO: 37078 - protein, 34 aa, Diabrotica virgifera; identical to SEQ ID NO: 27603
  misc_feature: Coding regions on vcDNA: vcDNA=SeqID_16775; Strand=-; Position=80-184

SEQ ID NO: 37079 - protein, 66 aa, Diabrotica virgifera; identical to SEQ ID NO: 26808
  misc_feature: Coding regions on vcDNA: vcDNA=SeqID_16776; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37080 - protein, 256 aa, Diabrotica virgifera
  misc_feature: Coding regions on vcDNA: vcDNA=SeqID_16777; Strand=-; Position=3-770
  misc_feature (7)..(17): Xaa can be any naturally occurring amino acid
  misc_feature (21)..(30): Xaa can be any naturally occurring amino acid
  misc_feature (40)..(47): Xaa can be any naturally occurring amino acid
  misc_feature (50)..(63): Xaa can be any naturally occurring amino acid
  misc_feature (69)..(82): Xaa can be any naturally occurring amino acid
  misc_feature (84)..(256): Xaa can be any naturally occurring amino acid
LFSLINXXXXXXXXXXXLSSXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37081 - protein, 284 aa, Diabrotica virgifera
  misc_feature: Coding regions on vcDNA: vcDNA=SeqID_16778; Strand=+; Position=1-853
  misc_feature: Homolog annotation: Hit_ID=XP_395865.1; Match level="QueryCoverage =98%, HitCoverage=46%, E-value=5e-83, Identity=56%"; Hit description =similar to ENSANGP00000010817 [Apis mellifera]
  misc_feature (160)..(166): Xaa can be any naturally occurring amino acid
  misc_feature (245)..(251): Xaa can be any naturally occurring amino acid
  misc_feature (260)..(260): Xaa can be any naturally occurring amino acid
GFSMKMRKHLKNKRLESLTQLGTDRIVDLQFGTGEAAYHVILELYDRGNILLTDYEHTILYVLRPHVEGDKLKFAVKEKYPQGRAREGGVISKEQLLEVLTKAKAGDQLKKVLVSNLEYGPALLEHVLVQHNFPNSTKIGKNFDPVDNLDKVFQAILDAXXXXXXXKAGQTKGYILQKKIERAKSDTTPNGEFYENQEFHPMLFEQHKEMPFKEFPTFNEAIDEFFSSLESQKIELKAVQQEREXXXXXXXVRKDHDQRXLVALEQTQAVDKQKAELITRRIGR

SEQ ID NO: 37082 - protein, 66 aa, Diabrotica virgifera; identical to SEQ ID NO: 26808
  misc_feature: Coding regions on vcDNA: vcDNA=SeqID_16779; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37083 - protein, 57 aa, Diabrotica virgifera
  misc_feature: Coding regions on vcDNA: vcDNA=SeqID_16780; Strand=-; Position=3-173
  misc_feature (17)..(27): Xaa can be any naturally occurring amino acid
  misc_feature (34)..(41): Xaa can be any naturally occurring amino acid
  misc_feature (52)..(57): Xaa can be any naturally occurring amino acid
SWYPIDRRSLSSFAHIXXXXXXXXXXXRPVALRXXXXXXXXSNRCEPGWFLXXXXXX

SEQ ID NO: 37084 - protein, 51 aa, Diabrotica virgifera
  misc_feature: Coding regions on vcDNA: vcDNA=SeqID_16781; Strand=+; Position=85-240
  misc_feature (40)..(49): Xaa can be any naturally occurring amino acid
FAFLSSLSHYLGASNSHIHCKILYINNIVTCIISYCKATXXXXXXXXXXKT

SEQ ID NO: 37085 - protein, 311 aa, Diabrotica virgifera
  misc_feature: Coding regions on vcDNA: vcDNA=SeqID_16782; Strand=+; Position=11-941
  misc_feature: Homolog annotation: Hit_ID=BAD11135.1; Match level="QueryCoverage =96%, HitCoverage=52%, E-value=1e-35, Identity=32%"; Hit description =putative transposase yabusame-1 [Bombyx mori]
  misc_feature (104)..(110): Xaa can be any naturally occurring amino acid
  misc_feature (278)..(278): Xaa can be any naturally occurring amino acid
MDRKRMKMTISDQEHEKIIRNIEEGISDSHFDYEITDESDSEEQDVFEENVSETEDNLEVNSDEESDAEPTEVDDNISEVSGPTYTSKSGMQWNSLPFVRSKRXXXXXXXVHPGLTNYSKNSNTFLDYFNLFLTEEMKNVICLHTNEEAVRRYQEWNEKHPNNKKEWTVLTNNELDSFLGALIKAGALRCGKESTREIWSTDTSIRRSFFTAALARNRFEELSSFLRFDDKVTRVERKEQDKLAAIRVICDMFVSNCDKAFEPYEHITRDEQLVSFRXGKCPFRQYIKSKPCRYGIKIWAAADVKHLIYQN

SEQ ID NO: 37086 - protein, 207 aa, Diabrotica virgifera
  misc_feature: Coding regions on vcDNA: vcDNA=SeqID_16783; Strand=+; Position=68-691
  misc_feature (136)..(179): Xaa can be any naturally occurring amino acid
SESGHSKFKYSTIKDSMLSYLIIIAIVSNAQVFGSNSTFNNVTALTAGNDLWFGLVRDCQEPTVSCIKNSIYNFLKNTFDYDRDLNFTSFMKFSKNNIIYKTPINQSITTGIENNFLIGDESPFEEISRSLKDHSXXXXXXXXXXXXXXXXXXXXXXXXXXXXXXXXXXXXXXXXXXXXDLKRSIGEGRILGNLIGKIISKYFVFKA

SEQ ID NO: 37087 - protein, 298 aa, Diabrotica virgifera
  misc_feature: Coding regions on vcDNA: vcDNA=SeqID_16784; Strand=-; Position=24-917
  misc_feature: Homolog annotation: Hit_ID=XP_310100.1; Match level="QueryCoverage =89%, HitCoverage=82%, E-value=3e-16, Identity=25%"; Hit description =ENSANGP00000018871 [Anopheles gambiae] ref|XP_310098.1| ENSANGP00000018873 [Anopheles gambiae]
  misc_feature: Pfam annotation: Pfam_ID=zf-CCHC; Match level="Score=10.1, E-value =0.028, Copies=1"; Pfam description=Zinc knuckle
  misc_feature (29)..(29): Xaa can be any naturally occurring amino acid
  misc_feature (47)..(47): Xaa can be any naturally occurring amino acid
  misc_feature (63)..(63): Xaa can be any naturally occurring amino acid
  misc_feature (172)..(177): Xaa can be any naturally occurring amino acid
GEEGIEIYNTLELREAQKGKLADVLEALXSYVTPRKNVVYERYVFTXRIQEEREPFDHFLTDXKNKVKNCEFGAEASSMVRDRIVLGTNSKDAQQNMLKTINLDLAKAIEICKMHEISQAQIKEVQNSLEKVKIESIGSKAKQGQNSVQTFRSANSRDEYSCRNCGRVHGPXXXXXXGKKCRKCGKNNHFDKVCYHSRLVREVQVEESENNEVGDFMISSITVNEIKNKNNKDWIENLKISNVDIPFKIDTGAQVNILPNGFNDLKETKVILETYGGFKVVPIGTIKLVCKYKNIDYL

SEQ ID NO: 37088 - protein, 79 aa, Diabrotica virgifera
  misc_feature: Coding regions on vcDNA: vcDNA=SeqID_16785; Strand=-; Position=1-237
  misc_feature (1)..(1): Xaa can be any naturally occurring amino acid
  misc_feature (4)..(19): Xaa can be any naturally occurring amino acid
  misc_feature (22)..(79): Xaa can be any naturally occurring amino acid
XNKXXXXXXXXXXXXXXXXYKXXXXXXXXXXXXXXXXXXXXXXXXXXXXXXXXXXXXXXXXXXXXXXXXXXXXXXXXXX

SEQ ID NO: 37089 - protein, 275 aa, Diabrotica virgifera
  misc_feature: Coding regions on vcDNA: vcDNA=SeqID_16786; Strand=+; Position=79-903
  misc_feature: Homolog annotation: Hit_ID=XP_321784.1; Match level="QueryCoverage =97%, HitCoverage=40%, E-value=1e-106, Identity=69%"; Hit description= ENSANGP00000009742 [Anopheles gambiae] gb|EAA01086.1| ENSANGP00000009742 [Anopheles gambiae
  misc_feature: Gene Ontology Annotation: Molecular function=general transcriptional repressor activity; Cellular component=cytoplasm; Biological process= signal transduction
  misc_feature: Pfam annotation: Pfam_ID=WD40; Match level="Score=129.2, E-value=9.6e- 36, Copies=5"; Pfam description=WD domain, G-beta repeat
  misc_feature (215)..(228): Xaa can be any naturally occurring amino acid
  misc_feature (230)..(230): Xaa can be any naturally occurring amino acid
  misc_feature (251)..(251): Xaa can be any naturally occurring amino acid
  misc_feature (265)..(265): Xaa can be any naturally occurring amino acid
MANLKPGSQNTRKKVQVSMVICEAEEKRHRSGVNALQLDPALDRLYSAGRDSIIRVYEHERFLHGMEHHTDWVNDIVLCCGGKHLISASSDTTVKVWNAHKGFCMSTLRTHKDYVKALAYAKDREQVASAGLDKSIYLWDINTLTALTASNNTVTTSSLVGSKESIYSLAMNPSGSIIVSGSTEKALRLWDPRTCAKLLKLKGHADNVKALVVSXXXXXXXXXXXXXXIXLWNLGSQRCVQTILVHTDSVXALLATESFSHVISXGRDEKVIMTD

SEQ ID NO: 37090 - protein, 87 aa, Diabrotica virgifera
  misc_feature: Coding regions on vcDNA: vcDNA=SeqID_16787; Strand=-; Position=197-460
  misc_feature (2)..(2): Xaa can be any naturally occurring amino acid
  misc_feature (5)..(7): Xaa can be any naturally occurring amino acid
  misc_feature (9)..(17): Xaa can be any naturally occurring amino acid
  misc_feature (19)..(19): Xaa can be any naturally occurring amino acid
  misc_feature (22)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (32)..(32): Xaa can be any naturally occurring amino acid
  misc_feature (36)..(36): Xaa can be any naturally occurring amino acid
  misc_feature (40)..(40): Xaa can be any naturally occurring amino acid
  misc_feature (50)..(51): Xaa can be any naturally occurring amino acid
  misc_feature (53)..(54): Xaa can be any naturally occurring amino acid
  misc_feature (57)..(58): Xaa can be any naturally occurring amino acid
  misc_feature (62)..(62): Xaa can be any naturally occurring amino acid
  misc_feature (64)..(64): Xaa can be any naturally occurring amino acid
  misc_feature (69)..(69): Xaa can be any naturally occurring amino acid
  misc_feature (73)..(74): Xaa can be any naturally occurring amino acid
  misc_feature (76)..(87): Xaa can be any naturally occurring amino acid
HXPFXXXNXXXXXXXXXSXLLXXLXKXKXSPXQLNXLTPXFSQSQLYKTXXNXXNLXXTIKXLXPHIHXYLNXXPXXXXXXXXXXXX

SEQ ID NO: 37091 - protein, 38 aa, Diabrotica virgifera
  misc_feature: Coding regions on vcDNA: vcDNA=SeqID_16788; Strand=-; Position=1-114
  misc_feature (2)..(36): Xaa can be any naturally occurring amino acid
IXXXXXXXXXXXXXXXXXXXXXXXXXXXXXXXXXXXIN

SEQ ID NO: 37092 - protein, 30 aa, Diabrotica virgifera
  misc_feature: Coding regions on vcDNA: vcDNA=SeqID_16789; Strand=-; Position=2-91
  misc_feature (19)..(26): Xaa can be any naturally occurring amino acid
KVILFQYKIHHRIACSRMXXXXXXXXQISK

SEQ ID NO: 37093 - protein, 75 aa, Diabrotica virgifera
  misc_feature: Coding regions on vcDNA: vcDNA=SeqID_16790; Strand=+; Position=520-747
VSFCFSPDEFIAFYDSSSVCRTFFSGKARNILFFFRRLTLEVRNFYTTLRGHFAVQTIMKNSVGYSTPLQYFTYI

SEQ ID NO: 37094 - protein, 107 aa, Diabrotica virgifera
  misc_feature: Coding regions on vcDNA: vcDNA=SeqID_16791; Strand=+; Position=2-325
  misc_feature: Pfam annotation: Pfam_ID=PBP_GOBP; Match level="Score=7.4, E-value =0.0029, Copies=1"; Pfam description=PBP/GOBP family
AKVHADCQAVPKTHEDEDKLRNLQNNIDDHQVGVHMFCMAVKAGLLKSNGDLDIPAITSKVSLVVKDHSKVDGLVQKCAKKSDNSGKTANLLFLCFVQNDIQYYHKL

SEQ ID NO: 37095 - protein, 128 aa, Diabrotica virgifera
  misc_feature: Coding regions on vcDNA: vcDNA=SeqID_16792; Strand=+; Position=264-650
  misc_feature: Homolog annotation: Hit_ID=XP_143000.4; Match level="QueryCoverage =86%, HitCoverage=82%, E-value=5e-25, Identity=45%"; Hit description =similar to zinc finger protein 347; zinc finger 1111 [Mus musculus]
  misc_feature: Gene Ontology Annotation: Molecular function=electron transporter activity; Cellular component=nucleus; Biological process =photoreceptor fate commitment (sensu Drosophila)
  misc_feature: Pfam annotation: Pfam_ID=zf-C2H2; Match level="Score=61.6, E-value =2.2e-15, Copies=3"; Pfam description=Zinc finger, C2H2 type
  misc_feature (42)..(42): Xaa can be any naturally occurring amino acid
  misc_feature (69)..(69): Xaa can be any naturally occurring amino acid
  misc_feature (87)..(87): Xaa can be any naturally occurring amino acid
  misc_feature (99)..(99): Xaa can be any naturally occurring amino acid
NIVLRSLLRKSIVGSTYDSTHSEKNSSQKHRNLNQHLKIHTXGEKPFKCEICLKQFSQKVSLDTHTNGXHLGKKPFKCETSFKAVYXSSGLKTHLRVHXGEKPYKCEICFNQFSQKAHLERHLRIHTE

SEQ ID NO: 37096 - protein, 173 aa, Diabrotica virgifera
  misc_feature: Coding regions on vcDNA: vcDNA=SeqID_16793; Strand=-; Position=405-926
  misc_feature (3)..(3): Xaa can be any naturally occurring amino acid
  misc_feature (10)..(122): Xaa can be any naturally occurring amino acid
  misc_feature (147)..(163): Xaa can be any naturally occurring amino acid
LVXKKIKLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRLMMIKRLRLITDILKIMKNILNXXXXXXXXXXXXXXXXXARSLKDYLII

SEQ ID NO: 37097 - protein, 36 aa, Diabrotica virgifera
  misc_feature: Coding regions on vcDNA: vcDNA=SeqID_16794; Strand=-; Position=1-108
LIACAMGILQPEETLCYIPKTYHSVGVIICSFNIAY

SEQ ID NO: 37098 - protein, 258 aa, Diabrotica virgifera
  misc_feature: Coding regions on vcDNA: vcDNA=SeqID_16795; Strand=-; Position=1-774
  misc_feature (1)..(185): Xaa can be any naturally occurring amino acid
  misc_feature (190)..(226): Xaa can be any naturally occurring amino acid
  misc_feature (229)..(258): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFRLXXXXXXXXXXXXXXXXXXXXXXXXXXXXXXXXXXXXXEVXXXXXXXXXXXXXXXXXXXXXXXXXXXXXX

SEQ ID NO: 37099 - protein, 93 aa, Diabrotica virgifera
  misc_feature: Coding regions on vcDNA: vcDNA=SeqID_16796; Strand=-; Position=69-350
VLNHPTIFFRDLFRRVFDIMSVNLGSLFGVDITCLASFISLFRGSVDGMSNSSKTTNGSDHPLRLMVVRKASYFLCINKEIIYCLSRSHCHYY

SEQ ID NO: 37100 - protein, 74 aa, Diabrotica virgifera
  misc_feature: Coding regions on vcDNA: vcDNA=SeqID_16797; Strand=-; Position=453-677
MLSYWRRVICSKRCLHDPKYSPSAEHLEGVNSSTKTDKNVKYYLPPNDVSSQMKQIERAQRKVCYFKTLADTEN

SEQ ID NO: 37101 - protein, 56 aa, Diabrotica virgifera
  misc_feature: Coding regions on vcDNA: vcDNA=SeqID_16798; Strand=-; Position=485-655
  misc_feature (18)..(18): Xaa can be any naturally occurring amino acid
TIVRFPENLIFVIFGKFXKVKFFVFMTCHQTFFCRFLIVLTNFQVAWRRKSRTLTY

SEQ ID NO: 37102 - protein, 44 aa, Diabrotica virgifera
  misc_feature: Coding regions on vcDNA: vcDNA=SeqID_16799; Strand=-; Position=183-317
  misc_feature (29)..(35): Xaa can be any naturally occurring amino acid
IKRDLFLKILDLLTVRSMLSRFKYNYYIXXXXXXXVLFLALLNL

SEQ ID NO: 37103 - protein, 37 aa, Diabrotica virgifera
  misc_feature: Coding regions on vcDNA: vcDNA=SeqID_16800; Strand=-; Position=1-111
  misc_feature (9)..(28): Xaa can be any naturally occurring amino acid
  misc_feature (30)..(37): Xaa can be any naturally occurring amino acid
KTCVFINRXXXXXXXXXXXXXXXXXXXXSXXXXXXXX

SEQ ID NO: 37104 - protein, 131 aa, Diabrotica virgifera
  misc_feature: Coding regions on vcDNA: vcDNA=SeqID_16801; Strand=+; Position=266-657
  misc_feature: Homolog annotation: Hit_ID=XP_394656.1; Match level="QueryCoverage =52%, HitCoverage=36%, E-value=1e-23, Identity=75%"; Hit description =similar to CG6190-PA [Apis mellifera]
  misc_feature: Gene Ontology Annotation: Molecular function=ubiquitin conjugating enzyme activity; Cellular component=nucleus; Biological process =brain development
  misc_feature (11)..(11): Xaa can be any naturally occurring amino acid
MKRAAAKKLIXRYFYQLTDGCGNPHCDNRYCASSGEMNPLTPDQAAAQAIQLFSQDARLCERHPNKIARKKENIIINKTETSNDVNFKSNLPTNDIESQSNYSNSKDSVKSNSAPVPTYLTEQALYDIIDE

SEQ ID NO: 37105 - protein, 44 aa, Diabrotica virgifera
  misc_feature: Coding regions on vcDNA: vcDNA=SeqID_16802; Strand=+; Position=1-135
FLLITNFRITFTESNITELGDRKSYAGIPEAEFVEADDDFMDGL

SEQ ID NO: 37106 - protein, 179 aa, Diabrotica virgifera
  misc_feature: Coding regions on vcDNA: vcDNA=SeqID_16803; Strand=+; Position=240-776
  misc_feature: Homolog annotation: Hit_ID=XP_396331.1; Match level="QueryCoverage =95%, HitCoverage=79%, E-value=3e-39, Identity=46%"; Hit description =similar to CG7838-PA [Apis mellifera]
  misc_feature: Gene Ontology Annotation: Molecular function=molecular_function unknown; Cellular component=nucleus; Biological process=mitotic spindle checkpoint
  misc_feature (110)..(110): Xaa can be any naturally occurring amino acid
  misc_feature (141)..(141): Xaa can be any naturally occurring amino acid
MDFEYSKENILPLLRGRNVHQLNMALQAQTNRDCQLELLQQKEKWEKLIETYTGEDPLENYYKYISWIEQTFPKHGHEGNLVPLLEQCLATFEADRRYANDRRFCKLWIXYFDLQPKPLEFYHMMKAKGLCTGCADFYKAXAYYHEAAGDFISANKVFEEGKLNLAQPFDELENAHQNL

SEQ ID NO: 37107 - protein, 275 aa, Diabrotica virgifera
  misc_feature: Coding regions on vcDNA: vcDNA=SeqID_16804; Strand=+; Position=74-898
  misc_feature (24)..(33): Xaa can be any naturally occurring amino acid
  misc_feature (36)..(63): Xaa can be any naturally occurring amino acid
  misc_feature (73)..(228): Xaa can be any naturally occurring amino acid
  misc_feature (230)..(242): Xaa can be any naturally occurring amino acid
  misc_feature (245)..(252): Xaa can be any naturally occurring amino acid
  misc_feature (257)..(257): Xaa can be any naturally occurring amino acid
  misc_feature (260)..(275): Xaa can be any naturally occurring amino acid
LISIRERISLSFSTKEKFISLRTXXXXXXXXXXHHXXXXXXXXXXXXXXXXXXXXXXXXXXXXRNVIRFSNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXFIXXXXXXXXLNFLXDEXXXXXXXXXXXXXXXX

SEQ ID NO: 37108 - protein, 55 aa, Diabrotica virgifera
  misc_feature: Coding regions on vcDNA: vcDNA=SeqID_16805; Strand=+; Position=186-353
YLPAEFYQNISIRPQNTRILVNYIRHMFLIFFSTCQYNKICFKTHLLDLLKTRGN

SEQ ID NO: 37109 - protein, 243 aa, Diabrotica virgifera
  misc_feature: Coding regions on vcDNA: vcDNA=SeqID_16806; Strand=-; Position=0-728
  misc_feature (1)..(185): Xaa can be any naturally occurring amino acid
  misc_feature (188)..(226): Xaa can be any naturally occurring amino acid
  misc_feature (228)..(242): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXXG

SEQ ID NO: 37110 - protein, 164 aa, Diabrotica virgifera
  misc_feature: Coding regions on vcDNA: vcDNA=SeqID_16807; Strand=+; Position=1-495
  misc_feature: Homolog annotation: Hit_ID=EAA08203.3; Match level="QueryCoverage =71%, HitCoverage=5%, E-value=2e-12, Identity=41%"; Hit description =ENSANGP00000002840 [Anopheles gambiae str. PEST] ref|XP_563500.1| ENSANGP00000002840 [Anopheles gambiae str
NQPSQATFKTETAALEKINLAIVDDEEDPNNELKSVVCQRCKSEKCHCKLTKSHKPWLSENASALQQIRSSDLTTADILEREVKNKKSMLRSEIKTKDDVEPKRLSPFSEMSRRDEGDGRSIADSNCSIYKNQFLTYQSATDKKAPKPATKLRTISLHRRNLPS

SEQ ID NO: 37111 - protein, 201 aa, Diabrotica virgifera
  misc_feature: Coding regions on vcDNA: vcDNA=SeqID_16808; Strand=-; Position=1-603
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(183): Xaa can be any naturally occurring amino acid
  misc_feature (186)..(193): Xaa can be any naturally occurring amino acid
  misc_feature (197)..(201): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGXXXXXXXXKKTXXXXX

SEQ ID NO: 37112 - protein, 278 aa, Diabrotica virgifera
  misc_feature: Coding regions on vcDNA: vcDNA=SeqID_16809; Strand=+; Position=96-929
  misc_feature: Homolog annotation: Hit_ID=XP_312441.1; Match level="QueryCoverage =98%, HitCoverage=50%, E-value=2e-90, Identity=64%"; Hit description =ENSANGP00000022164 [Anopheles gambiae]
  misc_feature: Gene Ontology Annotation: Molecular function=methylmalonate -semialdehyde dehydrogenase (acylating) activity; Cellular component =mitochondrion; Biological process=pyrimidine nucleotide metabolism
  misc_feature: Pfam annotation: Pfam_ID=Aldedh; Match level="Score=-111.3, E-value =5.7e-12, Copies=1"; Pfam description=Aldehyde dehydrogenase family
  misc_feature (46)..(46): Xaa can be any naturally occurring amino acid
  misc_feature (70)..(70): Xaa can be any naturally occurring amino acid
  misc_feature (77)..(77): Xaa can be any naturally occurring amino acid
  misc_feature (90)..(90): Xaa can be any naturally occurring amino acid
  misc_feature (143)..(143): Xaa can be any naturally occurring amino acid
  misc_feature (162)..(162): Xaa can be any naturally occurring amino acid
  misc_feature (183)..(183): Xaa can be any naturally occurring amino acid
  misc_feature (247)..(247): Xaa can be any naturally occurring amino acid
TLSRACRSKLGRYYSSSAAPNTKLFINRQNRSNHKQKTRIDLHNPXATNEVVTRVPKSTKKEMEDAVESXKEAFKSXSKTSIITRQQIIXKYQNIIKANMKELRLENITTEQGKTLGLDAEGDVLRGLQVVEHRFAAWPSQLXSGKLSPGVAKDLDIISYRXPLGVTASITPFNFPAMVPLWXFPWAITCGNTHVIKPSERDPGACMMLVEMLQEAGCPPGVVNVIHGAHDAVDFICDHPAIRAISXFVGSDIAGQYIYERGAKNGKRVQSNMGARNH

SEQ ID NO: 37113 - protein, 42 aa, Diabrotica virgifera; identical to SEQ ID NO: 30242
  misc_feature: Coding regions on vcDNA: vcDNA=SeqID_16810; Strand=-; Position=1-126
  misc_feature (1)..(42): Xaa can be any naturally occurring amino acid

SEQ ID NO: 37114 - protein, 212 aa, Diabrotica virgifera
  misc_feature: Coding regions on vcDNA: vcDNA=SeqID_16811; Strand=+; Position=34-669
  misc_feature (8)..(37): Xaa can be any naturally occurring amino acid
  misc_feature (41)..(117): Xaa can be any naturally occurring amino acid
  misc_feature (120)..(169): Xaa can be any naturally occurring amino acid
  misc_feature (179)..(188): Xaa can be any naturally occurring amino acid
NNKIPFRXXXXXXXXXXXXXXXXXXXXXXXXXXXXXXVVYXXXXXXXXXXXXXXXXXXXXXXXXXXXXXXXXXXXXXXXXXXXXXXXXXXXXXXXXXXXXXXXXXXXXXXXXXXXXXVKXXXXXXXXXXXXXXXXXXXXXXXXXXXXXXXXXXXXXXXXXXXXXXXXXXSDDDNIRIKXXXXXXXXXXLRKVLGKIFFACILITCIYVVMMK

SEQ ID NO: 37115 - protein, 58 aa, Diabrotica virgifera
  misc_feature: Coding regions on vcDNA: vcDNA=SeqID_16812; Strand=-; Position=83-259
  misc_feature (26)..(35): Xaa can be any naturally occurring amino acid
IYLTFRLPLRKSLYFDFDFRSGRQNXXXXXXXXXXVVLFSNKIEKYIVNVKFCNIILF

SEQ ID NO: 37116 - protein, 214 aa, Diabrotica virgifera
  misc_feature: Coding regions on vcDNA: vcDNA=SeqID_16813; Strand=+; Position=157-798
  misc_feature (14)..(21): Xaa can be any naturally occurring amino acid
  misc_feature (23)..(32): Xaa can be any naturally occurring amino acid
  misc_feature (47)..(214): Xaa can be any naturally occurring amino acid
LIIHHHSSSFEFQXXXXXXXXHXXXXXXXXXXVIETLFVFKYHLIFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37117 - protein, 170 aa, Diabrotica virgifera
  misc_feature: Coding regions on vcDNA: vcDNA=SeqID_16814; Strand=+; Position=313-822
  misc_feature: Homolog annotation: Hit_ID=XP_307274.1; Match level="QueryCoverage =90%, HitCoverage=30%, E-value=3e-35, Identity=47%"; Hit description =ENSANGP00000023005 [Anopheles gambiae]
  misc_feature (159)..(159): Xaa can be any naturally occurring amino acid
RCRYLLLLPDCKLLPRYPGPDEINNELIANGGDDLLNRIYKLMVSIWEKEYMPEEWKKGLIIPVFKKGDPTLCSNYRAITLLNTTYKIMTTIIRNRLTRYTEKNLGPYQQGFRKGRSTIDAIHVLTQTIEKSYEHGIELHILFIDFQQAFDSIYRKQLXKEMKNMNIPAK

SEQ ID NO: 37118 - protein, 66 aa, Diabrotica virgifera
  misc_feature: Coding regions on vcDNA: vcDNA=SeqID_16815; Strand=+; Position=226-426
LYMNTADCLGCIPKLHTFLEYWSGNSANLFRFFPTPCSLLHISRQCLVNIIESYRVQDTDLLSLPL

SEQ ID NO: 37119 - protein, 47 aa, Diabrotica virgifera; identical to SEQ ID NO: 26759
  misc_feature: Coding regions on vcDNA: vcDNA=SeqID_16816; Strand=+; Position=3-146
  misc_feature (1)..(15): Xaa can be any naturally occurring amino acid
  misc_feature (17)..(24): Xaa can be any naturally occurring amino acid

SEQ ID NO: 37120 - protein, 226 aa, Diabrotica virgifera
  misc_feature: Coding regions on vcDNA: vcDNA=SeqID_16817; Strand=-; Position=0-677
  misc_feature (1)..(18): Xaa can be any naturally occurring amino acid
  misc_feature (23)..(224): Xaa can be any naturally occurring amino acid
XXXXXXXXXXXXXXXXXXLISSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 37121 - protein, 84 aa, Diabrotica virgifera
  misc_feature: Coding regions on vcDNA: vcDNA=SeqID_16818; Strand=-; Position=203-457
SNNHLQISTKCPQNKPYIMVPISVLVMDTKIPGSRISTGMVLACTNYSRCPSGAKCRIQRYVGGDSPGWSPSDLAWPRTVAPGC

SEQ ID NO: 37122 - protein, 64 aa, Diabrotica virgifera
  misc_feature: Coding regions on vcDNA: vcDNA=SeqID_16819; Strand=-; Position=198-392
MLSCLDCPSYFCLKCITEFMISRLHDDVRSSYDEDMKTLKLLRRSGIRKTFINRVTKKTKVVKN

SEQ ID NO: 37123 - protein, 66 aa, Diabrotica virgifera; identical to SEQ ID NO: 26808
  misc_feature: Coding regions on vcDNA: vcDNA=SeqID_16820; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37124 - protein, 135 aa, Diabrotica virgifera
  misc_feature: Coding regions on vcDNA: vcDNA=SeqID_16821; Strand=-; Position=129-536
  misc_feature (20)..(35): Xaa can be any naturally occurring amino acid
  misc_feature (41)..(49): Xaa can be any naturally occurring amino acid
NSRLTLIVGSCKSNIVFDSXXXXXXXXXXXXXXXXPKIHTXXXXXXXXXTIWISNFSKEIWKRNIGQAILLEANDDDIEYVVLNHILNDDNVQNVHPVFNFDTLEPEQAKHLKNRLVKLSLFAFFNKSVFILYDV

SEQ ID NO: 37125 - protein, 87 aa, Diabrotica virgifera
  misc_feature: Coding regions on vcDNA: vcDNA=SeqID_16822; Strand=+; Position=592-852
  misc_feature (38)..(45): Xaa can be any naturally occurring amino acid
  misc_feature (58)..(58): Xaa can be any naturally occurring amino acid
  misc_feature (60)..(60): Xaa can be any naturally occurring amino acid
LVHLVYNDNLPVFFFLTGFTTRVSLRRIHYGPPSSAIXXXXXXXXYPILDRSVSHHLXSXSGTATDLLTSGLSKHTVFSTLSSSDLT

SEQ ID NO: 37126 - protein, 71 aa, Diabrotica virgifera
  misc_feature: Coding regions on vcDNA: vcDNA=SeqID_16823; Strand=+; Position=71-286
RYATPIARQYFIHIKEQSILCTLCIKPNHLLIYHLHYFQIQHSYPLNNVIAEAILLLILLQRNAIRFYSIV

SEQ ID NO: 37127 - protein, 235 aa, Diabrotica virgifera
  misc_feature: Coding regions on vcDNA: vcDNA=SeqID_16824; Strand=-; Position=1-705
  misc_feature (1)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(34): Xaa can be any naturally occurring amino acid
  misc_feature (36)..(178): Xaa can be any naturally occurring amino acid
  misc_feature (181)..(218): Xaa can be any naturally occurring amino acid
  misc_feature (220)..(235): Xaa can be any naturally occurring amino acid
XXXXXXXXXXXPXHXSXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRXXXXXXXXXXXXXXXX

SEQ ID NO: 37128 - protein, 270 aa, Diabrotica virgifera
  misc_feature: Coding regions on vcDNA: vcDNA=SeqID_16825; Strand=+; Position=3-812
  misc_feature: Homolog annotation: Hit_ID=EAA12068.3; Match level="QueryCoverage =97%, HitCoverage=24%, E-value=2e-41, Identity=42%"; Hit description =ENSANGP00000001912 [Anopheles gambiae str. PEST] ref|XP_555866.1| ENSANGP00000001912 [Anopheles gambiae st
  misc_feature: Gene Ontology Annotation: Molecular function=protein binding; Cellular component=apical cortex; Biological process=oocyte cell fate determination (sensu Insecta)
TTIQCTDATYASQLSLENPKGFSRDAFGRQSMSEKRHATLDAKNTDTYQKSKKIREERKMKEINADKLGQLGPSLGMKKSSSLESLQTMVQEIQMQEEGDPAYSYRGPNGALKVIRGKGCEESFRAAVVDPNHRSEIGAKKHWLLDGPMENEREVDGFSNARGGPRQSSLNAAIDIKNKSAKKKPGIFKGIGSMFRFGKHRKLDFQTAEAAQHYHHTNEFDSNANVPQQHTADTENRTQSSQPERTQEHSQKVPNSNPQNQNTFPRFSPP

SEQ ID NO: 37129 - protein, 113 aa, Diabrotica virgifera
  misc_feature: Coding regions on vcDNA: vcDNA=SeqID_16826; Strand=+; Position=77-418
YFVFQVVVTSVIEFLLFVTSKISNLSNFLVLRAELFVRVGALCSSSFFVVSRYYFISSILIYFSSIFVFAGLIFFLVTIISLSIFFSHISKANIRCIEASPNTHLRFSVSLPI

SEQ ID NO: 37130 - protein, 73 aa, Diabrotica virgifera
  misc_feature: Coding regions on vcDNA: vcDNA=SeqID_16827; Strand=-; Position=2-223
  misc_feature (15)..(21): Xaa can be any naturally occurring amino acid
TRVMYCSMALYKNLXXXXXXXSRVNFLYMYNIASNFTGFDDFGKGFNCVIRGVRPNSPICHRNTDLIQETSKK

SEQ ID NO: 37131 - protein, 66 aa, Diabrotica virgifera; identical to SEQ ID NO: 26808
  misc_feature: Coding regions on vcDNA: vcDNA=SeqID_16828; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37132 - protein, 79 aa, Diabrotica virgifera
  misc_feature: Coding regions on vcDNA: vcDNA=SeqID_16829; Strand=-; Position=2-238
  misc_feature (4)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
ILSXXXXXXXXXXPFXXXXXXXXXXXTNLAHTGLNXXXXXXXXSNXXXXXXXXXXXXXXPTSRSXXXXXXXXXXXXXXV

SEQ ID NO: 37133 - protein, 61 aa, Diabrotica virgifera
  misc_feature: Coding regions on vcDNA: vcDNA=SeqID_16830; Strand=+; Position=67-252
SLLYHLDNYNNNLFHWPLKLKILGNVFFSLFNTKEFIYQQEVFIYPSLPYFFKSGLMSNFI

SEQ ID NO: 37134 - protein, 186 aa, Diabrotica virgifera
  misc_feature: Coding regions on vcDNA: vcDNA=SeqID_16831; Strand=+; Position=2-562
  misc_feature (58)..(64): Xaa can be any naturally occurring amino acid
  misc_feature (84)..(135): Xaa can be any naturally occurring amino acid
VILFNVKMNRAGSTNYVLTKDTGIAQSVAPALTLEREGDTLYYFGYTFKGNWFQAMEXXXXXXXDLASIETKQENDFLYNQMKXXXXXXXXXXXXXXXXXXXXXXXXXXXXXXXXXXXXXXXXXXXXXXXXXXXXEVRYNYNNGLQWNDNNQNANLHALCEAKITKSVAEMVPLFCNFTDSVTVLR

SEQ ID NO: 37135 - protein, 227 aa, Diabrotica virgifera
  misc_feature: Coding regions on vcDNA: vcDNA=SeqID_16832; Strand=-; Position=1-681
  misc_feature: Homolog annotation: Hit_ID=CAA41925.1; Match level="QueryCoverage =57%, HitCoverage=24%, E-value=4e-09, Identity=35%"; Hit description =unnamed protein product [Drosophila miranda]
  misc_feature: Pfam annotation: Pfam_ID=RnaseH; Match level="Score=31.9, E-value =6.1e-07, Copies=1"; Pfam description=RNase H
MEKYHIDLSKAAPFPAQTTLTRCLPNTELRLENHNPKHLSSDIVLRKAALETIHTNYPAHEWLHIYCNGSSMPDSGRTGAGYVSIFSKGSIAVGAPLTNYDGEIAAIHEAAKSLENLQHPQKVAFFIDCKAAILALSTNRYTDCAQTISCRVQLSNLLEKGWLITLQWIPSHVGVEGNEAADELAKEGTTLPQPPSFQSYTSAKSTIKGGIKAKIKDQQIQAGAGKS

SEQ ID NO: 37136 - protein, 30 aa, Diabrotica virgifera
  misc_feature: Coding regions on vcDNA: vcDNA=SeqID_16833; Strand=-; Position=1-90
DLQRPGVYPNKLASSIVKVSKKNTIFEKKG

SEQ ID NO: 37137 - protein, 83 aa, Diabrotica virgifera
  misc_feature: Coding regions on vcDNA: vcDNA=SeqID_16834; Strand=+; Position=268-519
LQLSNRSANRIIIRRLATLTLGGVMGCGPLKRRQIVERYFIQCVLTWYGYLCVEVLYWSTILNAVQLNAMFRNFLVYSVYLEN

SEQ ID NO: 37138 - protein, 220 aa, Diabrotica virgifera
  misc_feature: Coding regions on vcDNA: vcDNA=SeqID_16835; Strand=-; Position=0-659
  misc_feature (1)..(206): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 37139 - protein, 269 aa, Diabrotica virgifera
  misc_feature: Coding regions on vcDNA: vcDNA=SeqID_16836; Strand=+; Position=109-914
  misc_feature: Homolog annotation: Hit_ID=XP_316248.1; Match level="QueryCoverage =96%, HitCoverage=76%, E-value=7e-94, Identity=49%"; Hit description =ENSANGP00000017051 [Anopheles gambiae]
  misc_feature: Gene Ontology Annotation: Molecular function=cell adhesion molecule activity; Cellular component=plasma membrane; Biological process =embryogenesis and morphogenesis
  misc_feature: Pfam annotation: Pfam_ID=LRR_1; Match level="Score=59.2, E-value=1.2e- 14, Copies=7"; Pfam description=Leucine Rich Repeat
  misc_feature (237)..(237): Xaa can be any naturally occurring amino acid
  misc_feature (258)..(259): Xaa can be any naturally occurring amino acid
MARVRLFRWTWVWAWTALAGLCALAATESQQQCPPIAEISPCSCTVKKNGLDILCEFTDQQHINDAMGKLKGKSLTIFYLKLRHNNLRKLTGFIFLGLDIRHLTIHNSSLSVVEEASLSSIGKMLTQLDVSQNSLTTVPSAAFKNLHQLLILNMNHNKVTSLHAKAFEGLDTLEILTLYENKITNIDTEAFVGLEKKLKRLNLGANGLTKVPQPSLAILDMLKKLEMQENRISDIKXEGDFEGLKNLDSLGLAPTQLXXVPSKVFSHLT

SEQ ID NO: 37140 - protein, 222 aa, Diabrotica virgifera
  misc_feature: Coding regions on vcDNA: vcDNA=SeqID_16837; Strand=+; Position=169-834
  misc_feature: Homolog annotation: Hit_ID=XP_396684.1; Match level="QueryCoverage =75%, HitCoverage=41%, E-value=2e-14, Identity=26%"; Hit description =similar to ENSANGP00000020767 [Apis mellifera]
  misc_feature: Gene Ontology Annotation: Biological process=female meiosis chromosome segregation
DVISKRVATPARIKKVGLFSVVPEIPIFKFDFNEVEECGSIIDNIVTVLKHSKSKHKDLDIEIKKTDKELRKRLVDFDAKKMGNKVEIKNLTHLLQRQQNRNNNLEGKVSRLETEVCTLVTRNKELQDIVKSLHNKINEKDLKLNQNILERERTKQKIALASEQMSQELDAKLKKQREHLNAAMIAKEIQLKKVREALETEIVIDTNDVAIENIPPSSVLTP

SEQ ID NO: 37141 - protein, 86 aa, Diabrotica virgifera
  misc_feature: Coding regions on vcDNA: vcDNA=SeqID_16838; Strand=-; Position=18-278
WMYSDARLACSCQLFKLGDFGNVDRPSYEGVVRSGCSRSVYFSITCSKGIVQYVMRELYTVFLHVAFFSSHLYFGSFIQKIYHYLL

SEQ ID NO: 37142 - protein, 34 aa, Diabrotica virgifera
  misc_feature: Coding regions on vcDNA: vcDNA=SeqID_16839; Strand=-; Position=102-206
  misc_feature (2)..(8): Xaa can be any naturally occurring amino acid
LXXXXXXXPEIYNKKVNVNVINDCNVLIKYNLQF

SEQ ID NO: 37143 - protein, 22 aa, Diabrotica virgifera
  misc_feature: Coding regions on vcDNA: vcDNA=SeqID_16840; Strand=-; Position=1-66
  misc_feature (16)..(16): Xaa can be any naturally occurring amino acid
VCRVPRHIEMNLTPFXGALFSN

SEQ ID NO: 37144 - protein, 295 aa, Diabrotica virgifera
  misc_feature: Coding regions on vcDNA: vcDNA=SeqID_16841; Strand=-; Position=1-885
  misc_feature (2)..(13): Xaa can be any naturally occurring amino acid
  misc_feature (16)..(16): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(283): Xaa can be any naturally occurring amino acid
  misc_feature (285)..(295): Xaa can be any naturally occurring amino acid
LXXXXXXXXXXXXPTXAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXX

SEQ ID NO: 37145 - protein, 101 aa, Diabrotica virgifera; identical to SEQ ID NO: 29675
  misc_feature: Coding regions on vcDNA: vcDNA=SeqID_16842; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 37146 - protein, 259 aa, Diabrotica virgifera
  misc_feature: Coding regions on vcDNA: vcDNA=SeqID_16843; Strand=-; Position=0-776
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(254): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRVG

SEQ ID NO: 37147 - protein, 205 aa, Diabrotica virgifera
  misc_feature: Coding regions on vcDNA: vcDNA=SeqID_16844; Strand=+; Position=255-872
  misc_feature: Homolog annotation: Hit_ID=NP_611472.1; Match level="QueryCoverage =61%, HitCoverage=24%, E-value=7e-22, Identity=40%"; Hit description =CG13868-PA [Drosophila melanogaster] gb|AAF57480.2| CG13868-PA [Drosophila melanogaster]
LENENAWSQNGTLLGFKQEPFYGAHGNLNGNVGLPVDAASCTLAQLIEDEQDNGLWPLEHPLPLPGWEEEYIAPYRLNNIREYETLACEIEMHLRKVLEEHNYDTVGNFLKLYESYKKSGNDNLLEFFHLYSPPITSEHHTCVGLAFELWNRLRLNLDSKYPGIGNHICVVSCEEEIDSPIVYTNAFRYDPTSLPYRLEHVMMCF

SEQ ID NO: 37148 - protein, 156 aa, Diabrotica virgifera
  misc_feature: Coding regions on vcDNA: vcDNA=SeqID_16845; Strand=-; Position=1-468
  misc_feature (2)..(86): Xaa can be any naturally occurring amino acid
  misc_feature (91)..(111): Xaa can be any naturally occurring amino acid
  misc_feature (113)..(153): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXEIPFXXXXXXXXXXXXXXXXXXXXXGXXXXXXXXXXXXXXXXXXXXXXXXXXXXXXXXXXXXXXXXXLTI

SEQ ID NO: 37149 - protein, 128 aa, Diabrotica virgifera
  misc_feature: Coding regions on vcDNA: vcDNA=SeqID_16846; Strand=-; Position=3-386
  misc_feature: Homolog annotation: Hit_ID=DAA04499.1; Match level="QueryCoverage =96%, HitCoverage=8%, E-value=1e-21, Identity=41%"; Hit description =TPA: pol polyprotein [Schistosoma mansoni]
KSKVSEVLRQLHDGTSGGHLGITKTLQKVRERFYWVNCKDNVRRWCRKCEPCASGNGPVGKKRAPMRQYNVGSPMERVAIDIAGPFPETDAGNKYILVAMDYFTKWTEAYALPNQEAATVAEVLVKEF

SEQ ID NO: 37150 - protein, 254 aa, Diabrotica virgifera
  misc_feature: Coding regions on vcDNA: vcDNA=SeqID_16847; Strand=-; Position=0-761
  misc_feature (2)..(14): Xaa can be any naturally occurring amino acid
  misc_feature (18)..(57): Xaa can be any naturally occurring amino acid
  misc_feature (59)..(105): Xaa can be any naturally occurring amino acid
  misc_feature (108)..(117): Xaa can be any naturally occurring amino acid
  misc_feature (120)..(165): Xaa can be any naturally occurring amino acid
  misc_feature (168)..(192): Xaa can be any naturally occurring amino acid
  misc_feature (196)..(203): Xaa can be any naturally occurring amino acid
  misc_feature (206)..(252): Xaa can be any naturally occurring amino acid
VXXXXXXXXXXXXXRRRXXXXXXXXXXXXXXXXXXXXXXXXXXXXXXXXXXXXXXXXNXXXXXXXXXXXXXXXXXXXXXXXXXXXXXXXXXXXXXXXXXXXXXXXRGXXXXXXXXXXPPXXXXXXXXXXXXXXXXXXXXXXXXXXXXXXXXXXXXXXXXXXXXXXEGXXXXXXXXXXXXXXXXXXXXXXXXXPRPXXXXXXXXHTXXXXXXXXXXXXXXXXXXXXXXXXXXXXXXXXXXXXXXXXXXXXXXXPP

SEQ ID NO: 37151 - protein, 175 aa, Diabrotica virgifera
  misc_feature: Coding regions on vcDNA: vcDNA=SeqID_16848; Strand=+; Position=3-530
  misc_feature: Homolog annotation: Hit_ID=CAG11718.1; Match level="QueryCoverage =99%, HitCoverage=44%, E-value=7e-29, Identity=38%"; Hit description =unnamed protein product [Tetraodon nigroviridis]
  misc_feature (62)..(67): Xaa can be any naturally occurring amino acid
EQLGVKALALTLEFDEAAVLKTNSAYLAYTLDLEEVIIKYTDDPEATEKMKECCPGSPFVLXXXXXXIKLEFINPVPQNGLFSKVLTVSDGDTYEKVVQRLAKDSKAMKKPESIQLWRFEDPVLGPTKIPAFNEPTKDKLQVSPDSVFKIDGSRLKLLLGKQTVDLGSQITYLVV

SEQ ID NO: 37152 - protein, 27 aa, Diabrotica virgifera
  misc_feature: Coding regions on vcDNA: vcDNA=SeqID_16849; Strand=+; Position=40-120
  misc_feature (5)..(5): Xaa can be any naturally occurring amino acid
FVYIXLYLSDLKHCIVANYLKMMAGRL

SEQ ID NO: 37153 - protein, 24 aa, Diabrotica virgifera
  misc_feature: Coding regions on vcDNA: vcDNA=SeqID_16850; Strand=+; Position=3-74
AIVFCFIIYFDSTFYFQLVLNSNP

SEQ ID NO: 37154 - protein, 173 aa, Diabrotica virgifera
  misc_feature: Coding regions on vcDNA: vcDNA=SeqID_16851; Strand=+; Position=285-803
  misc_feature: Homolog annotation: Hit_ID=AAL67866.1; Match level="QueryCoverage =99%, HitCoverage=64%, E-value=1e-37, Identity=50%"; Hit description =cytochrome c oxidase subunit III [Crioceris duodecimpunctata] ref|NP_ 569065.1| cytochrome c oxidase subuni
  misc_feature: Pfam annotation: Pfam_ID=COX3; Match level="Score=-36.7, E-value=4.1e- 15, Copies=1"; Pfam description=Cytochrome c oxidase subunit III
  misc_feature (11)..(11): Xaa can be any naturally occurring amino acid
  misc_feature (28)..(28): Xaa can be any naturally occurring amino acid
  misc_feature (39)..(39): Xaa can be any naturally occurring amino acid
  misc_feature (51)..(51): Xaa can be any naturally occurring amino acid
  misc_feature (68)..(68): Xaa can be any naturally occurring amino acid
  misc_feature (86)..(86): Xaa can be any naturally occurring amino acid
  misc_feature (134)..(134): Xaa can be any naturally occurring amino acid
  misc_feature (156)..(156): Xaa can be any naturally occurring amino acid
  misc_feature (158)..(158): Xaa can be any naturally occurring amino acid
MKILLFISFFXGFCPTPLTPTIELRILXPPIAIQALNPXKNPLIKYFISLXTTGLTVTRSAHHQPTIXNNFSHGLARHLLLTVTLXIYFTILQGYEYIESPFAISDYIYDSSFFITPGIHVPPVIIETTFLVFXLIRHYLNHFSSTRHCGYESSAXYXHCAYAAWLFLYISVH

SEQ ID NO: 37155 - protein, 42 aa, Diabrotica virgifera
  misc_feature: Coding regions on vcDNA: vcDNA=SeqID_16852; Strand=-; Position=110-238
SLKTYYRISSRDTFLHTNLRQPCTNNSLLMVMFISVKVSQTP

SEQ ID NO: 37156 - protein, 48 aa, Diabrotica virgifera
  misc_feature: Coding regions on vcDNA: vcDNA=SeqID_16853; Strand=+; Position=1-147
VRAGGDGAELPGPPSTPAHLIEENRPVPAIYTGDYFAAWITHRKNYRV

SEQ ID NO: 37157 - protein, 148 aa, Diabrotica virgifera
  misc_feature: Coding regions on vcDNA: vcDNA=SeqID_16854; Strand=+; Position=7-450
  misc_feature: Homolog annotation: Hit_ID=XP_395553.1; Match level="QueryCoverage =62%, HitCoverage=25%, E-value=1e-12, Identity=43%"; Hit description =similar to CG2056-PA [Apis mellifera]
MKSINLLICVLFVYLNIAEGISEDSSSAAVANEICKSYTEDAKKNHICPVPQETSLIGGILAEKGEFPHMVQLAYSKSNTTKYLCSGFIISKNYVLTAAHCVNGGGTNKPQFLRAGVTDVNDVSNEQVRSIDSIIIHPGFKRPAIYND

SEQ ID NO: 37158 - protein, 277 aa, Diabrotica virgifera
  misc_feature: Coding regions on vcDNA: vcDNA=SeqID_16855; Strand=+; Position=4-837
MVLLFFAELNSRFKKYFIAFLTYNTTTKMWKTFTNDDHIYMLKVVDSDNNFEIYLSDLMTMWNCILSQEALVQKFQECNPAIEQTPEEYIQHAKNILNEVENAEVGVICDEGPCSVRFYIKTHLATNFKFKLKLELDFAQAEEESFTEKMTVPLIQTIILLEKQQEMMRNLLLKKDRELEEYKMEKGEISRSDLITEKFNPESLIASSKTLMLNVFQNRAEDIKRKYGAIEEKVEEVEVESWNSVKRRRKIYNKETANRTKDVEIKYNGGTNIKQEN

SEQ ID NO: 37159 - protein, 162 aa, Diabrotica virgifera
  misc_feature: Coding regions on vcDNA: vcDNA=SeqID_16856; Strand=+; Position=84-572
  misc_feature: Homolog annotation: Hit_ID=CAH04309.1; Match level="QueryCoverage =96%, HitCoverage=77%, E-value=2e-14, Identity=36%"; Hit description =acidic p0 ribosomal protein [Carabus granulatus]
  misc_feature: Gene Ontology Annotation: Molecular function=structural constituent of ribosome; Cellular component=cytosolic ribosome (sensu Eukarya); Biological process=protein biosynthesis
  misc_feature (76)..(76): Xaa can be any naturally occurring amino acid
  misc_feature (107)..(107): Xaa can be any naturally occurring amino acid
EDCDNIIIFFEDNLNRDIEFTDAVAYTQMDSIRLSLLPNVVDPMSENTMTLTVIQVYIYPETALVNILPHVTRNRXCVISRQELVEINKYLLQQNMKVSAPLWENAXMIWDLPALNTDLVPGKTSFVQGLRSCKDMYRVTSKMFPEAHNLITGDDVGASVAT

SEQ ID NO: 37160 - protein, 128 aa, Diabrotica virgifera
  misc_feature: Coding regions on vcDNA: vcDNA=SeqID_16857; Strand=+; Position=218-604
  misc_feature: Homolog annotation: Hit_ID=NP_376058.1; Match level="QueryCoverage =91%, HitCoverage=98%, E-value=1e-21, Identity=47%"; Hit description =hypothetical protein ST0208 [Sulfolobus tokodaii str. 7] sp|Q976I0|PTH_SULTO Peptidyl-tRNA
  misc_feature: Gene Ontology Annotation: Molecular function=molecular_function unknown; Cellular component=cellular_component unknown; Biological process=biological_process unknown
  misc_feature: Pfam annotation: Pfam_ID=UPF0099; Match level="Score=104.7, E-value =2.3e-28, Copies=1"; Pfam description=Domain of unknown function UPF0099
MFKSLISSLQPSKMVIILRTDINMGRGKLASQAAHAAVLLYQSSIESNNLHLKSWLATGQPKIVLKVETNCEEVLKDTYNKAKNLNLNTCLVRDAGRTQVDVACLTAVGIGPNKKSDIDEITSSFKLL

SEQ ID NO: 37161 - protein, 98 aa, Diabrotica virgifera
  misc_feature: Coding regions on vcDNA: vcDNA=SeqID_16858; Strand=+; Position=257-553
FINMQIFVILHKNVMTHQLHEHMIRVTDITGDDDLSFKTDYEEVRAEIEEQDGEVGGKHEKKCWQKGNMMFRTEILLVEKSVLHVRTKTALEDHNGRM

SEQ ID NO: 37162 - protein, 84 aa, Diabrotica virgifera
  misc_feature: Coding regions on vcDNA: vcDNA=SeqID_16859; Strand=-; Position=1-252
  misc_feature (12)..(21): Xaa can be any naturally occurring amino acid
PRVEVGVSGDFXXXXXXXXXXRSVNRFLFFEGKLCSEIRERLDAVYGDYSPSMATNKCSHETTSEQYLRLFKRNPKEFLHRPGR

SEQ ID NO: 37163 - protein, 95 aa, Diabrotica virgifera
  misc_feature: Coding regions on vcDNA: vcDNA=SeqID_16860; Strand=+; Position=10-297
  misc_feature (19)..(24): Xaa can be any naturally occurring amino acid
RKVQHTPFLQPAKVNTKVXXXXXXGERRDRIVEVIRKKTSERCSESTELVPSAPQDPIRLADIRICCLPRIWRRRTDTSAVLCNYLNRIVIGVEL

SEQ ID NO: 37164 - protein, 285 aa, Diabrotica virgifera
  misc_feature: Coding regions on vcDNA: vcDNA=SeqID_16861; Strand=+; Position=3-860
  misc_feature: Homolog annotation: Hit_ID=XP_392063.1; Match level="QueryCoverage =100%, HitCoverage=44%, E-value=6e-72, Identity=54%"; Hit description= similar to ENSANGP00000016235 [Apis mellifera]
  misc_feature: Gene Ontology Annotation: Cellular component=nucleus; Biological process=cystoblast cell division
  misc_feature: Pfam annotation: Pfam_ID=RRM_1; Match level="Score=28.2, E-value=2.5e- 05, Copies=1"; Pfam description=RNA recognition motif. (a.k.a. RRM, R
  misc_feature (146)..(176): Xaa can be any naturally occurring amino acid
  misc_feature (284)..(284): Xaa can be any naturally occurring amino acid
SGSSVLPTAAAVAAAAATAKIQAMDAVASNAAALGLPTLNKAPTVPNVVTQPVVMPVITQPVVAGPTIVTTTAGIPAIIPPPGIAIPQITPNNTIQPAIVTPLITPPQIAAPTMVTPMPMVQQPSGSSAESMKKVQEAQLKQQEQXXXXXXXXXXXXXXXXXXXXXXXXXXXXXXXMQKLMRKVDSRVVILRNMVGPEDVDEMLQEEIQEECSKFGSVERVIIYNEKQSEEDDDSDVIVKIFVEFTKTYAAERARDVLNGRYFGGRMVQASLYDQTLFDHSDFXG

SEQ ID NO: 37165 - protein, 22 aa, Diabrotica virgifera
  misc_feature: Coding regions on vcDNA: vcDNA=SeqID_16862; Strand=-; Position=1-66
  misc_feature (1)..(22): Xaa can be any naturally occurring amino acid
XXXXXXXXXXXXXXXXXXXXXX

SEQ ID NO: 37166 - protein, 52 aa, Diabrotica virgifera
  misc_feature: Coding regions on vcDNA: vcDNA=SeqID_16863; Strand=+; Position=823-978
  misc_feature (18)..(18): Xaa can be any naturally occurring amino acid
DYDVVRRNINSLRDVLSXYSRIKFNIRVVMTKKLKTVHDHITVYGIHYGQHM

SEQ ID NO: 37167 - protein, 256 aa, Diabrotica virgifera
  misc_feature: Coding regions on vcDNA: vcDNA=SeqID_16864; Strand=+; Position=92-859
  misc_feature: Homolog annotation: Hit_ID=AAL73046.1; Match level="QueryCoverage =98%, HitCoverage=78%, E-value=1e-20, Identity=25%"; Hit description =IGFALS [Sphoeroides nephelus]
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=59.9, E-value=7e -15, Copies=6"; Pfam description=Leucine Rich Repeat
  misc_feature (92)..(97): Xaa can be any naturally occurring amino acid
KYSGDNPLTLVHANTVNDEENITEVQIEDEDIPVLKTGTFQNLSRLKVIRIHRNNLQDLENCPFYNVTALRIINLNFNRIKIVPENVFANLXXXXXXLKGNGISLLQPGAFYNLSNLHALDLSSNNIKYLPKDLFYLTNNVKTIDLSYNQMQYYWNIVPYSYFAEPFANVNRDEHSCIDLSFNNFTFISSMLFKNVPYVKQLYLNNNNIKRIGDAAFTDLRWVEMLDLEGNELEELSDGTLKSLSIANYVNLANNP

SEQ ID NO: 37168 - protein, 38 aa, Diabrotica virgifera
  misc_feature: Coding regions on vcDNA: vcDNA=SeqID_16865; Strand=-; Position=2-115
TPKLQLSYIFAYVIKYNSRTIIEYPVNNVKVHICSTIH

SEQ ID NO: 37169 - protein, 81 aa, Diabrotica virgifera
  misc_feature: Coding regions on vcDNA: vcDNA=SeqID_16866; Strand=-; Position=2-244
  misc_feature (16)..(16): Xaa can be any naturally occurring amino acid
  misc_feature (29)..(81): Xaa can be any naturally occurring amino acid
KLLSNIEVASLYRLTXPIKLRCIPKVFIXXXXXXXXXXXXXXXXXXXXXXXXXXXXXXXXXXXXXXXXXXXXXXXXXXXXX

SEQ ID NO: 37170 - protein, 138 aa, Diabrotica virgifera
  misc_feature: Coding regions on vcDNA: vcDNA=SeqID_16867; Strand=+; Position=378-792
  misc_feature: Homolog annotation: Hit_ID=XP_393961.1; Match level="QueryCoverage =89%, HitCoverage=12%, E-value=1e-26, Identity=51%"; Hit description =similar to CG3590-PA [Apis mellifera]
  misc_feature: Gene Ontology Annotation: Molecular function=adenylosuccinate lyase activity; Cellular component=cellular_component unknown; Biological process=purine nucleotide metabolism
  misc_feature (55)..(55): Xaa can be any naturally occurring amino acid
FPSIHLGATSCTNAYKTDIVHILDELPLLIPYLCNGINNLARLANMHNRLCTTLXYTHLQPAQLTTVVIKTTLWIYDFLMDEGTMNRAINDLPFRGVKGTTDTTASFTSVFINDRERCRDLHRIHAECMCSCEIISCY

SEQ ID NO: 37171 - protein, 92 aa, Diabrotica virgifera
  misc_feature: Coding regions on vcDNA: vcDNA=SeqID_16868; Strand=-; Position=491-769
TSYYTKGWLRRQYVENYLILQKVPYFICLCPFSSDSSSQHLAKGVPFLSFKINFLYYIFNMYFICLCPFSSDSSSQLDVLRHNGDSLSVNSA

SEQ ID NO: 37172 - protein, 43 aa, Diabrotica virgifera
  misc_feature: Coding regions on vcDNA: vcDNA=SeqID_16869; Strand=-; Position=2-130
DSFLQAAHSDWFHIVLVYHFLGEDEISRGVHIHRHELITHNTP

SEQ ID NO: 37173 - protein, 126 aa, Diabrotica virgifera
  misc_feature: Coding regions on vcDNA: vcDNA=SeqID_16870; Strand=+; Position=49-429
  misc_feature: Homolog annotation: Hit_ID=NP_731505.1; Match level="QueryCoverage =100%, HitCoverage=100%, E-value=7e-18, Identity=49%"; Hit description=CG6544-PC, isoform C [Drosophila melanogaster] gb|AAF54551.1| CG6544-PC, isoform C [Drosophila
  misc_feature (84)..(89): Xaa can be any naturally occurring amino acid
MVYESDFYTTRRPYRATPSVSSYTISTPRHYVVTDYPERTRKSAEQVYSYSYSSDSSNRSGYGDPRSRSYTSTESVSRSSTGGXXXXXXTSERTSRSRGDGPGGYSSSYSSTSSGPGTYRHYSYRV

SEQ ID NO: 37174 - protein, 70 aa, Diabrotica virgifera
  misc_feature: Coding regions on vcDNA: vcDNA=SeqID_16871; Strand=+; Position=514-726
RRVWYLLVIYSVMRGCTKKSNLKRKHCKLLYMRLFKSSITSTQKHEEYNFKHQNINIQSKILAGSAIFYH

SEQ ID NO: 37175 - protein, 70 aa, Diabrotica virgifera
  misc_feature: Coding regions on vcDNA: vcDNA=SeqID_16872; Strand=+; Position=400-609
FERISVSKWRIYKITSGKSGGSCSKFSLACSVSLSRTSHLHGGRNLASLFELDWDIPSVVTSDRDAWEKV

SEQ ID NO: 37176 - protein, 91 aa, Diabrotica virgifera; identical to SEQ ID NO: 28001
  misc_feature: Coding regions on vcDNA: vcDNA=SeqID_16873; Strand=-; Position=431-706
  misc_feature: Homolog annotation: Hit_ID=XP_453846.1; Match level="QueryCoverage =56%, HitCoverage=42%, E-value=1e-13, Identity=74%"; Hit description =unnamed protein product [Kluyveromyces lactis] emb|CAH00942.1| unnamed protein product

SEQ ID NO: 37177 - protein, 186 aa, Diabrotica virgifera
  misc_feature: Coding regions on vcDNA: vcDNA=SeqID_16874; Strand=+; Position=249-809
  misc_feature (3)..(9): Xaa can be any naturally occurring amino acid
  misc_feature (16)..(39): Xaa can be any naturally occurring amino acid
  misc_feature (47)..(55): Xaa can be any naturally occurring amino acid
  misc_feature (57)..(65): Xaa can be any naturally occurring amino acid
  misc_feature (69)..(78): Xaa can be any naturally occurring amino acid
  misc_feature (94)..(112): Xaa can be any naturally occurring amino acid
  misc_feature (115)..(123): Xaa can be any naturally occurring amino acid
  misc_feature (136)..(178): Xaa can be any naturally occurring amino acid
NVXXXXXXXLFYEINXXXXXXXXXXXXXXXXXXXXXXXXALKHKILXXXXXXXXXSXXXXXXXXXVIIXXXXXXXXXXITFLLTYKFTLFKFSXXXXXXXXXXXXXXXXXXXINXXXXXXXXXLLTTCLFVLNIKXXXXXXXXXXXXXXXXXXXXXXXXXXXXXXXXXXXXXXXXXXXLSRILFLR

SEQ ID NO: 37178 - protein, 69 aa, Diabrotica virgifera
  misc_feature: Coding regions on vcDNA: vcDNA=SeqID_16875; Strand=-; Position=35-244
ALELVFKKLNRQEKGIKRSGEYLNHVRYADDVLPIESDKEELSNVLLKLDREARKIGLRINYEKHKNNE

SEQ ID NO: 37179 - protein, 81 aa, Diabrotica virgifera
  misc_feature: Coding regions on vcDNA: vcDNA=SeqID_16876; Strand=-; Position=575-820
  misc_feature (30)..(53): Xaa can be any naturally occurring amino acid
ERIVPKKVIRDRFWCAHPFIPAFYKETKDXXXXXXXXXXXXXXXXXXXXXXXXNTEKACFVITRRKKCVRIPLVDLCIFAT

SEQ ID NO: 37180 - protein, 76 aa, Diabrotica virgifera
  misc_feature: Coding regions on vcDNA: vcDNA=SeqID_16877; Strand=+; Position=93-323
  misc_feature: Homolog annotation: Hit_ID=AAL78751.1; Match level="QueryCoverage =100%, HitCoverage=17%, E-value=2e-11, Identity=47%"; Hit description= translation elongation factor-1 gamma [Locusta migratoria]
  misc_feature (15)..(15): Xaa can be any naturally occurring amino acid
  misc_feature (27)..(27): Xaa can be any naturally occurring amino acid
  misc_feature (65)..(65): Xaa can be any naturally occurring amino acid
VAPDFVFEKTNKTKXFTKKFPRGNELXAFESKDAKDLQESNDITDYVPIEQLKEENDNDTIQILXWTGFVEGAIVP

SEQ ID NO: 37181 - protein, 36 aa, Diabrotica virgifera
  misc_feature: Coding regions on vcDNA: vcDNA=SeqID_16878; Strand=+; Position=39-146
  misc_feature (17)..(17): Xaa can be any naturally occurring amino acid
  misc_feature (29)..(29): Xaa can be any naturally occurring amino acid
TKEIQPEQAKLTYIEQXKATNSNFHFPSXHKFFRYY

SEQ ID NO: 37182 - protein, 28 aa, Diabrotica virgifera
  misc_feature: Coding regions on vcDNA: vcDNA=SeqID_16879; Strand=-; Position=1-84
  misc_feature (3)..(28): Xaa can be any naturally occurring amino acid
FIXXXXXXXXXXXXXXXXXXXXXXXXXX

SEQ ID NO: 37183 - protein, 60 aa, Diabrotica virgifera
  misc_feature: Coding regions on vcDNA: vcDNA=SeqID_16880; Strand=-; Position=96-278
KILSWFFIINEVFNKCSFLSSGRRRCGVNIISMFNHKCIAIGGIWKLSYRSWSAGLSRIP

SEQ ID NO: 37184 - protein, 57 aa, Diabrotica virgifera
  misc_feature: Coding regions on vcDNA: vcDNA=SeqID_16881; Strand=-; Position=151-324
  misc_feature (2)..(9): Xaa can be any naturally occurring amino acid
  misc_feature (27)..(47): Xaa can be any naturally occurring amino acid
EXXXXXXXXELNILLLVSNIIIISKCXXXXXXXXXXXXXXXXXXXXXLIYNLVKNKS

SEQ ID NO: 37185 - protein, 90 aa, Diabrotica virgifera
  misc_feature: Coding regions on vcDNA: vcDNA=SeqID_16882; Strand=+; Position=795 -1067
  misc_feature (67)..(78): Xaa can be any naturally occurring amino acid
YYLVSLFYLLLRKMQYSNVGNSSNKIMEKGLGKEPGYLSAIERNSGLEYFSYNFSRGTKRKNGFPPXXXXXXXXXXXXPGKRGGKGLIFS

SEQ ID NO: 37186 - protein, 29 aa, Diabrotica virgifera
  misc_feature: Coding regions on vcDNA: vcDNA=SeqID_16883; Strand=-; Position=0-86
  misc_feature (2)..(28): Xaa can be any naturally occurring amino acid
RXXXXXXXXXXXXXXXXXXXXXXXXXXXS

SEQ ID NO: 37187 - protein, 268 aa, Diabrotica virgifera
  misc_feature: Coding regions on vcDNA: vcDNA=SeqID_16884; Strand=+; Position=35-841
  misc_feature: Homolog annotation: Hit_ID=XP_393185.1; Match level="QueryCoverage =88%, HitCoverage=37%, E-value=4e-24, Identity=30%"; Hit description =similar to ENSANGP00000022165 [Apis mellifera]
  misc_feature: Gene Ontology Annotation: Molecular function=chaperone activity; Cellular component=extracellular space; Biological process=protein folding
  misc_feature (8)..(15): Xaa can be any naturally occurring amino acid
RFLLSRSXXXXXXXXEVDSVNTNNAVNEENSQEEKSSKTRKSKSKSPRLTTIERAREESEAITKGLGPEVEGRRRTRSAAKGVTATPPPPAKKERKSSSTTKSSRGRPKRTVEESSDSHDEKSETSVAESEEQAKSIDESKSEADTTETNSHDDKEESGNNNADASKCEDQAMSVDEKSEADGNETNSHDDKEESANNNADAKDEADADAEESTPAPAATENGAKEDSVDAPASEEEQDKAERESTSEDDDDAEEHVPQVEEGDHDEL

SEQ ID NO: 37188 - protein, 39 aa, Diabrotica virgifera
  misc_feature: Coding regions on vcDNA: vcDNA=SeqID_16885; Strand=+; Position=26-145
SVPAIPLSNMATENEQGDCPDDLQSRQQMFFHNDLIWAH

SEQ ID NO: 37189 - protein, 74 aa, Diabrotica virgifera
  misc_feature: Coding regions on vcDNA: vcDNA=SeqID_16886; Strand=-; Position=0-221
  misc_feature (3)..(3): Xaa can be any naturally occurring amino acid
  misc_feature (5)..(56): Xaa can be any naturally occurring amino acid
  misc_feature (59)..(69): Xaa can be any naturally occurring amino acid
RLXKXXXXXXXXXXXXXXXXXXXXXXXXXXXXXXXXXXXXXXXXXXXXXXXXXXXXVGXXXXXXXXXXXVFNNR

SEQ ID NO: 37190 - protein, 20 aa, Diabrotica virgifera
  misc_feature: Coding regions on vcDNA: vcDNA=SeqID_16887; Strand=-; Position=2-61
  misc_feature (5)..(20): Xaa can be any naturally occurring amino acid
SSLNXXXXXXXXXXXXXXXX

SEQ ID NO: 37191 - protein, 65 aa, Diabrotica virgifera
  misc_feature: Coding regions on vcDNA: vcDNA=SeqID_16888; Strand=-; Position=2-196
  misc_feature (2)..(12): Xaa can be any naturally occurring amino acid
  misc_feature (21)..(29): Xaa can be any naturally occurring amino acid
  misc_feature (31)..(45): Xaa can be any naturally occurring amino acid
  misc_feature (51)..(64): Xaa can be any naturally occurring amino acid
FXXXXXXXXXXXTNLAHTGLXXXXXXXXXSXXXXXXXXXXXXXXXPTSRSXXXXXXXXXXXXXXV

SEQ ID NO: 37192 - protein, 186 aa, Diabrotica virgifera
  misc_feature: Coding regions on vcDNA: vcDNA=SeqID_16889; Strand=-; Position=626 -1186
  misc_feature (1)..(32): Xaa can be any naturally occurring amino acid
  misc_feature (37)..(63): Xaa can be any naturally occurring amino acid
  misc_feature (69)..(78): Xaa can be any naturally occurring amino acid
  misc_feature (80)..(113): Xaa can be any naturally occurring amino acid
  misc_feature (118)..(141): Xaa can be any naturally occurring amino acid
  misc_feature (164)..(171): Xaa can be any naturally occurring amino acid
XXXXXXXXXXXXXXXXXXXXXXXXXXXXXXXXSLPPXXXXXXXXXXXXXXXXXXXXXXXXXXXKTVPTXXXXXXXXXXKXXXXXXXXXXXXXXXXXXXXXXXXXXXXXXXXXXGHKIXXXXXXXXXXXXXXXXXXXXXXXXGGGQGPIPFPPKKNIFFFPPNPXXXXXXXXNQTPIGIYLGCFSQK

SEQ ID NO: 37193 - protein, 167 aa, Diabrotica virgifera
  misc_feature: Coding regions on vcDNA: vcDNA=SeqID_16890; Strand=+; Position=64-564
  misc_feature: Homolog annotation: Hit_ID=XP_393030.1; Match level="QueryCoverage =97%, HitCoverage=21%, E-value=2e-33, Identity=52%"; Hit description =similar to ENSANGP00000001626 [Apis mellifera]
  misc_feature (45)..(51): Xaa can be any naturally occurring amino acid
  misc_feature (136)..(136): Xaa can be any naturally occurring amino acid
  misc_feature (138)..(138): Xaa can be any naturally occurring amino acid
MNTIERDPNKRKVKPVDPGDQTCVLDFDEESSDDSDFRIEDHPEXXXXXXXSLDSQGEGNGAEVSEDNEDESEDSDLEMLKGVGQPKTNGMERSVADVIEQAAKSKLKFNEKDAQIMICCGCLGDQSDGVNEIVEXDXCGVTVHEACYGVSDSNSVSSTDSLSPNTP

SEQ ID NO: 37194 - protein, 293 aa, Diabrotica virgifera
  misc_feature: Coding regions on vcDNA: vcDNA=SeqID_16891; Strand=-; Position=1-879
  misc_feature (1)..(37): Xaa can be any naturally occurring amino acid
  misc_feature (40)..(50): Xaa can be any naturally occurring amino acid
  misc_feature (60)..(67): Xaa can be any naturally occurring amino acid
  misc_feature (70)..(83): Xaa can be any naturally occurring amino acid
  misc_feature (89)..(102): Xaa can be any naturally occurring amino acid
  misc_feature (104)..(293): Xaa can be any naturally occurring amino acid
XXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37195 - protein, 280 aa, Diabrotica virgifera
  misc_feature: Coding regions on vcDNA: vcDNA=SeqID_16892; Strand=+; Position=60-902
  misc_feature: Homolog annotation: Hit_ID=XP_394222.1; Match level="QueryCoverage =91%, HitCoverage=82%, E-value=1e-53, Identity=37%"; Hit description =similar to ENSANGP00000015188 [Apis mellifera]
  misc_feature: Gene Ontology Annotation: Biological process=reproduction
  misc_feature: Pfam annotation: Pfam_ID=GMC_oxred_N; Match level="Score=134.2, E -value=3e-37, Copies=1"; Pfam description=GMC oxidoreductase
  misc_feature (54)..(54): Xaa can be any naturally occurring amino acid
  misc_feature (100)..(100): Xaa can be any naturally occurring amino acid
  misc_feature (154)..(160): Xaa can be any naturally occurring amino acid
  misc_feature (164)..(164): Xaa can be any naturally occurring amino acid
  misc_feature (213)..(213): Xaa can be any naturally occurring amino acid
  misc_feature (239)..(240): Xaa can be any naturally occurring amino acid
  misc_feature (247)..(247): Xaa can be any naturally occurring amino acid
  misc_feature (260)..(260): Xaa can be any naturally occurring amino acid
  misc_feature (264)..(264): Xaa can be any naturally occurring amino acid
  misc_feature (270)..(270): Xaa can be any naturally occurring amino acid
MTKLILFVSVILAAAVSSDAGIIQDILGSVNSKYDFIVIGAGSAGSVVANRLVXNPNWTVLALEAGINENFLNDIPITAWFQSKYPYDWGFKTEKQPNAXLSTIDGTWLIANGKAVGGTSVTNFMVYNRGNKEDYNEWAALGNNGWSYDDVLPXXXXXXXIVKXYDIDAGYHSNDGPLNIEPPGWESPLVDLFIKAGEELGYSQNDPDGKEQXGFSKIRGTERRGRRCSTATAFIKPYXXRSNFNLXVWCQSHQILIDPXTQKXRSRYIXYGIKHTVHAR

SEQ ID NO: 37196 - protein, 107 aa, Diabrotica virgifera
  misc_feature: Coding regions on vcDNA: vcDNA=SeqID_16893; Strand=-; Position=1-321
  misc_feature (6)..(9): Xaa can be any naturally occurring amino acid
  misc_feature (12)..(63): Xaa can be any naturally occurring amino acid
  misc_feature (66)..(107): Xaa can be any naturally occurring amino acid
IFYHPXXXXIYXXXXXXXXXXXXXXXXXXXXXXXXXXXXXXXXXXXXXXXXXXXXXXXXXXXXIPXXXXXXXXXXXXXXXXXXXXXXXXXXXXXXXXXXXXXXXXXX

SEQ ID NO: 37197 - protein, 71 aa, Diabrotica virgifera
  misc_feature: Coding regions on vcDNA: vcDNA=SeqID_16894; Strand=-; Position=1-213
  misc_feature (36)..(43): Xaa can be any naturally occurring amino acid
YCFSKLKVCEVSLIGKRIFNITPLYILDLIGLHYIXXXXXXXXVFVAYKSVKCFHNVLMLTWGKRGSPTRP

SEQ ID NO: 37198 - protein, 111 aa, Diabrotica virgifera
  misc_feature: Coding regions on vcDNA: vcDNA=SeqID_16895; Strand=-; Position=554-889
  misc_feature (7)..(7): Xaa can be any naturally occurring amino acid
MDHPIIXFKFEILLPLHHKNTKACHAIQGIYKVITNFLYENRNKFNSLYKHKNKQNTNGLLMPYPLTYCQNFQEWSILPIFPHIKYRVSQNASTIILSVILNGTPRTLYHH

SEQ ID NO: 37199 - protein, 270 aa, Diabrotica virgifera
  misc_feature: Coding regions on vcDNA: vcDNA=SeqID_16896; Strand=+; Position=99-908
  misc_feature: Pfam annotation: Pfam_ID=ubiquitin; Match level="Score=9.4, E-value =0.017, Copies=1"; Pfam description=Ubiquitin family
  misc_feature (176)..(182): Xaa can be any naturally occurring amino acid
  misc_feature (257)..(257): Xaa can be any naturally occurring amino acid
FFCTMEATLTFSVCYRTPEGFLTEQFEQLEYDTVENLKISIHQIFGIPPHRQIIDGWRTEPENDQSLLQICTDLGRTNYLFLRCRQEESIPTDSSFNAQENERDCMEIRAVKSCIRKISTHITASSVRFNMGKLSNIKDTVLLAPPLNRKFVVLYMHNSREEFSTTFLTRYLRDEXXXXXXXDYFCIIGWDVENRAYHSALCKAVEDANFGNLSALIQSEDCAAVIIQNINGFPNIISFLIGDEVDSSRDSFFICLXNCRDYLNCRSHGS

SEQ ID NO: 37200 - protein, 216 aa, Diabrotica virgifera
  misc_feature: Coding regions on vcDNA: vcDNA=SeqID_16897; Strand=+; Position=3-653
  misc_feature: Homolog annotation: Hit_ID=XP_309188.1; Match level="QueryCoverage =98%, HitCoverage=82%, E-value=1e-70, Identity=54%"; Hit description =ENSANGP00000018601 [Anopheles gambiae]
HASGENDDDNSELSEHRFLTKGAFLLTPSHDLSLDKAANICDKLNFRGSFSLTKTATGILFKFSEPEDFQQVFRKGFHKVTGGRLYRKVAIPCRPQKTFSLLVYEVPSDLPEDDIRASLYRYCSVVEVTRLPGRLDQSPGAPPPIRITVASLDEYNALLQQGLDFYGATYFPTEPLKKDQLNQLRGSKEKLLPVFDSAGFSRIPPPPTRTLKPIRS

SEQ ID NO: 37201 - protein, 302 aa, Diabrotica virgifera
  misc_feature: Coding regions on vcDNA: vcDNA=SeqID_16898; Strand=+; Position=1-905
  misc_feature: Homolog annotation: Hit_ID=EAL39935.1; Match level="QueryCoverage =100%, HitCoverage=19%, E-value=2e-66, Identity=45%"; Hit description= ENSANGP00000002241 [Anopheles gambiae str. PEST] ref|XP_556472.1| ENSANGP00000002241 [Anopheles gambiae s
  misc_feature (223)..(223): Xaa can be any naturally occurring amino acid
  misc_feature (271)..(271): Xaa can be any naturally occurring amino acid
  misc_feature (273)..(273): Xaa can be any naturally occurring amino acid
  misc_feature (294)..(294): Xaa can be any naturally occurring amino acid
  misc_feature (299)..(299): Xaa can be any naturally occurring amino acid
IPSNIRLSDPNFNIPSGIDLLIGVELFWDLLCVGQIKLGTQKPILQKTKFGWVLSGPLPKRYDHQIVTCNFAQQNECHHLSRFWEIEECPLLPPLSKEEIECEEHFKSTHKRNSDGRFVVSLPLKNSTDTLGESRSRAGKRFFNLERKLPNNPIMKDMYVSFMDEYISMGHMSKVEEPTDQAHFYLPHHGVLKENSLTTQLRVVFDGSCPTTSGVSVNDLQMXVGPVVQNDLISILFRFRQHTYVASADIAKMYRQILVCPSERNLQLILXEXDPQEPFATYSLNTVTYGTASXSFLAXRCL

SEQ ID NO: 37202 - protein, 227 aa, Diabrotica virgifera
  misc_feature: Coding regions on vcDNA: vcDNA=SeqID_16899; Strand=+; Position=1-680
  misc_feature: Homolog annotation: Hit_ID=AAR83167.1; Match level="QueryCoverage =100%, HitCoverage=79%, E-value=3e-58, Identity=54%"; Hit description= cytochrome oxidase subunit I [Tegeticula yuccasella] gb|AAR83140.1| cytochrome oxidase subunit I [Tegetic
  misc_feature: Pfam annotation: Pfam_ID=COX1; Match level="Score=-216.6, E-value =0.00069, Copies=1"; Pfam description=Cytochrome C and Quinol oxidase polype
  misc_feature (16)..(16): Xaa can be any naturally occurring amino acid
  misc_feature (34)..(34): Xaa can be any naturally occurring amino acid
  misc_feature (72)..(72): Xaa can be any naturally occurring amino acid
  misc_feature (93)..(93): Xaa can be any naturally occurring amino acid
  misc_feature (96)..(104): Xaa can be any naturally occurring amino acid
  misc_feature (119)..(119): Xaa can be any naturally occurring amino acid
  misc_feature (168)..(168): Xaa can be any naturally occurring amino acid
  misc_feature (194)..(194): Xaa can be any naturally occurring amino acid
  misc_feature (203)..(203): Xaa can be any naturally occurring amino acid
  misc_feature (215)..(215): Xaa can be any naturally occurring amino acid
TKRKDIGTLYVIFDIXAGMAGTSLKILVRAEVGXPGSLIGKDQIYNGIDTAHAFMITVFIGIPIIIAEFGNXLAPLILGAPAIAYPLQQIIYXLIXXXXXXXXXITNAGTKEGSGTAWXTAHPALTSHIAHVGPSLDLPIFRLHLAALPSILGATNFITPVTNIRPTXMTFDPLRLCDRADAVTPVLLLLSLPXMSWSYDNMXTDRDLNTSFFDXPADGGYPILYQH

SEQ ID NO: 37203 - protein, 45 aa, Diabrotica virgifera
  misc_feature: Coding regions on vcDNA: vcDNA=SeqID_16900; Strand=-; Position=1-135
  misc_feature (1)..(13): Xaa can be any naturally occurring amino acid
  misc_feature (18)..(45): Xaa can be any naturally occurring amino acid
XXXXXXXXXXXXXVSRLXXXXXXXXXXXXXXXXXXXXXXXXXXXX

SEQ ID NO: 37204 - protein, 65 aa, Diabrotica virgifera
  misc_feature: Coding regions on vcDNA: vcDNA=SeqID_16901; Strand=-; Position=363-560
  misc_feature (33)..(39): Xaa can be any naturally occurring amino acid
GKVVCYGKNKETPSRRKRKQLIKTTTRQTTLQXXXXXXXNHSLSDDLNVQIAAYHFRFKHLLFQE

SEQ ID NO: 37205 - protein, 46 aa, Diabrotica virgifera
  misc_feature: Coding regions on vcDNA: vcDNA=SeqID_16902; Strand=-; Position=2-139
  misc_feature (1)..(12): Xaa can be any naturally occurring amino acid
  misc_feature (16)..(45): Xaa can be any naturally occurring amino acid
XXXXXXXXXXXXAFYXXXXXXXXXXXXXXXXXXXXXXXXXXXXXXI

SEQ ID NO: 37206 - protein, 265 aa, Diabrotica virgifera
  misc_feature: Coding regions on vcDNA: vcDNA=SeqID_16903; Strand=+; Position=121-920
  misc_feature: Homolog annotation: Hit_ID=AAC47442.1; Match level="QueryCoverage =87%, HitCoverage=77%, E-value=2e-70, Identity=54%"; Hit description =caspase-1 [Spodoptera frugiperda] sp|P89116|ICE1_SPOFR Caspase-1 precursor
  misc_feature: Gene Ontology Annotation: Molecular function=caspase activity; Cellular component=cytoplasm; Biological process=cleavage of lamin
  misc_feature: Pfam annotation: Pfam_ID=Peptidase_C14; Match level="Score=191.2, E -value=2.2e-54, Copies=1"; Pfam description=Caspase domain
  misc_feature (202)..(202): Xaa can be any naturally occurring amino acid
  misc_feature (218)..(218): Xaa can be any naturally occurring amino acid
  misc_feature (234)..(234): Xaa can be any naturally occurring amino acid
MGDTGIDKVCNDFHSLEVEETFEDALDGQCLGRTRNGKSESDEGDAQGTDGKTSGEKDARMPVHKNSPYYNMDHPKRGMALIFNHEFFDDEDLLTRRGTNEDCRNLKECLIALGFDVQVFKDLDNRDIEQHIDDTAKIDHNKYDCLLISVLSHGDLGIVHAKDGPYKPETLWTPFTADKCPSLAGKPKIFFLQACRGRQFEXGIILKKTETDGEQTSXKIPVEADFLIVYLTAXGYFSWRNPVKGSWFIQSLCDELKKKAFELDL

SEQ ID NO: 37207 - protein, 34 aa, Diabrotica virgifera; identical to SEQ ID NO: 27603
  misc_feature: Coding regions on vcDNA: vcDNA=SeqID_16904; Strand=-; Position=80-184

SEQ ID NO: 37208 - protein, 46 aa, Diabrotica virgifera
  misc_feature: Coding regions on vcDNA: vcDNA=SeqID_16905; Strand=-; Position=74-214
  misc_feature (3)..(16): Xaa can be any naturally occurring amino acid
SYXXXXXXXXXXXXXXLINNYGLSIIKFVLSKCVFHCTAQTILYNI

SEQ ID NO: 37209 - protein, 94 aa, Diabrotica virgifera
  misc_feature: Coding regions on vcDNA: vcDNA=SeqID_16906; Strand=-; Position=2-283
  misc_feature (1)..(32): Xaa can be any naturally occurring amino acid
  misc_feature (34)..(35): Xaa can be any naturally occurring amino acid
  misc_feature (37)..(51): Xaa can be any naturally occurring amino acid
  misc_feature (56)..(56): Xaa can be any naturally occurring amino acid
  misc_feature (58)..(59): Xaa can be any naturally occurring amino acid
  misc_feature (63)..(83): Xaa can be any naturally occurring amino acid
  misc_feature (85)..(93): Xaa can be any naturally occurring amino acid
XXXXXXXXXXXXXXXXXXXXXXXXXXXXXXXXIXXLXXXXXXXXXXXXXXXVSRLXKXXKLLXXXXXXXXXXXXXXXXXXXXXPXXXXXXXXXI

SEQ ID NO: 37210 - protein, 70 aa, Diabrotica virgifera
  misc_feature: Coding regions on vcDNA: vcDNA=SeqID_16907; Strand=-; Position=140-352
LNSRQILYSRVVHLSVLIYILVKHASSISFSDSKEVVAVMSRHVTRPIKCLLHPWLTSQFILHILVFNNL

SEQ ID NO: 37211 - protein, 20 aa, Diabrotica virgifera
  misc_feature: Coding regions on vcDNA: vcDNA=SeqID_16908; Strand=-; Position=1-60
  misc_feature (2)..(9): Xaa can be any naturally occurring amino acid
  misc_feature (14)..(20): Xaa can be any naturally occurring amino acid
LXXXXXXXXLKTVXXXXXXX

SEQ ID NO: 37212 - protein, 311 aa, Diabrotica virgifera
  misc_feature: Coding regions on vcDNA: vcDNA=SeqID_16909; Strand=+; Position=1-936
  misc_feature (45)..(50): Xaa can be any naturally occurring amino acid
  misc_feature (151)..(161): Xaa can be any naturally occurring amino acid
SQLNCGDNKYKTPSKSSFAWIELDPSVFTNITAEDLKAFEKSLHXXXXXXFQFDESIHFKIPETPVTQTTQKETKVMELEDLIDTSILADFSDTAATTATNTTATFMPPKSLNNLLNKYSTSLIDENLQFPPPTDTQHSEYNNKSTLEVIXXXXXXXXXXXKDILDFFKLETLEDVFETNIPDSQATITYSPDIFDITNTANTNVIIEDDISEDSNSPIICSYFNKKKNVTIRNSQIEATYSQSLSSTPLTRKTEKNIDKLSQSSNKLCGNTGDPKKTPPEDLTTFSTFLSLHHSLVKKWKQCKSKESLIT

SEQ ID NO: 37213 - protein, 174 aa, Diabrotica virgifera
  misc_feature: Coding regions on vcDNA: vcDNA=SeqID_16910; Strand=-; Position=1-522
  misc_feature (5)..(11): Xaa can be any naturally occurring amino acid
  misc_feature (29)..(62): Xaa can be any naturally occurring amino acid
  misc_feature (64)..(88): Xaa can be any naturally occurring amino acid
  misc_feature (92)..(120): Xaa can be any naturally occurring amino acid
  misc_feature (122)..(142): Xaa can be any naturally occurring amino acid
  misc_feature (145)..(174): Xaa can be any naturally occurring amino acid
YGGGXXXXXXXGFLTFSQIKIRAGFSLKXXXXXXXXXXXXXXXXXXXXXXXXXXXXXXXXXXPXXXXXXXXXXXXXXXXXXXXXXXXXSIGXXXXXXXXXXXXXXXXXXXXXXXXXXXXXKXXXXXXXXXXXXXXXXXXXXXLGXXXXXXXXXXXXXXXXXXXXXXXXXXXXXX

SEQ ID NO: 37214 - protein, 196 aa, Diabrotica virgifera
  misc_feature: Coding regions on vcDNA: vcDNA=SeqID_16911; Strand=+; Position=23-613
  misc_feature: Homolog annotation: Hit_ID=XP_309305.1; Match level="QueryCoverage =80%, HitCoverage=65%, E-value=1e-21, Identity=37%"; Hit description =ENSANGP00000018509 [Anopheles gambiae]
  misc_feature (142)..(148): Xaa can be any naturally occurring amino acid
SEVKYLILVLKQQRISVIRKFSSQINIEKLEEESTLSPSDFISDEAKARDAIIEQKRNKSRLREQDRSILMNKNPYPEPCASHHGSLKYLRRTYGHYGEASGVNPSLCWPVKEELDSSKEYESLKHPYTIPEMIAEAAKLRXXXXXXXAIRQEEIVKKMQKLEGWKQDLFNRIAKKEAEARSVKIPCKHIFCLAWW

SEQ ID NO: 37215 - protein, 37 aa, Diabrotica virgifera
  misc_feature: Coding regions on vcDNA: vcDNA=SeqID_16912; Strand=+; Position=2-112
  misc_feature (2)..(31): Xaa can be any naturally occurring amino acid
  misc_feature (33)..(33): Xaa can be any naturally occurring amino acid
FXXXXXXXXXXXXXXXXXXXXXXXXXXXXXXIXRDEL

SEQ ID NO: 37216 - protein, 99 aa, Diabrotica virgifera
  misc_feature: Coding regions on vcDNA: vcDNA=SeqID_16913; Strand=+; Position=629-924
  misc_feature (38)..(38): Xaa can be any naturally occurring amino acid
  misc_feature (63)..(63): Xaa can be any naturally occurring amino acid
PSFWKRLENGEEFSHPYEFEWDRFTPWPIQLKKENPLXPLPGGETPLIEITEEGHWDGLVETXIKLVKNWLVDVEHHSYRTFMGYYLVWCKFLLERKDI

SEQ ID NO: 37217 - protein, 65 aa, Diabrotica virgifera
  misc_feature: Coding regions on vcDNA: vcDNA=SeqID_16914; Strand=-; Position=0-194
  misc_feature (1)..(10): Xaa can be any naturally occurring amino acid
  misc_feature (13)..(13): Xaa can be any naturally occurring amino acid
  misc_feature (17)..(63): Xaa can be any naturally occurring amino acid
XXXXXXXXXXKEXKLVXXXXXXXXXXXXXXXXXXXXXXXXXXXXXXXXXXXXXXXXXXXXXXXVA

SEQ ID NO: 37218 - protein, 186 aa, Diabrotica virgifera
  misc_feature: Coding regions on vcDNA: vcDNA=SeqID_16915; Strand=+; Position=31-594
  misc_feature: Homolog annotation: Hit_ID=XP_310186.1; Match level="QueryCoverage =79%, HitCoverage=44%, E-value=2e-35, Identity=53%"; Hit description =ENSANGP00000011006 [Anopheles gambiae]
  misc_feature: Gene Ontology Annotation: Molecular function=malic enzyme activity; Cellular component=cytosol
  misc_feature: Pfam annotation: Pfam_ID=Ldh_1_N; Match level="Score=17.1, E-value =3.2e-06, Copies=1"; Pfam description=lactate/malate dehydrogenase, NAD bind
  misc_feature (123)..(123): Xaa can be any naturally occurring amino acid
  misc_feature (133)..(133): Xaa can be any naturally occurring amino acid
  misc_feature (138)..(138): Xaa can be any naturally occurring amino acid
  misc_feature (155)..(155): Xaa can be any naturally occurring amino acid
MLVDRILYVFTCRENQIADADLGCGGLIAYSLVDMIAKEDVFDRNLTLPVRLLEITPMMSEVKYVALELADCSLPVLIEDVPSADADGLFNDDSAAFLVGAMARKVGMERNDLLACHRRMLRXQVEDVNKHDXKDVEXLILGCPADTSALVCSNXTPSIPEDHFTAMTRLYLYRDREESVFFNLFY

SEQ ID NO: 37219 - protein, 67 aa, Diabrotica virgifera
  misc_feature: Coding regions on vcDNA: vcDNA=SeqID_16916; Strand=+; Position=568-771
  misc_feature (39)..(57): Xaa can be any naturally occurring amino acid
FTLNITMDDYISITLPPILNKISRLSTDIPQHFFAPVYXXXXXXXXXXXXXXXXXXXNARAILSGLR

SEQ ID NO: 37220 - protein, 265 aa, Diabrotica virgifera
  misc_feature: Coding regions on vcDNA: vcDNA=SeqID_16917; Strand=+; Position=2-796
  misc_feature (2)..(21): Xaa can be any naturally occurring amino acid
  misc_feature (24)..(62): Xaa can be any naturally occurring amino acid
  misc_feature (66)..(128): Xaa can be any naturally occurring amino acid
  misc_feature (130)..(249): Xaa can be any naturally occurring amino acid
  misc_feature (254)..(254): Xaa can be any naturally occurring amino acid
NXXXXXXXXXXXXXXXXXXXXGPXXXXXXXXXXXXXXXXXXXXXXXXXXXXXXXXXXXXXXXMKRXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKSLXFFKDERPYRVY

SEQ ID NO: 37221 - protein, 79 aa, Diabrotica virgifera; identical to SEQ ID NO: 27306
  misc_feature: Coding regions on vcDNA: vcDNA=SeqID_16918; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 37222 - protein, 29 aa, Diabrotica virgifera
  misc_feature: Coding regions on vcDNA: vcDNA=SeqID_16919; Strand=+; Position=2-91
  misc_feature (9)..(9): Xaa can be any naturally occurring amino acid
HNNVKSLRXKFQDAEAWLRPWATLEQLAK

SEQ ID NO: 37223 - protein, 71 aa, Diabrotica virgifera
  misc_feature: Coding regions on vcDNA: vcDNA=SeqID_16920; Strand=+; Position=538-753
  misc_feature (46)..(52): Xaa can be any naturally occurring amino acid
IYCKSKILFFLKILNHKFYVILFLYIPTYCNFLSRVIRYYIKDGLXXXXXXXGMYYCIPTQLYSFTKENKL

SEQ ID NO: 37224 - protein, 274 aa, Diabrotica virgifera
  misc_feature: Coding regions on vcDNA: vcDNA=SeqID_16921; Strand=+; Position=24-840
  misc_feature: Homolog annotation: Hit_ID=XP_311745.1; Match level="QueryCoverage =98%, HitCoverage=31%, E-value=1e-50, Identity=40%"; Hit description =ENSANGP00000014233 [Anopheles gambiae]
  misc_feature (74)..(74): Xaa can be any naturally occurring amino acid
  misc_feature (85)..(85): Xaa can be any naturally occurring amino acid
  misc_feature (97)..(97): Xaa can be any naturally occurring amino acid
  misc_feature (143)..(143): Xaa can be any naturally occurring amino acid
  misc_feature (150)..(150): Xaa can be any naturally occurring amino acid
  misc_feature (175)..(175): Xaa can be any naturally occurring amino acid
  misc_feature (199)..(199): Xaa can be any naturally occurring amino acid
  misc_feature (218)..(218): Xaa can be any naturally occurring amino acid
  misc_feature (226)..(226): Xaa can be any naturally occurring amino acid
  misc_feature (229)..(229): Xaa can be any naturally occurring amino acid
  misc_feature (245)..(245): Xaa can be any naturally occurring amino acid
RSKSKTIFKTEANKGYFSVLNNRSKMADFSELLQEAEKLTNELGGSQDLPKVERSIRQVLEASTDLYSRVAQTXGAKDIQANLLXLGAKGVDLPKIXQKLESLSTKRTFEPILPVTDLDIYNTLENETRTQILSIFDSGYNKXYRLPKTXAWEHQQSEWKQEKRKILNAMSTSSXAAIGVGTNKHLTINLDRPTYGRRXSLVLWRLIYVSKIMEYKQXVSRSAQKXNLXNIFWSMVNDFKDQKVXDMWGIIKYMTQLPTSSKTDDPIKTRNTNT

SEQ ID NO: 37225 - protein, 35 aa, Diabrotica virgifera
  misc_feature: Coding regions on vcDNA: vcDNA=SeqID_16922; Strand=-; Position=1-105
  misc_feature (1)..(26): Xaa can be any naturally occurring amino acid
  misc_feature (30)..(30): Xaa can be any naturally occurring amino acid
  misc_feature (33)..(33): Xaa can be any naturally occurring amino acid
XXXXXXXXXXXXXXXXXXXXXXXXXXSRLXKKXKL

SEQ ID NO: 37226 - protein, 20 aa, Diabrotica virgifera
  misc_feature: Coding regions on vcDNA: vcDNA=SeqID_16923; Strand=-; Position=1-60
  misc_feature (1)..(19): Xaa can be any naturally occurring amino acid
XXXXXXXXXXXXXXXXXXXL

SEQ ID NO: 37227 - protein, 25 aa, Diabrotica virgifera
  misc_feature: Coding regions on vcDNA: vcDNA=SeqID_16924; Strand=+; Position=1-75
  misc_feature (2)..(22): Xaa can be any naturally occurring amino acid
GXXXXXXXXXXXXXXXXXXXXXRYL

SEQ ID NO: 37228 - protein, 84 aa, Diabrotica virgifera
  misc_feature: Coding regions on vcDNA: vcDNA=SeqID_16925; Strand=-; Position=196-450
NSHTERKKSLSNNILPSSSTLVSPLPQVFTFYFSIILHNYIQSRKKLVLHNEQLEEVCSYKDLGMKLTNSGRTEPSIDDKSDEG

SEQ ID NO: 37229 - protein, 234 aa, Diabrotica virgifera
  misc_feature: Coding regions on vcDNA: vcDNA=SeqID_16926; Strand=+; Position=93-794
  misc_feature: Homolog annotation: Hit_ID=AAT38514.1; Match level="QueryCoverage =84%, HitCoverage=43%, E-value=2e-31, Identity=35%"; Hit description =antennae-rich cytochrome P450 [Phyllopertha diversa]
EKLVGTIGAIFDIKLALSYIVSVNPIDVLLDFTMVIFLILLVTIIFLAYKYFTRHFDYWKKRGVHTKKPIPFFGHFYRTATFQTTLSELIQDLYHETDEPYFGVFAFDRPILVIKSPKLIKDILIKDFNTFCDRTVADPTHHPLLSKFAKWRHTRTKLTPLFTSSMQLINEKFVEYLGNIQGPFDAKYVAGHYSTEMIGRCFFAIDPRCFEETTTEFRDCVERTLSLPSEMNLY

SEQ ID NO: 37230 - protein, 43 aa, Diabrotica virgifera
  misc_feature: Coding regions on vcDNA: vcDNA=SeqID_16927; Strand=-; Position=2-130
DILTLQISGLLVLRIDLVPVTSFFSSDFYIMFLNNAISVFTGP

SEQ ID NO: 37231 - protein, 60 aa, Diabrotica virgifera
  misc_feature: Coding regions on vcDNA: vcDNA=SeqID_16928; Strand=-; Position=2-181
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(52): Xaa can be any naturally occurring amino acid
PFXXXXXXXXXXXTNLAHTGLNXXXXXXXXSNXXXXXXXXPIINXXXXXXXXSNRLNNII

SEQ ID NO: 37232 - protein, 254 aa, Diabrotica virgifera
  misc_feature: Coding regions on vcDNA: vcDNA=SeqID_16929; Strand=+; Position=116-877
  misc_feature: Homolog annotation: Hit_ID=XP_395425.1; Match level="QueryCoverage =99%, HitCoverage=33%, E-value=3e-52, Identity=40%"; Hit description =similar to ENSANGP00000021246 [Apis mellifera]
  misc_feature: Pfam annotation: Pfam_ID=Ion_trans_2; Match level="Score=74.0, E -value=4e-19, Copies=1"; Pfam description=Ion channel
MYVEGSHETKIVEHDLRTDRYNLIRNLRNLSISMPDKTSEGEWEGAAARMIFKYEDNIIAAYQKSQLILINRGHKIWTLWNAIVYCATVYTTLGYGHLYPSTTTGRALTIVYAIVGIPLFLIALTDFGKLFTRAIKFLWSFVRRLYYTGSCRKVRKSATASEIFKGAQMMYGIATFRRPSKDPSAESAASPFSTDITSIKPMSSHDTVISAMSEDTPTTPDLSTFEIDDEFNLPISVALFILVAYMFIGALVYC

SEQ ID NO: 37233 - protein, 113 aa, Diabrotica virgifera
  misc_feature: Coding regions on vcDNA: vcDNA=SeqID_16930; Strand=+; Position=306-647
  misc_feature: Homolog annotation: Hit_ID=XP_315163.1; Match level="QueryCoverage =77%, HitCoverage=38%, E-value=7e-09, Identity=38%"; Hit description =ENSANGP00000023823 [Anopheles gambiae]
EIAFAPLLKLVSKSLLEVRNVSVSRRTIRRRLSQINLRAFRPARAPQLLPQHRRARLPFAREWTLAEWKHTLLSDESRINLTGPDGRQRVYRRQNGKVCFMRYNRNTGLEEGQ

SEQ ID NO: 37234 - protein, 67 aa, Diabrotica virgifera
  misc_feature: Coding regions on vcDNA: vcDNA=SeqID_16931; Strand=+; Position=227-430
IIDLLNHVYEVISYSPINRTKSVKVEINSTNINVSLLTIYVYYNDYVSLRRMVSTIDEKKLHSLLTV

SEQ ID NO: 37235 - protein, 31 aa, Diabrotica virgifera
  misc_feature: Coding regions on vcDNA: vcDNA=SeqID_16932; Strand=+; Position=1-93
  misc_feature (1)..(21): Xaa can be any naturally occurring amino acid
XXXXXXXXXXXXXXXXXXXXXVFLIKKIKLP

SEQ ID NO: 37236 - protein, 99 aa, Diabrotica virgifera
  misc_feature: Coding regions on vcDNA: vcDNA=SeqID_16933; Strand=-; Position=119-418
TITSLLDEPGFSAPTATYHLYVGYDHLVINPQWTTSLHTIRQIKEGYSNVWHLTLLSMNSRGPASNKNPGCTSHLRSIESTRTVPTDSTSNTRTRQFIQ

SEQ ID NO: 37237 - protein, 104 aa, Diabrotica virgifera
  misc_feature: Coding regions on vcDNA: vcDNA=SeqID_16934; Strand=+; Position=632-943
  misc_feature (44)..(49): Xaa can be any naturally occurring amino acid
  misc_feature (94)..(102): Xaa can be any naturally occurring amino acid
LPISRQCFNLHNLITNKLSTNLHLIYRFLTLYFVVFYFDKKTNXXXXXXRINLWCKRLVCVYYHMTYTRMGCRLKCRQFRTGGKPEGVSAPNKXXXXXXXXXES

SEQ ID NO: 37238 - protein, 201 aa, Diabrotica virgifera
  misc_feature: Coding regions on vcDNA: vcDNA=SeqID_16935; Strand=+; Position=3-608
  misc_feature: Homolog annotation: Hit_ID=EAA05725.3; Match level="QueryCoverage =96%, HitCoverage=17%, E-value=4e-31, Identity=40%"; Hit description =ENSANGP00000004412 [Anopheles gambiae str. PEST] ref|XP_559953.1| ENSANGP00000004412 [Anopheles gambiae st
  misc_feature: Gene Ontology Annotation: Cellular component=endoplasmic reticulum
LKSTDNLQELIELVTFLQKAIERQGRQVTVSGALADLLSHYSSLLASQGELSTAIAYLGNSTNEKVSTLRDRLQVALGVKQVLAQDPRQPNRRGSHRTSLSTIGYNQFNTGLPNPSINNQPWQPQPTQCFPQPPKAFSPAPQAPPSHPPRPTSVGSNQGGSGLPSRKYVLDPSVSSNPYGSPPNQYVPPPIHSFQQNRLPV

SEQ ID NO: 37239 - protein, 216 aa, Diabrotica virgifera
  misc_feature: Coding regions on vcDNA: vcDNA=SeqID_16936; Strand=+; Position=3-653
  misc_feature (215)..(215): Xaa can be any naturally occurring amino acid
KTDNSEPVIIVNGTPEEVKICTENLKSTKYDLKPDAEEFVPRAFRTPEIPLSPVQFIKVPPNFMPIPVVPFNGQINPAFIPPGGIPINFLPPDPKMFPNFINFVPTPPRSEEATEKNKEAKEVTANHQNTCVIHHCTNIAKSEIPLKAEKIVEKSTPGKTIDIATIVSKLEEAAKEQEEDEDKSKVTEAEQITKKRIFKNNQKYRSNFKRNYYNXS

SEQ ID NO: 37240 - protein, 25 aa, Diabrotica virgifera
  misc_feature: Coding regions on vcDNA: vcDNA=SeqID_16937; Strand=+; Position=1-75
  misc_feature (3)..(24): Xaa can be any naturally occurring amino acid
WGXXXXXXXXXXXXXXXXXXXXXXT

SEQ ID NO: 37241 - protein, 55 aa, Diabrotica virgifera
  misc_feature: Coding regions on vcDNA: vcDNA=SeqID_16938; Strand=-; Position=16-183
  misc_feature (7)..(7): Xaa can be any naturally occurring amino acid
  misc_feature (17)..(17): Xaa can be any naturally occurring amino acid
ILNIIMXPKLKYYLDIXNKLNIKLTYLLYLLPPPPLRLDLSSYLLLLLDLLPSLS

SEQ ID NO: 37242 - protein, 58 aa, Diabrotica virgifera
  misc_feature: Coding regions on vcDNA: vcDNA=SeqID_16939; Strand=-; Position=162-338
MTDKILQMMEERKKLKGRNDNEYKKLHKSILRKIKNAKICGKWTSFHAKHHHHHHQGK

SEQ ID NO: 37243 - protein, 122 aa, Diabrotica virgifera
  misc_feature: Coding regions on vcDNA: vcDNA=SeqID_16940; Strand=+; Position=2-370
  misc_feature (104)..(114): Xaa can be any naturally occurring amino acid
AENGGDVGGIPNVFGKDGKIPTTDELLKMLEGMSELSEENKRELRESILSGGLAREAQNMADSVKENVASGGILGEFTILFIFLSIVFLILVFFGYKLYSSLMXXXXXXXXXXXQRQQKKKK

SEQ ID NO: 37244 - protein, 75 aa, Diabrotica virgifera
  misc_feature: Coding regions on vcDNA: vcDNA=SeqID_16941; Strand=+; Position=361-588
TKLQFSPISSAGAICDLRVCIAPREPNETNYLHDFSFLCISTRYLRMDSYFYKFMDTYLKHISPKTLFYFFYCSI

SEQ ID NO: 37245 - protein, 192 aa, Diabrotica virgifera
  misc_feature: Coding regions on vcDNA: vcDNA=SeqID_16942; Strand=+; Position=2-580
  misc_feature: Homolog annotation: Hit_ID=EAL33315.1; Match level="QueryCoverage =100%, HitCoverage=30%, E-value=9e-93, Identity=81%"; Hit description= GA20298-PA [Drosophila pseudoobscura]
  misc_feature: Gene Ontology Annotation: Molecular function=transporter activity; Cellular component=integral to plasma membrane; Biological process =transport
  misc_feature: Pfam annotation: Pfam_ID=EMP70; Match level="Score=-191.0, E-value =9.3e-10, Copies=1"; Pfam description=Endomembrane protein 70
NLLLMWVFVSLPLVYLGYYFGYRKQPYQHPVRTNQIPRQVPEQHWYMNPILCTLMAGILPFGAVFIELVFIFTAIWKNQFYYLFGFLFLVFVILIISCSQISIVMVYFQLCGEDYHWLWRSFIVSGGSALYILGYSLFYFMTVLEITEFIPTLLYISYTGLMVFTFWLLTGSIGFFAAYAFVRKIYAAVKID

SEQ ID NO: 37246 - protein, 63 aa, Diabrotica virgifera
  misc_feature: Coding regions on vcDNA: vcDNA=SeqID_16943; Strand=+; Position=133-324
EEDIKNLLDINQSINYKEQSMFKDFMKYNMMTVCFWIVRSGRISCSSKYFVECRSIWHSKFFD

SEQ ID NO: 37247 - protein, 245 aa, Diabrotica virgifera
  misc_feature: Coding regions on vcDNA: vcDNA=SeqID_16944; Strand=+; Position=1-735
  misc_feature (1)..(243): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKA

SEQ ID NO: 37248 - protein, 236 aa, Diabrotica virgifera
  misc_feature: Coding regions on vcDNA: vcDNA=SeqID_16945; Strand=-; Position=1-711
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(236): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37249 - protein, 81 aa, Diabrotica virgifera
  misc_feature: Coding regions on vcDNA: vcDNA=SeqID_16946; Strand=+; Position=124-369
  misc_feature (36)..(43): Xaa can be any naturally occurring amino acid
NSPRMNKVVKLVLSSEVYDSSSINNSQNKYNQVSQXXXXXXXXFSPVSARKVSKNRITFFRKMASFGIHQNGKYRPNNGQK

SEQ ID NO: 37250 - protein, 61 aa, Diabrotica virgifera
  misc_feature: Coding regions on vcDNA: vcDNA=SeqID_16947; Strand=-; Position=1-183
IGIIYLYIFSILYLLRPMSLRILILLSIFTIFSLPIPSIHSHLTNLISPYSNICSIYIKIY

SEQ ID NO: 37251 - protein, 71 aa, Diabrotica virgifera
  misc_feature: Coding regions on vcDNA: vcDNA=SeqID_16948; Strand=+; Position=368-583
  misc_feature (11)..(25): Xaa can be any naturally occurring amino acid
  misc_feature (29)..(45): Xaa can be any naturally occurring amino acid
  misc_feature (53)..(70): Xaa can be any naturally occurring amino acid
NLPLTIFIFYXXXXXXXXXXXXXXXHTLXXXXXXXXXXXXXXXXXQLKNSIFXXXXXXXXXXXXXXXXXXY

SEQ ID NO: 37252 - protein, 66 aa, Diabrotica virgifera; identical to SEQ ID NO: 26808
  misc_feature: Coding regions on vcDNA: vcDNA=SeqID_16949; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37253 - protein, 81 aa, Diabrotica virgifera
  misc_feature: Coding regions on vcDNA: vcDNA=SeqID_16950; Strand=-; Position=0-242
  misc_feature (20)..(28): Xaa can be any naturally occurring amino acid
  misc_feature (50)..(56): Xaa can be any naturally occurring amino acid
  misc_feature (71)..(78): Xaa can be any naturally occurring amino acid
RGGKRTASFFVPLEGGGRPXXXXXXXXXAKARPPPPSLFGASPFFFLPLXXXXXXXSGLFFYSSKLCTPPXXXXXXXXPPP

SEQ ID NO: 37254 - protein, 58 aa, Diabrotica virgifera
  misc_feature: Coding regions on vcDNA: vcDNA=SeqID_16951; Strand=-; Position=0-173
  misc_feature (4)..(20): Xaa can be any naturally occurring amino acid
  misc_feature (23)..(40): Xaa can be any naturally occurring amino acid
  misc_feature (43)..(57): Xaa can be any naturally occurring amino acid
PFHXXXXXXXXXXXXXXXXXSSXXXXXXXXXXXXXXXXXXPRXXXXXXXXXXXXXXXP

SEQ ID NO: 37255 - protein, 59 aa, Diabrotica virgifera
  misc_feature: Coding regions on vcDNA: vcDNA=SeqID_16952; Strand=-; Position=136-315
LFQNLVNLFIMSSRPQALSQAVALLTSIGNVKNESPVMDRLFLQCFTIQARPAMLNGNI

SEQ ID NO: 37256 - protein, 22 aa, Diabrotica virgifera
  misc_feature: Coding regions on vcDNA: vcDNA=SeqID_16953; Strand=+; Position=7-72
  misc_feature (7)..(8): Xaa can be any naturally occurring amino acid
  misc_feature (15)..(15): Xaa can be any naturally occurring amino acid
YKNKLPXXIQRNFIXESQSIIK

SEQ ID NO: 37257 - protein, 67 aa, Diabrotica virgifera; identical to SEQ ID NO: 32422
  misc_feature: Coding regions on vcDNA: vcDNA=SeqID_16954; Strand=-; Position=2-202
  misc_feature (3)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 37258 - protein, 234 aa, Diabrotica virgifera
  misc_feature: Coding regions on vcDNA: vcDNA=SeqID_16955; Strand=+; Position=235-937
  misc_feature: Homolog annotation: Hit_ID=AAT38512.1; Match level="QueryCoverage =77%, HitCoverage=36%, E-value=1e-31, Identity=41%"; Hit description =pheromone-degrading enzyme [Phyllopertha diversa]
  misc_feature: Gene Ontology Annotation: Molecular function=monooxygenase activity; Cellular component=extracellular space; Biological process =leukotriene metabolism
  misc_feature (53)..(53): Xaa can be any naturally occurring amino acid
  misc_feature (150)..(150): Xaa can be any naturally occurring amino acid
  misc_feature (189)..(189): Xaa can be any naturally occurring amino acid
  misc_feature (192)..(192): Xaa can be any naturally occurring amino acid
  misc_feature (203)..(203): Xaa can be any naturally occurring amino acid
  misc_feature (215)..(215): Xaa can be any naturally occurring amino acid
GQQQSSSTTPCCTNCNRYVPETPRSHTYWKQSRVQCWKKIQHYLSVSRFEAPXIFDRVGDIFIRTLKQQVNTASLNVFPLVTLCTLDIISEAAMGIQINAQESQTSEYVKSVNTMCNIFIGRVTSPIPHFLYRLTPTYYRERKAIRILHXRQTKSLILKWKKEVNANNQQDQSNQQDQSTRKRLAFLDXLLXSSIDSNHYLDXHPRRVDTFMFAXHDTTATAISFALYCLAMTP

SEQ ID NO: 37259 - protein, 307 aa, Diabrotica virgifera
  misc_feature: Coding regions on vcDNA: vcDNA=SeqID_16956; Strand=-; Position=205 -1128
  misc_feature (9)..(21): Xaa can be any naturally occurring amino acid
  misc_feature (58)..(64): Xaa can be any naturally occurring amino acid
  misc_feature (71)..(76): Xaa can be any naturally occurring amino acid
  misc_feature (78)..(84): Xaa can be any naturally occurring amino acid
  misc_feature (91)..(290): Xaa can be any naturally occurring amino acid
  misc_feature (297)..(307): Xaa can be any naturally occurring amino acid
QHPSHLPSXXXXXXXXXXXXXLSRGKKIPGGPFKNYTRGAGGELFIFYSKKPIFLINXXXXXXXEISFFKXXXXXXKXXXXXXXNFLHPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAHTKSXXXXXXXXXXX

SEQ ID NO: 37260 - protein, 37 aa, Diabrotica virgifera
  misc_feature: Coding regions on vcDNA: vcDNA=SeqID_16957; Strand=-; Position=2-112
  misc_feature (2)..(2): Xaa can be any naturally occurring amino acid
  misc_feature (5)..(36): Xaa can be any naturally occurring amino acid
NXSFXXXXXXXXXXXXXXXXXXXXXXXXXXXXXXXXI

SEQ ID NO: 37261 - protein, 113 aa, Diabrotica virgifera
  misc_feature: Coding regions on vcDNA: vcDNA=SeqID_16958; Strand=-; Position=579-920
LFILGKKLRILTMFFHVNSKIKLIFVFSTIKNIEYDQNQAFTTPWSISREISLFWGCAAHIIKSHNFLPIAYLNLKFSRKLLHDLCFNAVVIKIINLTFCHPKFLNKHGTDKI

SEQ ID NO: 37262 - protein, 272 aa, Diabrotica virgifera
  misc_feature: Coding regions on vcDNA: vcDNA=SeqID_16959; Strand=-; Position=1-816
  misc_feature (4)..(272): Xaa can be any naturally occurring amino acid
VSRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37263 - protein, 163 aa, Diabrotica virgifera
  misc_feature: Coding regions on vcDNA: vcDNA=SeqID_16960; Strand=+; Position=39-530
  misc_feature: Pfam annotation: Pfam_ID=E1_DerP2_DerF2; Match level="Score=-5.0, E -value=0.032, Copies=1"; Pfam description=ML domain
  misc_feature (97)..(102): Xaa can be any naturally occurring amino acid
MRDFFGTSFVVILLGFVNSTIVDKCRDGGIIPPSVNLKSDFEQNVEDCKQAPCVVYTGGNCYVELNFTSPGYVPSISPKYKATAMGVTLDYPCEKDXXXXXXNTVCPLVENELVSYTWVMALPSFYPECLADLEVSFTNDDDNSLIFCFRSQIDVRKPSRLAK

SEQ ID NO: 37264 - protein, 80 aa, Diabrotica virgifera
  misc_feature: Coding regions on vcDNA: vcDNA=SeqID_16961; Strand=+; Position=29-268
  misc_feature (71)..(77): Xaa can be any naturally occurring amino acid
TGAAGGVTSVSSLTLPTVYKKNCLVKPIVNVYINNNLVSSGVSVAPGVDEGHKNQGTYSVNINNSLKPCAXXXXXXXKLY

SEQ ID NO: 37265 - protein, 56 aa, Diabrotica virgifera
  misc_feature: Coding regions on vcDNA: vcDNA=SeqID_16962; Strand=-; Position=525-695
LYRLCDYTSISIWIIFIAPRNYIESFSNNFLQGCTEYAHSYIAQDSANKITHICIS

SEQ ID NO: 37266 - protein, 273 aa, Diabrotica virgifera
  misc_feature: Coding regions on vcDNA: vcDNA=SeqID_16963; Strand=-; Position=2-820
  misc_feature (4)..(28): Xaa can be any naturally occurring amino acid
  misc_feature (30)..(78): Xaa can be any naturally occurring amino acid
  misc_feature (80)..(216): Xaa can be any naturally occurring amino acid
  misc_feature (221)..(273): Xaa can be any naturally occurring amino acid
IIIXXXXXXXXXXXXXXXXXXXXXXXXXAXXXXXXXXXXXXXXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHSXXXXXXXXXXXXXXXXXXXXXXXXXXXXXXXXXXXXXXXXXXXXXXXXXXXXX

SEQ ID NO: 37267 - protein, 88 aa, Diabrotica virgifera
  misc_feature: Coding regions on vcDNA: vcDNA=SeqID_16964; Strand=+; Position=95-361
  misc_feature (61)..(67): Xaa can be any naturally occurring amino acid
NNELRNRIKGKLAPNPFDDVKETLRPRFRKLLTITSKLFDDGRYYTIVPMLVKNGSDGFEXXXXXXXKNDLGTWSRWLLDHDYDVFEW

SEQ ID NO: 37268 - protein, 36 aa, Diabrotica virgifera
  misc_feature: Coding regions on vcDNA: vcDNA=SeqID_16965; Strand=-; Position=1-108
  misc_feature (1)..(36): Xaa can be any naturally occurring amino acid
XXXXXXXXXXXXXXXXXXXXXXXXXXXXXXXXXXXX

SEQ ID NO: 37269 - protein, 243 aa, Diabrotica virgifera
  misc_feature: Coding regions on vcDNA: vcDNA=SeqID_16966; Strand=+; Position=2-730
  misc_feature (1)..(206): Xaa can be any naturally occurring amino acid
  misc_feature (208)..(234): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXKTRDPYRVL

SEQ ID NO: 37270 - protein, 249 aa, Diabrotica virgifera
  misc_feature: Coding regions on vcDNA: vcDNA=SeqID_16967; Strand=+; Position=19-764
  misc_feature: Homolog annotation: Hit_ID=EAA06242.2; Match level="QueryCoverage =94%, HitCoverage=34%, E-value=2e-77, Identity=64%"; Hit description =ENSANGP00000007994 [Anopheles gambiae str. PEST] ref|XP_566065.1| ENSANGP00000007994 [Anopheles gambiae st
  misc_feature: Gene Ontology Annotation: Molecular function=protein binding; Cellular component=dynein complex
  misc_feature (134)..(134): Xaa can be any naturally occurring amino acid
  misc_feature (163)..(163): Xaa can be any naturally occurring amino acid
MDVILDRPKPSMADRKAELERKKAKLQALREEKDRRRREKELKEVEEAASRTLLGGGGDRKELDDLLREVGVAPVSEVFSSISSANSLTPEPSRNHTPDTSLQPHILTNNVTAVKKKLPQLTVVPVQTTNIPPXEVVVYTKQTQTTTTGHDVRDDFGFWKKSXSSCSSSPLKGYMEDWWRPRKAHATDYYDEYNLNPGLEWEDEFTGEDEEGSLPPHLGGYGGSKLPPGILPHGLPQVKEVQPAVTALE

SEQ ID NO: 37271 - protein, 278 aa, Diabrotica virgifera
  misc_feature: Coding regions on vcDNA: vcDNA=SeqID_16968; Strand=+; Position=7-838
  misc_feature: Homolog annotation: Hit_ID=XP_392972.1; Match level="QueryCoverage =100%, HitCoverage=65%, E-value=1e-100, Identity=68%"; Hit description=similar to CG11888-PA [Apis mellifera]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature (144)..(158): Xaa can be any naturally occurring amino acid
  misc_feature (227)..(227): Xaa can be any naturally occurring amino acid
  misc_feature (250)..(250): Xaa can be any naturally occurring amino acid
  misc_feature (260)..(260): Xaa can be any naturally occurring amino acid
  misc_feature (273)..(273): Xaa can be any naturally occurring amino acid
MDIFESSITQSDDIISMLTYAFQVAMSLIQNRAFRNTVLRSLVGLYRGLVTPDYVNMCQCLIFLDDPLSVAEILDRLVTGKEDTELMAYQIAFDLYESATQQFLERVLVALRATAPVPSLLEEKAKPKPSGEGEGAMSTETGEXXXXXXXXXXXXXXXLDSLSDQDKEHQKRIEKLHTILSGEVSIELHLQFLIRSNHADLLILKQTKETVRVSICHTATVIANAFXHSGTTSDQFLRDNLEWLARATNXAKLTATARLXGVIHRGHEQEALXLMQSY

SEQ ID NO: 37272 - protein, 49 aa, Diabrotica virgifera
  misc_feature: Coding regions on vcDNA: vcDNA=SeqID_16969; Strand=+; Position=54-203
ELIYRMSEEMFKNDRVMLLEQKRTCMRVNVTYTALVFDRLSRVEVIDCL

SEQ ID NO: 37273 - protein, 77 aa, Diabrotica virgifera
  misc_feature: Coding regions on vcDNA: vcDNA=SeqID_16970; Strand=-; Position=96-329
YPHATHTFLPSAHAYTRYSSPNIHHNCTGNGEYKFYKLYKTMSNTHFHILVLNLHYIIHSDPQRILPETAHIPSHSS

SEQ ID NO: 37274 - protein, 81 aa, Diabrotica virgifera
  misc_feature: Coding regions on vcDNA: vcDNA=SeqID_16971; Strand=+; Position=1-246
RPDLLVPRKNSFFPGSGSIKKTSGMSIPNTGGRSTPPRRLDSLRQKIFLSFFSYEAPFLCKKIKHLNAYQVFEVVSICIET

SEQ ID NO: 37275 - protein, 161 aa, Diabrotica virgifera
  misc_feature: Coding regions on vcDNA: vcDNA=SeqID_16972; Strand=-; Position=511-996
  misc_feature (2)..(65): Xaa can be any naturally occurring amino acid
  misc_feature (69)..(87): Xaa can be any naturally occurring amino acid
  misc_feature (97)..(104): Xaa can be any naturally occurring amino acid
  misc_feature (115)..(124): Xaa can be any naturally occurring amino acid
EXXXXXXXXXXXXXXXXXXXXXXXXXXXXXXXXXXXXXXXXXXXXXXXXXXXXXXXXXXXXXXXXLPEXXXXXXXXXXXXXXXXXXXGPSKLIRWAXXXXXXXXKKTDVFNNRVXXXXXXXXXXNLMIFLLKIIPNFFELLEIIIRSDYLNFKINFKFDYF

SEQ ID NO: 37276 - protein, 296 aa, Diabrotica virgifera
  misc_feature: Coding regions on vcDNA: vcDNA=SeqID_16973; Strand=+; Position=1-892
  misc_feature: Homolog annotation: Hit_ID=XP_319955.1; Match level="QueryCoverage =85%, HitCoverage=61%, E-value=2e-16, Identity=27%"; Hit description =ENSANGP00000005283 [Anopheles gambiae]
  misc_feature: Pfam annotation: Pfam_ID=RVT_1; Match level="Score=-6.4, E-value =0.00035, Copies=1"; Pfam description=Reverse transcriptase (RNA -dependent
  misc_feature (73)..(73): Xaa can be any naturally occurring amino acid
  misc_feature (128)..(128): Xaa can be any naturally occurring amino acid
SPSVRNKPAYLCFIHLTKAFDRIQVKDVLHLLYRRNIPINIQTIENIYFHIRIQAKINGKLTQFIPVQSGIRXGDSLSTLLFNIIMDEIIEAVHKSHGYRMGNKEIRILCYADDAALIAETEDDLQRXHTYSIQQLRNTYIISAEKTKRMTTSKYPLRCKIEIDGKIIKQEARFRYLGINITSYGDVEEEVRQQSLKASKAAGSLNDTIWKNQHLRQDTKARIYKAAIIPILTYTVETRPDASKTRRLLETTEMKILRRKSGKSLLGRERSENIRSWHIEDINEWDKTEKGVELTH

SEQ ID NO: 37277 - protein, 157 aa, Diabrotica virgifera
  misc_feature: Coding regions on vcDNA: vcDNA=SeqID_16974; Strand=+; Position=61-533
  misc_feature: Homolog annotation: Hit_ID=XP_392590.1; Match level="QueryCoverage =77%, HitCoverage=16%, E-value=6e-19, Identity=50%"; Hit description =similar to CG10327-PA [Apis mellifera]
  misc_feature (36)..(36): Xaa can be any naturally occurring amino acid
  misc_feature (73)..(73): Xaa can be any naturally occurring amino acid
  misc_feature (88)..(88): Xaa can be any naturally occurring amino acid
  misc_feature (112)..(112): Xaa can be any naturally occurring amino acid
  misc_feature (119)..(119): Xaa can be any naturally occurring amino acid
MKGERSSNRIFARSLKYEGQEPIELPTEDDVTLIVXTLSAQIPESSVLKNNNPETIYRFGGVLIICKGRLTSXHTCMMRCDFIIYYTXDFPKEKKRKRDDNMEKSTAKTNDXMETKLAXTDLIDFAIPMKGNDYNLIEYICISLIEVVYDSMKRKTS

SEQ ID NO: 37278 - protein, 85 aa, Diabrotica virgifera
  misc_feature: Coding regions on vcDNA: vcDNA=SeqID_16975; Strand=-; Position=144-401
MVYMLRPCIPTSLPDAAHRFLFSETKHKSKPKVKRTPMCVSYIVIRVIRKCYIPVRPFRLYVMTPICLKNESATRWEKARSVPNE

SEQ ID NO: 37279 - protein, 286 aa, Diabrotica virgifera
  misc_feature: Coding regions on vcDNA: vcDNA=SeqID_16976; Strand=+; Position=169 -1026
  misc_feature (6)..(19): Xaa can be any naturally occurring amino acid
  misc_feature (21)..(32): Xaa can be any naturally occurring amino acid
  misc_feature (45)..(257): Xaa can be any naturally occurring amino acid
  misc_feature (259)..(275): Xaa can be any naturally occurring amino acid
  misc_feature (277)..(277): Xaa can be any naturally occurring amino acid
LIIIYXXXXXXXXXXXXXXHXXXXXXXXXXXXETLFVFQISSNFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXTXKIFGSQFFL

SEQ ID NO: 37280 - protein, 159 aa, Diabrotica virgifera
  misc_feature: Coding regions on vcDNA: vcDNA=SeqID_16977; Strand=+; Position=3-479
  misc_feature (16)..(23): Xaa can be any naturally occurring amino acid
  misc_feature (27)..(45): Xaa can be any naturally occurring amino acid
  misc_feature (67)..(91): Xaa can be any naturally occurring amino acid
  misc_feature (95)..(156): Xaa can be any naturally occurring amino acid
GPIFLFIFQIIKSSFXXXXXXXXIFTXXXXXXXXXXXXXXXXXXXHFLRTFVVSGINLINNYHHFIXXXXXXXXXXXXXXXXXXXXXXXXXKERXXXXXXXXXXXXXXXXXXXXXXXXXXXXXXXXXXXXXXXXXXXXXXXXXXXXXXXXXXXXXXKYG

SEQ ID NO: 37281 - protein, 238 aa, Diabrotica virgifera
  misc_feature: Coding regions on vcDNA: vcDNA=SeqID_16978; Strand=-; Position=2-715
  misc_feature (2)..(155): Xaa can be any naturally occurring amino acid
  misc_feature (158)..(195): Xaa can be any naturally occurring amino acid
  misc_feature (198)..(238): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXEVXXXXXXXXXXXXXXXXXXXXXXXXXXXXXXXXXXXXXXXXX

SEQ ID NO: 37282 - protein, 121 aa, Diabrotica virgifera
  misc_feature: Coding regions on vcDNA: vcDNA=SeqID_16979; Strand=-; Position=516-881
  misc_feature (1)..(14): Xaa can be any naturally occurring amino acid
  misc_feature (17)..(17): Xaa can be any naturally occurring amino acid
  misc_feature (24)..(31): Xaa can be any naturally occurring amino acid
  misc_feature (33)..(43): Xaa can be any naturally occurring amino acid
  misc_feature (54)..(54): Xaa can be any naturally occurring amino acid
  misc_feature (56)..(104): Xaa can be any naturally occurring amino acid
XXXXXXXXXXXXXXIFXHPPFQSXXXXXXXXLXXXXXXXXXXXKLSMARRDFIXIXXXXXXXXXXXXXXXXXXXXXXXXXXXXXXXXXXXXXXXXXXXXXXXXXKKFMKKIKNYNDDEKIK

SEQ ID NO: 37283 - protein, 24 aa, Diabrotica virgifera
  misc_feature: Coding regions on vcDNA: vcDNA=SeqID_16980; Strand=-; Position=1-72
  misc_feature (1)..(13): Xaa can be any naturally occurring amino acid
  misc_feature (16)..(22): Xaa can be any naturally occurring amino acid
XXXXXXXXXXXXXKKXXXXXXXSI

SEQ ID NO: 37284 - protein, 284 aa, Diabrotica virgifera
  misc_feature: Coding regions on vcDNA: vcDNA=SeqID_16981; Strand=-; Position=2-853
  misc_feature (1)..(211): Xaa can be any naturally occurring amino acid
  misc_feature (214)..(251): Xaa can be any naturally occurring amino acid
  misc_feature (254)..(262): Xaa can be any naturally occurring amino acid
  misc_feature (276)..(282): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXEVXXXXXXXXXKKDILSRYELTMIXXXXXXXLR

SEQ ID NO: 37285 - protein, 282 aa, Diabrotica virgifera
  misc_feature: Coding regions on vcDNA: vcDNA=SeqID_16982; Strand=-; Position=2-847
  misc_feature (2)..(16): Xaa can be any naturally occurring amino acid
  misc_feature (18)..(44): Xaa can be any naturally occurring amino acid
  misc_feature (48)..(48): Xaa can be any naturally occurring amino acid
  misc_feature (52)..(52): Xaa can be any naturally occurring amino acid
  misc_feature (55)..(86): Xaa can be any naturally occurring amino acid
  misc_feature (89)..(282): Xaa can be any naturally occurring amino acid
NXXXXXXXXXXXXXXXTXXXXXXXXXXXXXXXXXXXXXXXXXXXVSRXLKKXKLXXXXXXXXXXXXXXXXXXXXXXXXXXXXXXXXWIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37286 - protein, 268 aa, Diabrotica virgifera
  misc_feature: Coding regions on vcDNA: vcDNA=SeqID_16983; Strand=-; Position=1-804
  misc_feature (3)..(243): Xaa can be any naturally occurring amino acid
  misc_feature (248)..(268): Xaa can be any naturally occurring amino acid
LIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTRGXXXXXXXXXXXXXXXXXXXXX

SEQ ID NO: 37287 - protein, 70 aa, Diabrotica virgifera
  misc_feature: Coding regions on vcDNA: vcDNA=SeqID_16984; Strand=+; Position=312-525
  misc_feature: Homolog annotation: Hit_ID=XP_393267.1; Match level="QueryCoverage =75%, HitCoverage=8%, E-value=4e-11, Identity=54%"; Hit description =similar to CG13830-PA [Apis mellifera]
  misc_feature (26)..(26): Xaa can be any naturally occurring amino acid
RRYSKRALHTGLDSYCFPHHGNVWTXDALPDTCQYPEHLDDAPGCKGDHHPIGGIQIEYRLATRGNNLYP

SEQ ID NO: 37288 - protein, 82 aa, Diabrotica virgifera
  misc_feature: Coding regions on vcDNA: vcDNA=SeqID_16985; Strand=+; Position=1-249
AVRLFRGSQPPGGISRPFAKLRLTSFTLGRAFFKFSFIRIKPFSNFASHLILHQGPNSFRRNSSFLFIKNSLNSHFHSSFGG

SEQ ID NO: 37289 - protein, 57 aa, Diabrotica virgifera
  misc_feature: Coding regions on vcDNA: vcDNA=SeqID_16986; Strand=+; Position=72-245
VRRPPSPFKRNLETTTRINYIAVITPHALQHISLNLMTIHSLLLLCIDNYSFFKLIL

SEQ ID NO: 37290 - protein, 249 aa, Diabrotica virgifera
  misc_feature: Coding regions on vcDNA: vcDNA=SeqID_16987; Strand=-; Position=1-747
  misc_feature (2)..(25): Xaa can be any naturally occurring amino acid
  misc_feature (28)..(28): Xaa can be any naturally occurring amino acid
  misc_feature (31)..(37): Xaa can be any naturally occurring amino acid
  misc_feature (40)..(192): Xaa can be any naturally occurring amino acid
  misc_feature (195)..(233): Xaa can be any naturally occurring amino acid
  misc_feature (235)..(249): Xaa can be any naturally occurring amino acid
SXXXXXXXXXXXXXXXXXXXXXXXXQPXHPXXXXXXXDYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXGXXXXXXXXXXXXXXX

SEQ ID NO: 37291 - protein, 61 aa, Diabrotica virgifera
  misc_feature: Coding regions on vcDNA: vcDNA=SeqID_16988; Strand=-; Position=2-184
  misc_feature (7)..(13): Xaa can be any naturally occurring amino acid
IRIVIFXXXXXXXFLILSLINIDANYMDIVFTSRMCMRASSNRRDSSPHRDNRERERESRT

SEQ ID NO: 37292 - protein, 184 aa, Diabrotica virgifera
  misc_feature: Coding regions on vcDNA: vcDNA=SeqID_16989; Strand=+; Position=272-829
  misc_feature: Homolog annotation: Hit_ID=BAC15603.1; Match level="QueryCoverage =86%, HitCoverage=23%, E-value=2e-36, Identity=48%"; Hit description =prophenoloxidase-II [Holotrichia diomphalia]
  misc_feature (50)..(50): Xaa can be any naturally occurring amino acid
  misc_feature (64)..(64): Xaa can be any naturally occurring amino acid
  misc_feature (76)..(76): Xaa can be any naturally occurring amino acid
  misc_feature (85)..(85): Xaa can be any naturally occurring amino acid
  misc_feature (120)..(120): Xaa can be any naturally occurring amino acid
  misc_feature (147)..(147): Xaa can be any naturally occurring amino acid
  misc_feature (153)..(153): Xaa can be any naturally occurring amino acid
VNITLSTTYTAISSAHSLHYCRCPDKYVKLSLILARDREEVMIESTNSRXQVKYQEIFLASDLXPEHRVAYFIEDXAITLHHWHXNVTYPFEAAFYVINKNRREELFYYMHQHIVDRYNXESLCRAPIGVQRYIDGTKVIPEDYLPXTRQIVXSRPCPSRVDKHNLSNLTIDADQITRDIDDLD

SEQ ID NO: 37293 - protein, 97 aa, Diabrotica virgifera
  misc_feature: Coding regions on vcDNA: vcDNA=SeqID_16990; Strand=-; Position=0-290
  misc_feature (3)..(39): Xaa can be any naturally occurring amino acid
  misc_feature (41)..(79): Xaa can be any naturally occurring amino acid
  misc_feature (82)..(96): Xaa can be any naturally occurring amino acid
LIXXXXXXXXXXXXXXXXXXXXXXXXXXXXXXXXXXXXXHXXXXXXXXXXXXXXXXXXXXXXXXXXXXXXXXXXXXXXXQGXXXXXXXXXXXXXXXR

SEQ ID NO: 37294 - protein, 263 aa, Diabrotica virgifera
  misc_feature: Coding regions on vcDNA: vcDNA=SeqID_16991; Strand=-; Position=1-789
  misc_feature (5)..(5): Xaa can be any naturally occurring amino acid
  misc_feature (7)..(8): Xaa can be any naturally occurring amino acid
  misc_feature (11)..(31): Xaa can be any naturally occurring amino acid
  misc_feature (33)..(197): Xaa can be any naturally occurring amino acid
  misc_feature (201)..(238): Xaa can be any naturally occurring amino acid
  misc_feature (241)..(248): Xaa can be any naturally occurring amino acid
  misc_feature (250)..(261): Xaa can be any naturally occurring amino acid
VSRLXKXXKLXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXXXXXXXXXXXXXXEVXXXXXXXXKXXXXXXXXXXXXED

SEQ ID NO: 37295 - protein, 204 aa, Diabrotica virgifera
  misc_feature: Coding regions on vcDNA: vcDNA=SeqID_16992; Strand=-; Position=58-672
  misc_feature (1)..(137): Xaa can be any naturally occurring amino acid
  misc_feature (140)..(179): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXXGTKNEIFLLGEDERRFLSRIRINYV

SEQ ID NO: 37296 - protein, 77 aa, Diabrotica virgifera
  misc_feature: Coding regions on vcDNA: vcDNA=SeqID_16993; Strand=+; Position=247-480
  misc_feature (20)..(26): Xaa can be any naturally occurring amino acid
  misc_feature (60)..(70): Xaa can be any naturally occurring amino acid
IKYNQKCKHFSPRPTRLVEXXXXXXXFLGILNYTVCLCRTYTYSYYTYLCEELPTNKYLXXXXXXXXXXXHSYLFNK

SEQ ID NO: 37297 - protein, 243 aa, Diabrotica virgifera
  misc_feature: Coding regions on vcDNA: vcDNA=SeqID_16994; Strand=-; Position=1-729
  misc_feature (1)..(199): Xaa can be any naturally occurring amino acid
  misc_feature (201)..(239): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXEIKI

SEQ ID NO: 37298 - protein, 79 aa, Diabrotica virgifera
  misc_feature: Coding regions on vcDNA: vcDNA=SeqID_16995; Strand=-; Position=200-439
  misc_feature (4)..(4): Xaa can be any naturally occurring amino acid
  misc_feature (41)..(49): Xaa can be any naturally occurring amino acid
  misc_feature (65)..(71): Xaa can be any naturally occurring amino acid
PPHXLLRGGSCLVSFDRFFKNSEYMHFALFDLMFTSRNIAXXXXXXXXXPPPLYVGRRVWYHSIXXXXXXXYVFFSFSI

SEQ ID NO: 37299 - protein, 17 aa, Diabrotica virgifera
  misc_feature: Coding regions on vcDNA: vcDNA=SeqID_16996; Strand=-; Position=3-53
  misc_feature (8)..(14): Xaa can be any naturally occurring amino acid
LNNYTNIXXXXXXXTTF

SEQ ID NO: 37300 - protein, 73 aa, Diabrotica virgifera
  misc_feature: Coding regions on vcDNA: vcDNA=SeqID_16997; Strand=-; Position=48-269
  misc_feature (34)..(40): Xaa can be any naturally occurring amino acid
SFIWEINHKKTFPYKQLIIKMPQGNSFRTTKSLXXXXXXXIRLTKKRKYILICKLTSGNNAQLKNQKIKKVGL

SEQ ID NO: 37301 - protein, 268 aa, Diabrotica virgifera
  misc_feature: Coding regions on vcDNA: vcDNA=SeqID_16998; Strand=-; Position=1-804
  misc_feature (3)..(15): Xaa can be any naturally occurring amino acid
  misc_feature (19)..(205): Xaa can be any naturally occurring amino acid
  misc_feature (208)..(245): Xaa can be any naturally occurring amino acid
  misc_feature (248)..(268): Xaa can be any naturally occurring amino acid
NNXXXXXXXXXXXXXNLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXEVXXXXXXXXXXXXXXXXXXXXX

SEQ ID NO: 37302 - protein, 109 aa, Diabrotica virgifera
  misc_feature: Coding regions on vcDNA: vcDNA=SeqID_16999; Strand=-; Position=526-855
  misc_feature (21)..(32): Xaa can be any naturally occurring amino acid
  misc_feature (42)..(53): Xaa can be any naturally occurring amino acid
  misc_feature (55)..(61): Xaa can be any naturally occurring amino acid
  misc_feature (63)..(90): Xaa can be any naturally occurring amino acid
NKILYRLNKTVFFSSTPPFHXXXXXXXXXXXXPGPKYPGSSXXXXXXXXXXXXPXXXXXXXRXXXXXXXXXXXXXXXXXXXXXXXXXXXXSDYLNFKINLKFIILMRKI

SEQ ID NO: 37303 - protein, 285 aa, Diabrotica virgifera
  misc_feature: Coding regions on vcDNA: vcDNA=SeqID_17000; Strand=+; Position=39-896
  misc_feature: Homolog annotation: Hit_ID=NP_722501.1; Match level="QueryCoverage =98%, HitCoverage=32%, E-value=1e-43, Identity=37%"; Hit description =acidic 82 kDa protein [Mus musculus] gb|AAH28305.1| Acidic 82 kDa protein mRNA [Mus
  misc_feature: Gene Ontology Annotation: Molecular function=molecular_function unknown; Cellular component=cellular_component unknown; Biological process=biological_process unknown
  misc_feature (243)..(249): Xaa can be any naturally occurring amino acid
  misc_feature (281)..(281): Xaa can be any naturally occurring amino acid
MDTELNNESDAELSELEDNNEEIPNQIEESADSSDSEKSADDIDFVIDKEGVPDSTQEKSEKEKLLDEIFKDCPISFKEKKPKVKKIKKNSFIRQTLADLGFNDDGTLRSKPHHKQKKLLTKNQRDEVKKALKKSVITPEFEKLHVVPPLDVSEKKLKEQRKKERSLTKGSKWYGLPATELTDEVKRNLEVLQMRSVLDPKHFYKKNDLKVLPKYFQVGKVMDSPLDYYNNRLTKKERKKTLXXXXXXXAEFNKYNKRKYKEIITEKQQTHYKAWRQAKRXKKKK

SEQ ID NO: 37304 - protein, 258 aa, Diabrotica virgifera
  misc_feature: Coding regions on vcDNA: vcDNA=SeqID_17001; Strand=-; Position=1-774
  misc_feature (2)..(2): Xaa can be any naturally occurring amino acid
  misc_feature (6)..(6): Xaa can be any naturally occurring amino acid
  misc_feature (10)..(195): Xaa can be any naturally occurring amino acid
  misc_feature (198)..(235): Xaa can be any naturally occurring amino acid
  misc_feature (238)..(247): Xaa can be any naturally occurring amino acid
  misc_feature (253)..(258): Xaa can be any naturally occurring amino acid
RXLKKXKLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRYXXXXXXXXXXKDILSXXXXXX

SEQ ID NO: 37305 - protein, 322 aa, Diabrotica virgifera
  misc_feature: Coding regions on vcDNA: vcDNA=SeqID_17002; Strand=-; Position=1-966
  misc_feature (4)..(13): Xaa can be any naturally occurring amino acid
  misc_feature (23)..(29): Xaa can be any naturally occurring amino acid
  misc_feature (32)..(40): Xaa can be any naturally occurring amino acid
  misc_feature (51)..(63): Xaa can be any naturally occurring amino acid
  misc_feature (66)..(321): Xaa can be any naturally occurring amino acid
LFVXXXXXXXXXXQQLASHRFNXXXXXXXVDXXXXXXXXXIINLIQHRGPXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXH

SEQ ID NO: 37306 - protein, 69 aa, Diabrotica virgifera
  misc_feature: Coding regions on vcDNA: vcDNA=SeqID_17003; Strand=-; Position=29-238
  misc_feature (3)..(13): Xaa can be any naturally occurring amino acid
  misc_feature (52)..(61): Xaa can be any naturally occurring amino acid
KLXXXXXXXXXXXSRIVKILYVNSSKIKIVIKSKRRICFTSRLSHQQSNKNXXXXXXXXXXYSNVSIFI

SEQ ID NO: 37307 - protein, 60 aa, Diabrotica virgifera
  misc_feature: Coding regions on vcDNA: vcDNA=SeqID_17004; Strand=+; Position=25-207
QMRGVLCVFVLKKKIIIFYTWINVCYSLLSRGEDKYLCTDFVLFHFIFNTHLHSCVKNYY

SEQ ID NO: 37308 - protein, 137 aa, Diabrotica virgifera
  misc_feature: Coding regions on vcDNA: vcDNA=SeqID_17005; Strand=+; Position=1-414
  misc_feature (1)..(16): Xaa can be any naturally occurring amino acid
  misc_feature (18)..(28): Xaa can be any naturally occurring amino acid
  misc_feature (32)..(54): Xaa can be any naturally occurring amino acid
  misc_feature (69)..(95): Xaa can be any naturally occurring amino acid
  misc_feature (97)..(103): Xaa can be any naturally occurring amino acid
  misc_feature (105)..(119): Xaa can be any naturally occurring amino acid
XXXXXXXXXXXXXXXXPXXXXXXXXXXXSFIXXXXXXXXXXXXXXXXXXXXXXXRNETLFVFQISSNFXXXXXXXXXXXXXXXXXXXXXXXXXXXGXXXXXXXHXXXXXXXXXXXXXXXILKYVITSPFTSSSLPPP

SEQ ID NO: 37309 - protein, 244 aa, Diabrotica virgifera
  misc_feature: Coding regions on vcDNA: vcDNA=SeqID_17006; Strand=-; Position=170-904
  misc_feature (1)..(13): Xaa can be any naturally occurring amino acid
  misc_feature (18)..(41): Xaa can be any naturally occurring amino acid
  misc_feature (53)..(65): Xaa can be any naturally occurring amino acid
  misc_feature (67)..(77): Xaa can be any naturally occurring amino acid
  misc_feature (80)..(98): Xaa can be any naturally occurring amino acid
  misc_feature (101)..(198): Xaa can be any naturally occurring amino acid
  misc_feature (202)..(232): Xaa can be any naturally occurring amino acid
  misc_feature (235)..(242): Xaa can be any naturally occurring amino acid
XXXXXXXXXXXXXGSLVXXXXXXXXXXXXXXXXXXXXXXXXSSNASFQLRIKXXXXXXXXXXXXXAXXXXXXXXXXXLYXXXXXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVKXXXXXXXXXXXXXXXXXXXXXXXXXXXXXXXIKXXXXXXXXIN

SEQ ID NO: 37310 - protein, 66 aa, Diabrotica virgifera
  misc_feature: Coding regions on vcDNA: vcDNA=SeqID_17007; Strand=-; Position=2-199
  misc_feature (3)..(11): Xaa can be any naturally occurring amino acid
  misc_feature (17)..(17): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
SFXXXXXXXXXIETNLXSTGXNXXXXXXXXSNXXXXXXXXXXXXXXPTSRSXXXXXXXXXXXXXXV

SEQ ID NO: 37311 - protein, 72 aa, Diabrotica virgifera
  misc_feature: Coding regions on vcDNA: vcDNA=SeqID_17008; Strand=-; Position=146-364
ITKCRSIKKISNFDKRRHNQKYLGRETELFLQLSTILILISKGCKYHLKLCTYASASAALHLINPNAAFQVK

SEQ ID NO: 37312 - protein, 103 aa, Diabrotica virgifera
  misc_feature: Coding regions on vcDNA: vcDNA=SeqID_17009; Strand=-; Position=81-392
RSPPFLKSISPADCISIWIINFILVVDSFGIMVPPFTVFVIVVPDCRWKCKVLSIILVNSQFYPLKHFSVISLLFLDTCSGKVSVTSVKDYRGGLRWFIRCIV

SEQ ID NO: 37313 - protein, 58 aa, Diabrotica virgifera
  misc_feature: Coding regions on vcDNA: vcDNA=SeqID_17010; Strand=-; Position=114-290
SKNNIDTDDKIKLNVNSSGFYLRTVSSGTLTYSEVPNQLTLQLSISLVKRMMEIRHPA

SEQ ID NO: 37314 - protein, 114 aa, Diabrotica virgifera
  misc_feature: Coding regions on vcDNA: vcDNA=SeqID_17011; Strand=-; Position=1-342
  misc_feature (1)..(14): Xaa can be any naturally occurring amino acid
  misc_feature (17)..(35): Xaa can be any naturally occurring amino acid
  misc_feature (37)..(113): Xaa can be any naturally occurring amino acid
XXXXXXXXXXXXXXFYXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXY

SEQ ID NO: 37315 - protein, 53 aa, Diabrotica virgifera
  misc_feature: Coding regions on vcDNA: vcDNA=SeqID_17012; Strand=+; Position=104-265
QYFFMYRAKCIFCTMYISANYLIRMYLIMFNIRRAERLTFFLANNDFKCFVLK

SEQ ID NO: 37316 - protein, 91 aa, Diabrotica virgifera
  misc_feature: Coding regions on vcDNA: vcDNA=SeqID_17013; Strand=+; Position=88-364
  misc_feature: Homolog annotation: Hit_ID=CAG32105.1; Match level="QueryCoverage =92%, HitCoverage=88%, E-value=1e-15, Identity=47%"; Hit description =hypothetical protein [Gallus gallus]
  misc_feature: Pfam annotation: Pfam_ID=HIG_1_N; Match level="Score=85.0, E-value=2e- 22, Copies=1"; Pfam description=Hypoxia induced protein conserved reg
  misc_feature (59)..(59): Xaa can be any naturally occurring amino acid
MNEPPRIYYEEESQSDKLLRKSKETPVFPIAIGICAAAVGYGIYAYKNKGKMSTSVYLXHLRVGAQGAAVGSLTLGLIYTMDHRHFLKKPE

SEQ ID NO: 37317 - protein, 253 aa, Diabrotica virgifera
  misc_feature: Coding regions on vcDNA: vcDNA=SeqID_17014; Strand=-; Position=1-759
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(244): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMMIILILS

SEQ ID NO: 37318 - protein, 56 aa, Diabrotica virgifera
  misc_feature: Coding regions on vcDNA: vcDNA=SeqID_17015; Strand=-; Position=57-227
  misc_feature (12)..(23): Xaa can be any naturally occurring amino acid
QVLVPKSSSTTXXXXXXXXXXXXGYQSIIIIIYKRGYITFSTRGNPVLTTLYLETP

SEQ ID NO: 37319 - protein, 66 aa, Diabrotica virgifera; identical to SEQ ID NO: 26808
  misc_feature: Coding regions on vcDNA: vcDNA=SeqID_17016; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37320 - protein, 268 aa, Diabrotica virgifera
  misc_feature: Coding regions on vcDNA: vcDNA=SeqID_17017; Strand=+; Position=131-933
  misc_feature: Homolog annotation: Hit_ID=XP_316724.1; Match level="QueryCoverage =97%, HitCoverage=84%, E-value=1e-115, Identity=30%"; Hit description= ENSANGP00000002653 [Anopheles gambiae] gb|EAA11800.1| ENSANGP00000002653 [Anopheles gambiae
  misc_feature: Gene Ontology Annotation: Molecular function=actin binding; Cellular component=plasma membrane; Biological process=neuromuscular synaptic transmission
  misc_feature: Pfam annotation: Pfam_ID=Spectrin; Match level="Score=192.4, E-value =9.4e-55, Copies=2"; Pfam description=Spectrin repeat
  misc_feature (246)..(246): Xaa can be any naturally occurring amino acid
  misc_feature (251)..(251): Xaa can be any naturally occurring amino acid
  misc_feature (263)..(263): Xaa can be any naturally occurring amino acid
MDQIPPPKEVKILETAEDIQERRQEVLSRYDNFKADARAKREKLEDSRRFQYFKRDADELESWILEKLQAASDESYKDPTNLQAKIQKHQAFEAEVAAHSNAIVVLDNTGREMINQNHYESETIRRRLEELHRLWEQLLSKLAEKGTKLQQALVLVQFIRHCDEVMFWINEKSAFLSAEEFGHDLEHVEVLQRKFDEFQKDMASQEYRVTEVNELADKLLHDGQRERPNHHKKRRINNAWQRLKQXTLMRXDKLYGAHEIQRXHRDAD

SEQ ID NO: 37321 - protein, 21 aa, Diabrotica virgifera
  misc_feature: Coding regions on vcDNA: vcDNA=SeqID_17018; Strand=-; Position=0-62
  misc_feature (2)..(2): Xaa can be any naturally occurring amino acid
  misc_feature (5)..(6): Xaa can be any naturally occurring amino acid
  misc_feature (10)..(10): Xaa can be any naturally occurring amino acid
  misc_feature (16)..(17): Xaa can be any naturally occurring amino acid
EXSGXXVPAXAYPSFXXIVSR

SEQ ID NO: 37322 - protein, 108 aa, Diabrotica virgifera; identical to SEQ ID NO: 27732
  misc_feature: Coding regions on vcDNA: vcDNA=SeqID_17019; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37323 - protein, 67 aa, Diabrotica virgifera
  misc_feature: Coding regions on vcDNA: vcDNA=SeqID_17020; Strand=-; Position=428-631
  misc_feature (23)..(23): Xaa can be any naturally occurring amino acid
  misc_feature (46)..(52): Xaa can be any naturally occurring amino acid
MLLTIKILTFIFRISTVINVLNXYYTIVKHIRKQNNLYTLFINSFXXXXXXXHRYSAPKYDIHQVQV

SEQ ID NO: 37324 - protein, 79 aa, Diabrotica virgifera
  misc_feature: Coding regions on vcDNA: vcDNA=SeqID_17021; Strand=-; Position=470-709
  misc_feature (1)..(1): Xaa can be any naturally occurring amino acid
  misc_feature (11)..(11): Xaa can be any naturally occurring amino acid
XNIFMKAKKAXHCEPNTGCRKGKLTANINLLKESRFSSKYWHNYLRIDGFLLILFCRGHDYMRKLNLTTQLVQLITNRL

SEQ ID NO: 37325 - protein, 222 aa, Diabrotica virgifera
  misc_feature: Coding regions on vcDNA: vcDNA=SeqID_17022; Strand=+; Position=63-731
  misc_feature: Homolog annotation: Hit_ID=P29522; Match level="QueryCoverage=97%, HitCoverage=99%, E-value=9e-69, Identity=61%"; Hit description =Elongation factor 1-beta' pir||S35514 translation elongation factor eEF-1 beta chain -
  misc_feature: Gene Ontology Annotation: Molecular function=translation elongation factor activity; Cellular component=eukaryotic translation elongation factor 1 complex; Biological process=translational elongation
  misc_feature: Pfam annotation: Pfam_ID=EF1_GNE; Match level="Score=163.1, E-value =6.2e-46, Copies=1"; Pfam description=EF-1 guanine nucleotide exchange doma
  misc_feature (88)..(95): Xaa can be any naturally occurring amino acid
  misc_feature (101)..(111): Xaa can be any naturally occurring amino acid
MAFGDLKTEKGVKELNSFLEDKSYVGGYILSQADVNAFNQLPKAPAANLPHALRWYNHIKSFSADELKQAGVSGNPLKSAPTTTAPAXXXXXXXXDLFASXXXXXXXXXXXREERLKAYAEKKSKKPELIAKSSIVLDVKPWDDETDMKELEKVTRTIEMDGLIWGASKLMPVGYGINKLQIMCVVEDAKVSIDELVEKIQEFEDYVQSVDMVSTNCKLMCC

SEQ ID NO: 37326 - protein, 67 aa, Diabrotica virgifera
  misc_feature: Coding regions on vcDNA: vcDNA=SeqID_17023; Strand=+; Position=168-371
  misc_feature (8)..(17): Xaa can be any naturally occurring amino acid
HEYIYNSXXXXXXXXXXYTACTERLYFFLYSILFYSYFTEELPIRQCLNIYVYTLLSPVLEIIKYRS

SEQ ID NO: 37327 - protein, 186 aa, Diabrotica virgifera
  misc_feature: Coding regions on vcDNA: vcDNA=SeqID_17024; Strand=-; Position=278-838
  misc_feature: Homolog annotation: Hit_ID=AAT40504.1; Match level="QueryCoverage =98%, HitCoverage=22%, E-value=3e-49, Identity=53%"; Hit description =putative polyprotein [Solanum demissum]
  misc_feature (15)..(15): Xaa can be any naturally occurring amino acid
  misc_feature (26)..(26): Xaa can be any naturally occurring amino acid
KYLGSVLQSIKEIDXDACSRIRVGMXKVKRSDVLCDRKIRMKLKGKFYKTAIRPAMMYGTECWAVKKKEEQRMHVAEMRMLRWMSGVTKKDKIRNEYIRGSLGVAPIDAKIRVHRLRWFGHVQRRDVNHPIRRIAEVQIPGRSRRGRPKKTWGETIRQDILVKGINIDMTQDRIEWRNVIREADPA

SEQ ID NO: 37328 - protein, 47 aa, Diabrotica virgifera
  misc_feature: Coding regions on vcDNA: vcDNA=SeqID_17025; Strand=+; Position=142-285
  misc_feature (10)..(16): Xaa can be any naturally occurring amino acid
  misc_feature (18)..(26): Xaa can be any naturally occurring amino acid
DGLRFLRYSXXXXXXXLXXXXXXXXXKDFYIINIKHFSACPLSIHSS

SEQ ID NO: 37329 - protein, 52 aa, Diabrotica virgifera
  misc_feature: Coding regions on vcDNA: vcDNA=SeqID_17026; Strand=-; Position=162-320
SRSLSEKVRDIESRIPFQCRTIFHGSYFTGNIFAPFARHMKKVIIRSFSGSS

SEQ ID NO: 37330 - protein, 35 aa, Diabrotica virgifera
  misc_feature: Coding regions on vcDNA: vcDNA=SeqID_17027; Strand=-; Position=0-104
  misc_feature (3)..(34): Xaa can be any naturally occurring amino acid
VKXXXXXXXXXXXXXXXXXXXXXXXXXXXXXXXXR

SEQ ID NO: 37331 - protein, 43 aa, Diabrotica virgifera
  misc_feature: Coding regions on vcDNA: vcDNA=SeqID_17028; Strand=+; Position=2-130
  misc_feature (2)..(39): Xaa can be any naturally occurring amino acid
NXXXXXXXXXXXXXXXXXXXXXXXXXXXXXXXXXXXXXXRRET

SEQ ID NO: 37332 - protein, 99 aa, Diabrotica virgifera
  misc_feature: Coding regions on vcDNA: vcDNA=SeqID_17029; Strand=-; Position=1-297
RATYFFLTYLAFFSPASLVSLHSSVYASYLLSHLHASQLLLIVLYFLYLYCIPLLFLFSWCGSVKNRFSLFLFSLVFLRFSLPLVPVSQRLLTLKIGMP

SEQ ID NO: 37333 - protein, 47 aa, Diabrotica virgifera
  misc_feature: Coding regions on vcDNA: vcDNA=SeqID_17030; Strand=+; Position=1-141
HLRGRPKGGRERGSLWAASTRGEKSRRGRGGRRGRSDFFLGGAKRRR

SEQ ID NO: 37334 - protein, 33 aa, Diabrotica virgifera
  misc_feature: Coding regions on vcDNA: vcDNA=SeqID_17031; Strand=-; Position=0-98
AVVELVNKMFLKSFIVPVGVFSVGCLFIVVFSS

SEQ ID NO: 37335 - protein, 37 aa, Diabrotica virgifera
  misc_feature: Coding regions on vcDNA: vcDNA=SeqID_17032; Strand=+; Position=129-239
KNSLFSNTHIGIIMEFRNILFTSVLKAWPLVFKIPTR

SEQ ID NO: 37336 - protein, 187 aa, Diabrotica virgifera
  misc_feature: Coding regions on vcDNA: vcDNA=SeqID_17033; Strand=-; Position=2-562
  misc_feature (11)..(21): Xaa can be any naturally occurring amino acid
  misc_feature (28)..(40): Xaa can be any naturally occurring amino acid
  misc_feature (42)..(187): Xaa can be any naturally occurring amino acid
VKFKKSNRLNXXXXXXXXXXXFNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37337 - protein, 294 aa, Diabrotica virgifera
  misc_feature: Coding regions on vcDNA: vcDNA=SeqID_17034; Strand=+; Position=23-907
  misc_feature: Homolog annotation: Hit_ID=EAA55044.1; Match level="QueryCoverage =96%, HitCoverage=55%, E-value=1e-21, Identity=25%"; Hit description =hypothetical protein MG06701.4 [Magnaporthe grisea 70-15] ref|XP _370204.1| hypothetical protein MG06701.4
  misc_feature: Gene Ontology Annotation: Cellular component=nucleus; Biological process=central nervous system development
  misc_feature: Pfam annotation: Pfam_ID=DDE; Match level="Score=23.1, E-value=9.4e -08, Copies=1"; Pfam description=DDE superfamily endonuclease
  misc_feature (146)..(146): Xaa can be any naturally occurring amino acid
  misc_feature (234)..(234): Xaa can be any naturally occurring amino acid
TRVAAETFKIPRRGVHAGKPGYPTIFSYEEERCFVQCIQRLSDVGFPVTGMELRQIIKSYLNCQGKNITRFKDNTPGIDWVKSFLSRHKDLTARIASNIKRSRAALNADQMTEYIENLRQTITGVEPDAIFNYDETNLTDDTEKKXLLTKRGVKYPERICNSSKSSISLMMCGNAAGELLPPYVVYKSKNLWDTGTENGPSGKRYANTASGWFESQTFANWFNNILLPRLKKIXERRSFLLDNLSSHINVLHLCRKHNIHFIYLPPNRTPVTHPLDAALFAPMKKAWKGNFISI

SEQ ID NO: 37338 - protein, 130 aa, Diabrotica virgifera
  misc_feature: Coding regions on vcDNA: vcDNA=SeqID_17035; Strand=-; Position=515-905
  misc_feature: Homolog annotation: Hit_ID=NP_511057.1; Match level="QueryCoverage =98%, HitCoverage=71%, E-value=4e-55, Identity=85%"; Hit description =CG3595-PA [Drosophila melanogaster] gb|EAL32148.1| GA17546-PA [Drosophila
  misc_feature: Gene Ontology Annotation: Molecular function=structural constituent of muscle; Cellular component=muscle myosin; Biological process =regulation of muscle contraction
  misc_feature (17)..(17): Xaa can be any naturally occurring amino acid
  misc_feature (22)..(22): Xaa can be any naturally occurring amino acid
  misc_feature (36)..(36): Xaa can be any naturally occurring amino acid
  misc_feature (40)..(41): Xaa can be any naturally occurring amino acid
  misc_feature (56)..(56): Xaa can be any naturally occurring amino acid
  misc_feature (72)..(72): Xaa can be any naturally occurring amino acid
EWFVDKEDLHDMLASFXGKNPXDDYLDGMMNEAPGXINFXXVLTLFGERLQGHRPXEDVIKNAFGCFDEDNXMGVLNEERLRELLTSMGDRFTDDEVDEMYREAPIKNGLFDYVEFTRILKHGAKDKDEQ

SEQ ID NO: 37339 - protein, 106 aa, Diabrotica virgifera
  misc_feature: Coding regions on vcDNA: vcDNA=SeqID_17036; Strand=+; Position=132-448
  misc_feature: Homolog annotation: Hit_ID=NP_733280.1; Match level="QueryCoverage =100%, HitCoverage=25%, E-value=1e-16, Identity=40%"; Hit description= CG11901-PB, isoform B [Drosophila melanogaster] ref|NP_652000.1| CG11901-PA, isoform A [Drosophila
  misc_feature: Gene Ontology Annotation: Molecular function=translation elongation factor activity; Cellular component=intracellular; Biological process=translational elongation
  misc_feature (19)..(19): Xaa can be any naturally occurring amino acid
  misc_feature (25)..(25): Xaa can be any naturally occurring amino acid
  misc_feature (27)..(27): Xaa can be any naturally occurring amino acid
  misc_feature (40)..(40): Xaa can be any naturally occurring amino acid
KYVIDEKFRKCFGNVNRWXIKLINXKXLIDVIEEVKVCEXKLLNPGTLAAADATPGKGKKKEEMNQDKKPRTPKDMKEKEQLEELDAAEAGLVEEPKNKDPFFELP

SEQ ID NO: 37340 - protein, 57 aa, Diabrotica virgifera
  misc_feature: Coding regions on vcDNA: vcDNA=SeqID_17037; Strand=-; Position=2-172
VPHEVFSSPKFSLCPITSLLRNSYDVNGSLPSTHPVPLFSTYFQRGNGLPHSHRPLK

SEQ ID NO: 37341 - protein, 113 aa, Diabrotica virgifera
  misc_feature: Coding regions on vcDNA: vcDNA=SeqID_17038; Strand=-; Position=2-340
LCPGRGTMGMLLADDDRRSGLNFVLVSFQRLVVVIVSLTTFLGWEYTTSCWWIRFAFTKLHSLRGGVLFRFGFALFGVRRYHSKRWRVCVAAACRSFSSKAGSVPVGVFSVVC

SEQ ID NO: 37342 - protein, 34 aa, Diabrotica virgifera
  misc_feature: Coding regions on vcDNA: vcDNA=SeqID_17039; Strand=-; Position=132-236
  misc_feature (8)..(8): Xaa can be any naturally occurring amino acid
MYRMFSCXYSSLNWRLRYTTFFCYFYLTTYGVFS

SEQ ID NO: 37343 - protein, 60 aa, Diabrotica virgifera
  misc_feature: Coding regions on vcDNA: vcDNA=SeqID_17040; Strand=+; Position=235-417
DTTISKYLDGRQLCNDLSNCFSPSEALYTLDKRMLALMRPLFNAPIQAVFTHCNMYLLTR

SEQ ID NO: 37344 - protein, 30 aa, Diabrotica virgifera
  misc_feature: Coding regions on vcDNA: vcDNA=SeqID_17041; Strand=-; Position=0-89
  misc_feature (3)..(3): Xaa can be any naturally occurring amino acid
  misc_feature (5)..(29): Xaa can be any naturally occurring amino acid
SSXKXXXXXXXXXXXXXXXXXXXXXXXXXS

SEQ ID NO: 37345 - protein, 78 aa, Diabrotica virgifera
  misc_feature: Coding regions on vcDNA: vcDNA=SeqID_17042; Strand=-; Position=0-233
VQAVFADLVIPDIETRMYDDYRDKPCFPVVPGMMITSACIKKYTANLSHVCFTIILFPFIFNRGDYAVTRLVRRAREG

SEQ ID NO: 37346 - protein, 116 aa, Diabrotica virgifera
  misc_feature: Coding regions on vcDNA: vcDNA=SeqID_17043; Strand=+; Position=1-351
DKRKTNLPHKKQTTETRNTPPRRKQNQGKKNQQQRNENRRRPKNRRPETQDKTGQKKTHRPKNRLKILMKYKRTVRNIYLPKSLLCQKYIKSPSGNSTYENGLDIQPRNENFNRKD

SEQ ID NO: 37347 - protein, 177 aa, Diabrotica virgifera
  misc_feature: Coding regions on vcDNA: vcDNA=SeqID_17044; Strand=+; Position=3-533
  misc_feature (2)..(177): Xaa can be any naturally occurring amino acid
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37348 - protein, 52 aa, Diabrotica virgifera
  misc_feature: Coding regions on vcDNA: vcDNA=SeqID_17045; Strand=-; Position=66-224
LQNHSYGSTLLEYRSSYFSERTYYSFKHHLPFHTNKVCNMRLNVVSNARTLL

SEQ ID NO: 37349 - protein, 17 aa, Diabrotica virgifera
  misc_feature: Coding regions on vcDNA: vcDNA=SeqID_17046; Strand=+; Position=1-51
  misc_feature (11)..(11): Xaa can be any naturally occurring amino acid
KNFKPILHPIXHFVSRL

SEQ ID NO: 37350 - protein, 40 aa, Diabrotica virgifera
  misc_feature: Coding regions on vcDNA: vcDNA=SeqID_17047; Strand=-; Position=589-711
HFSIKNVHRYATLSRSKISRFLHSNQWTDEPLYQILKLIM

SEQ ID NO: 37351 - protein, 191 aa, Diabrotica virgifera
  misc_feature: Coding regions on vcDNA: vcDNA=SeqID_17048; Strand=-; Position=446 -1021
  misc_feature (4)..(46): Xaa can be any naturally occurring amino acid
  misc_feature (51)..(87): Xaa can be any naturally occurring amino acid
  misc_feature (90)..(97): Xaa can be any naturally occurring amino acid
  misc_feature (100)..(106): Xaa can be any naturally occurring amino acid
VGAXXXXXXXXXXXXXXXXXXXXXXXXXXXXXXXXXXXXXXXXXXXVFWWXXXXXXXXXXXXXXXXXXXXXXXXXXXXXXXXXXXXXFLXXXXXXXXPRXXXXXXXRGTPPRGGEIFLPAGGRPPGVLPPLGNAGGGVNPPGLFFPTKMGGGVGFEGVGLPKLCSIIRDVVVISMQCMLRSTMLKCGRYYA

SEQ ID NO: 37352 - protein, 37 aa, Diabrotica virgifera
  misc_feature: Coding regions on vcDNA: vcDNA=SeqID_17049; Strand=-; Position=1-111
  misc_feature (2)..(14): Xaa can be any naturally occurring amino acid
  misc_feature (18)..(37): Xaa can be any naturally occurring amino acid
PXXXXXXXXXXXXXLKNXXXXXXXXXXXXXXXXXXXX

SEQ ID NO: 37353 - protein, 44 aa, Diabrotica virgifera
  misc_feature: Coding regions on vcDNA: vcDNA=SeqID_17050; Strand=-; Position=0-131
  misc_feature (1)..(4): Xaa can be any naturally occurring amino acid
  misc_feature (10)..(42): Xaa can be any naturally occurring amino acid
XXXXPCFSPXXXXXXXXXXXXXXXXXXXXXXXXXXXXXXXXXTP

SEQ ID NO: 37354 - protein, 186 aa, Diabrotica virgifera
  misc_feature: Coding regions on vcDNA: vcDNA=SeqID_17051; Strand=+; Position=180-737
  misc_feature (16)..(30): Xaa can be any naturally occurring amino acid
  misc_feature (34)..(143): Xaa can be any naturally occurring amino acid
  misc_feature (147)..(166): Xaa can be any naturally occurring amino acid
SSIHHFRIYKSYKIKXXXXXXXXXXXXXXXNVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQEFXXXXXXXXXXXXXXXXXXXXLACPLINLNGRAILTVLREH

SEQ ID NO: 37355 - protein, 254 aa, Diabrotica virgifera
  misc_feature: Coding regions on vcDNA: vcDNA=SeqID_17052; Strand=+; Position=53-817
  misc_feature: Homolog annotation: Hit_ID=XP_396479.1; Match level="QueryCoverage =80%, HitCoverage=93%, E-value=2e-46, Identity=43%"; Hit description =similar to checkpoint protein Hus1 [Apis mellifera]
  misc_feature: Gene Ontology Annotation: Cellular component=replication fork; Biological process=DNA damage response, signal transduction resulting in cell cycle arrest
  misc_feature: Pfam annotation: Pfam_ID=Hus1; Match level="Score=133.3, E-value=5.7e- 37, Copies=1"; Pfam description=Hus1-like protein
GYIKSFRAVITDGLAMRDFMNISLSLSKFSKECIMRITTRKVYYIISEEESGPRRPLVWCELPVNFYFKEYNVVGVNDQYNEIYLEFSTGLLARSLSILKQVVKTLKIKLTNKQSPCLTLEMDLVAEEISSQVVHDIPVEVISRKHWSDYEEPRFNDFHVSIQMPNLKALKNIVERLRNMSHSLIVSANKNGRLTFQIKTNVVNVAAHFTDLSVQSFAVGQIPTTDDDDGEDLNLISSTINKKVFNVSHWITNK

SEQ ID NO: 37356 - protein, 47 aa, Diabrotica virgifera
  misc_feature: Coding regions on vcDNA: vcDNA=SeqID_17053; Strand=+; Position=154-297
  misc_feature (11)..(19): Xaa can be any naturally occurring amino acid
NRSIQIPTTLXXXXXXXXXDLYRAKQSLDIRRSYALCTGTSCYLYPI

SEQ ID NO: 37357 - protein, 118 aa, Diabrotica virgifera
  misc_feature: Coding regions on vcDNA: vcDNA=SeqID_17054; Strand=+; Position=1-357
  misc_feature: Homolog annotation: Hit_ID=XP_313843.1; Match level="QueryCoverage =99%, HitCoverage=22%, E-value=2e-37, Identity=51%"; Hit description =ENSANGP00000011728 [Anopheles gambiae]
  misc_feature: Gene Ontology Annotation: Molecular function=DNA binding; Cellular component=nucleus; Biological process=regulation of transcription, DNA-dependent
  misc_feature (52)..(58): Xaa can be any naturally occurring amino acid
  misc_feature (101)..(101): Xaa can be any naturally occurring amino acid
KKPAKEKERDRDRERERDRDREREKDRDRERDRDDRRSSRDMLKEKEMEEEXXXXXXXERRAREKEAAYQERLRAWETRERRKAKDYEKEREKERTKEEEXERDAKRLIEFLVDYDDF

SEQ ID NO: 37358 - protein, 66 aa, Diabrotica virgifera
  misc_feature: Coding regions on vcDNA: vcDNA=SeqID_17055; Strand=-; Position=3-200
  misc_feature (3)..(4): Xaa can be any naturally occurring amino acid
  misc_feature (8)..(65): Xaa can be any naturally occurring amino acid
NKXXYINXXXXXXXXXXXXXXXXXXXXXXXXXXXXXXXXXXXXXXXXXXXXXXXXXXXXXXXXXXD

SEQ ID NO: 37359 - protein, 55 aa, Diabrotica virgifera
  misc_feature: Coding regions on vcDNA: vcDNA=SeqID_17056; Strand=-; Position=0-164
NGKTISSIGDCWVYYTPILEIIEKNLKLTEFEVQYRKEISHLSQVFKSLVYSVFT

SEQ ID NO: 37360 - protein, 147 aa, Diabrotica virgifera
  misc_feature: Coding regions on vcDNA: vcDNA=SeqID_17057; Strand=+; Position=79-522
  misc_feature: Homolog annotation: Hit_ID=XP_396304.1; Match level="QueryCoverage =96%, HitCoverage=97%, E-value=1e-75, Identity=94%"; Hit description =similar to ENSANGP00000020247 [Apis mellifera]
  misc_feature: Gene Ontology Annotation: Biological process=mRNA splicing
  misc_feature: Pfam annotation: Pfam_ID=Mago_nashi; Match level="Score=339.8, E -value=3.9e-99, Copies=1"; Pfam description=Mago nashi protein
KNNRVFYIRYYVGHKGKFGHEFLEFEFRPDGKLRYANNSNYKNDTMIRKEVYVHQCVMEELKRIIIDSEIMQEDDSLWPPPDRIGRQELEIVIKDEHISFTTSKTGSLIDVSQSKDPEGLRCFYYLVQDLKCLVFSLIGLHFKIKPI

SEQ ID NO: 37361 - protein, 46 aa, Diabrotica virgifera
  misc_feature: Coding regions on vcDNA: vcDNA=SeqID_17058; Strand=-; Position=2-139
  misc_feature (8)..(8): Xaa can be any naturally occurring amino acid
  misc_feature (16)..(16): Xaa can be any naturally occurring amino acid
  misc_feature (25)..(25): Xaa can be any naturally occurring amino acid
  misc_feature (34)..(34): Xaa can be any naturally occurring amino acid
  misc_feature (37)..(45): Xaa can be any naturally occurring amino acid
FNSDHVKXKSRPDLIXIAATPIITXNPTSRSQSXLSXXXXXXXXXV

SEQ ID NO: 37362 - protein, 66 aa, Diabrotica virgifera; identical to SEQ ID NO: 26808
  misc_feature: Coding regions on vcDNA: vcDNA=SeqID_17059; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37363 - protein, 80 aa, Diabrotica virgifera
  misc_feature: Coding regions on vcDNA: vcDNA=SeqID_17060; Strand=-; Position=1-240
  misc_feature (11)..(22): Xaa can be any naturally occurring amino acid
  misc_feature (47)..(79): Xaa can be any naturally occurring amino acid
TFNCLALLNSXXXXXXXXXXXXADAQGLKTAWLSYNKGNRALSVLLXXXXXXXXXXXXXXXXXXXXXXXXXXXXXXXXXR

SEQ ID NO: 37364 - protein, 18 aa, Diabrotica virgifera
  misc_feature: Coding regions on vcDNA: vcDNA=SeqID_17061; Strand=-; Position=1-54
  misc_feature (2)..(11): Xaa can be any naturally occurring amino acid
  misc_feature (13)..(18): Xaa can be any naturally occurring amino acid
LXXXXXXXXXXSXXXXXX

SEQ ID NO: 37365 - protein, 53 aa, Diabrotica virgifera
  misc_feature: Coding regions on vcDNA: vcDNA=SeqID_17062; Strand=-; Position=1-159
LKLEYVFGKGMQKGFMLILGNNYCDHALSIINKDKFQAVRYPLDVRQTGRWGG

SEQ ID NO: 37366 - protein, 306 aa, Diabrotica virgifera
  misc_feature: Coding regions on vcDNA: vcDNA=SeqID_17063; Strand=+; Position=1-918
  misc_feature: Homolog annotation: Hit_ID=A32713; Match level="QueryCoverage=99%, HitCoverage=35%, E-value=4e-72, Identity=47%"; Hit description =reverse transcriptase homolog - fruit fly (Drosophila melanogaster)
  misc_feature: Pfam annotation: Pfam_ID=RVT_1; Match level="Score=110.2, E-value=5e -30, Copies=1"; Pfam description=Reverse transcriptase (RNA-dependent D
  misc_feature (289)..(289): Xaa can be any naturally occurring amino acid
VFVEHLEKVFAPVDLFEDEEINSYLDAPCQLSPPARSITPSEIMEEIKKINSHKAPGYDLIVGEILKHLPRRAIVFLTTLCNRILHLSYYPTQWKFAEIIMIAKPGKPPTEAASYRPISLLPILSKIFERLLQSRINSITSINNLIPNHQFGFREKHTTTQQCHRIVNLIRDGLENKNICTAAFLDIQQAFDKVWHQGLLYKLKTNMPSQIYLLLKSYLSDRHFDVKMEKDNRRYQLIRAGVPQGSVLGPFLYLLYTADIPTTNETTIATFADDTAIIALDHDPVVASXQLQTHLDRLQNWLQNGK

SEQ ID NO: 37367 - protein, 254 aa, Diabrotica virgifera
  misc_feature: Coding regions on vcDNA: vcDNA=SeqID_17064; Strand=+; Position=3-764
  misc_feature (1)..(225): Xaa can be any naturally occurring amino acid
  misc_feature (227)..(233): Xaa can be any naturally occurring amino acid
  misc_feature (235)..(245): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXVXXXXXXXXXXXLRSLYYFKD

SEQ ID NO: 37368 - protein, 50 aa, Diabrotica virgifera
  misc_feature: Coding regions on vcDNA: vcDNA=SeqID_17065; Strand=-; Position=92-244
  misc_feature (4)..(16): Xaa can be any naturally occurring amino acid
  misc_feature (40)..(46): Xaa can be any naturally occurring amino acid
GPLXXXXXXXXXXXXXPNLGFPPGLNSRSIKIFKSRTGLXXXXXXXNNKL

SEQ ID NO: 37369 - protein, 262 aa, Diabrotica virgifera
  misc_feature: Coding regions on vcDNA: vcDNA=SeqID_17066; Strand=+; Position=2-787
  misc_feature: Homolog annotation: Hit_ID=XP_392363.1; Match level="QueryCoverage =100%, HitCoverage=22%, E-value=1e-139, Identity=91%"; Hit description=similar to sodium pump alpha subunit; (sodium/potassium)- ATPase alpha-subunit [Apis
  misc_feature: Gene Ontology Annotation: Molecular function=sodium/potassium -exchanging ATPase activity; Cellular component=sodium/potassium -exchanging ATPase complex; Biological process=neurotransmitter uptake
  misc_feature: Pfam annotation: Pfam_ID=Cation_ATPase_C; Match level="Score=239.0, E- value=8.9e-69, Copies=1"; Pfam description=Cation transporting ATPase, C-terminu
  misc_feature (223)..(223): Xaa can be any naturally occurring amino acid
  misc_feature (230)..(231): Xaa can be any naturally occurring amino acid
  misc_feature (248)..(248): Xaa can be any naturally occurring amino acid
EGRLIFDNLKKSIAYTLTSNIPEISPFLAFILCDVPLPLGTVTILCIDLGTDMVPAISLAYEEAESDIMKRRPRNPFSDKLVNERLISMAYGQIGMIQAAAGFFVYFVIMAENGFLPMKLFGIRKQWDSKAVNDLTDSYGQEWTFRDRKTLEYTCHTAFFVSIVVVQWADLIICKTRRNSIVHQGMRNWALNFGLVFETALAAFLSYTPGMDKGLRMFPLKFXVWWLPAXXFMLSIFIYDEVRRFILXRRCPGGWLEQETYY

SEQ ID NO: 37370 - protein, 83 aa, Diabrotica virgifera
  misc_feature: Coding regions on vcDNA: vcDNA=SeqID_17067; Strand=+; Position=36-284
  misc_feature: Homolog annotation: Hit_ID=CAI22236.1; Match level="QueryCoverage =67%, HitCoverage=6%, E-value=1e-14, Identity=55%"; Hit description =novel protein [Homo sapiens] gb|AAH34589.1| KIAA0090 protein [Homo sapiens] ref|NP_055862.1| KIAA0090 prote
KVEHLVVNLSSAIYEDQVGKFDWKRSFIGKSKFAEIDSKRIIIATEQNVLASLNLKNGQILWRHVLEDPKEYEIKLLYIDRDI

SEQ ID NO: 37371 - protein, 165 aa, Diabrotica virgifera
  misc_feature: Coding regions on vcDNA: vcDNA=SeqID_17068; Strand=+; Position=87-581
  misc_feature (6)..(22): Xaa can be any naturally occurring amino acid
  misc_feature (28)..(36): Xaa can be any naturally occurring amino acid
  misc_feature (48)..(58): Xaa can be any naturally occurring amino acid
  misc_feature (67)..(78): Xaa can be any naturally occurring amino acid
VYFIKXXXXXXXXXXXXXXXXXTQNSGXXXXXXXXXENHHLVLNFPNXXXXXXXXXXXRGKGIFRGXXXXXXXXXXXXFFPGAGRKGKGGKIRGGGGGFIRERVGIRNYSFRILTSLLSDGGGTLGGVDQLLFVGGPRQTHQMGIRRLHGSTRRHGWRNNTPHTP

SEQ ID NO: 37372 - protein, 53 aa, Diabrotica virgifera
  misc_feature: Coding regions on vcDNA: vcDNA=SeqID_17069; Strand=-; Position=28-189
  misc_feature (7)..(15): Xaa can be any naturally occurring amino acid
LTPLITXXXXXXXXXHPYYSPQPLLLFHSSFRGEKITKNNLHSTSSQPLFITF

SEQ ID NO: 37373 - protein, 60 aa, Diabrotica virgifera
  misc_feature: Coding regions on vcDNA: vcDNA=SeqID_17070; Strand=-; Position=118-300
  misc_feature (22)..(29): Xaa can be any naturally occurring amino acid
  misc_feature (43)..(51): Xaa can be any naturally occurring amino acid
SSGLSKNSSMSLASLLSYIFKXXXXXXXXQIYKNVRDIHVLQXXXXXXXXXSIKKLMFIE

SEQ ID NO: 37374 - protein, 66 aa, Diabrotica virgifera
  misc_feature: Coding regions on vcDNA: vcDNA=SeqID_17071; Strand=-; Position=2-199
  misc_feature (3)..(11): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
PFXXXXXXXXXIENNLAHTGLNXXXXXXXXSNXXXXXXXXPIINXNPTSRSXXXXXXXXXXXXXXV

SEQ ID NO: 37375 - protein, 200 aa, Diabrotica virgifera
  misc_feature: Coding regions on vcDNA: vcDNA=SeqID_17072; Strand=+; Position=202-799
  misc_feature: Homolog annotation: Hit_ID=AAD09820.1; Match level="QueryCoverage =100%, HitCoverage=19%, E-value=4e-93, Identity=87%"; Hit description= sarco(endo)plasmic reticulum-type calcium ATPase [Heliothis virescens]
  misc_feature: Gene Ontology Annotation: Molecular function=calcium-transporting ATPase activity; Cellular component=nuclear envelope-endoplasmic reticulum network; Biological process=calcium ion homeostasis
  misc_feature: Pfam annotation: Pfam_ID=Cation_ATPase_N; Match level="Score=113.0, E- value=7.5e-31, Copies=1"; Pfam description=Cation transporter/ATPase, N-terminus
  misc_feature (192)..(192): Xaa can be any naturally occurring amino acid
MEDGHAKTVDEVLRYFDADQERGLSLDQVKKNQAKYGPNELPAEEGKSIWQLVLEQFDDLLVKILLLAAIISFVLALFEEHDGAFTAFVEPFVILLILIANAVVGVWQERNAESAIEALKEYEPEMGKVVRQDKSGIQKIRAKEIVPGDIVEVSVGDKIPADIRLVKIFSTTLRIDQSILTGESVSVIKHTXDAISDPRA

SEQ ID NO: 37376 - protein, 306 aa, Diabrotica virgifera
  misc_feature: Coding regions on vcDNA: vcDNA=SeqID_17073; Strand=+; Position=3-920
  misc_feature (22)..(296): Xaa can be any naturally occurring amino acid
  misc_feature (300)..(300): Xaa can be any naturally occurring amino acid
KVTITSSSYTTPNLQNIRLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNYXSPSTLI

SEQ ID NO: 37377 - protein, 77 aa, Diabrotica virgifera
  misc_feature: Coding regions on vcDNA: vcDNA=SeqID_17074; Strand=-; Position=502-735
  misc_feature (4)..(4): Xaa can be any naturally occurring amino acid
  misc_feature (7)..(7): Xaa can be any naturally occurring amino acid
  misc_feature (50)..(58): Xaa can be any naturally occurring amino acid
WIDXNHXLRPFLARIVISLPSLPLPNIVFGYIHPFLSNVHSFHCFPQFLXXXXXXXXXALHVAKHFLCSTETFVIYL

SEQ ID NO: 37378 - protein, 120 aa, Diabrotica virgifera
  misc_feature: Coding regions on vcDNA: vcDNA=SeqID_17075; Strand=+; Position=197-559
LMPTKLRHKTAHLAYTTAVERKFLLHNKDLLAPRWNREKHHRSLLRKPQKEKLTAILAIPERKQLLTASLNIMLWQLEVKEVLRTFTAHKSEVMFLYYENPYSRHGPYFMSLSKVHRTLI

SEQ ID NO: 37379 - protein, 93 aa, Diabrotica virgifera
  misc_feature: Coding regions on vcDNA: vcDNA=SeqID_17076; Strand=-; Position=316-597
TNLEGAGRNFWAEIVQTTFSNKYTRSPFIAPKNTLLGFLGHSKQERHLVLSKIDNPRAIGDLKSKNENIRIFEAQKLTFKLVLLRVPITWTKV

SEQ ID NO: 37380 - protein, 261 aa, Diabrotica virgifera
  misc_feature: Coding regions on vcDNA: vcDNA=SeqID_17077; Strand=+; Position=2-787
  misc_feature: Homolog annotation: Hit_ID=CAF99021.1; Match level="QueryCoverage =98%, HitCoverage=40%, E-value=3e-36, Identity=31%"; Hit description =unnamed protein product [Tetraodon nigroviridis]
  misc_feature: Gene Ontology Annotation: Molecular function=snoRNA binding; Cellular component=small nucleolar ribonucleoprotein complex; Biological process=processing of 20S pre-rRNA
  misc_feature: Pfam annotation: Pfam_ID=WD40; Match level="Score=21.6, E-value =0.0025, Copies=4"; Pfam description=WD domain, G-beta repeat
EFTPDFHLTSPCTCLHFIQNDSVKYKGGSPKKKKRRDSESVVSPKIVLGTTSGVLLLYSITNAGLENSFNSDTNQAINCLSTVDHNIIYSGLEQNVVIWNLEKQKVINKWKVGNEKVTAILAIPESSQLLTASRNIKLWDLEVKEVLRTFTGHKSEVMFLYYVNPYSRDGSYFMSGSKGDRTLSCWSLNTNVSEKNAVANFLMEDIVLNVSINVEDDGTTQMAATVRSGVVHFYRHTLNGKSGKPIKPKTTIQVVSDTGSI

SEQ ID NO: 37381 - protein, 71 aa, Diabrotica virgifera
  misc_feature: Coding regions on vcDNA: vcDNA=SeqID_17078; Strand=-; Position=635-850
  misc_feature (13)..(22): Xaa can be any naturally occurring amino acid
ITKPFYAVKVYHXXXXXXXXXXVGILSQLKDDVLKNYILRLFFTFRFPLRKSFSKNRKFLKWKFNLWFNPI

SEQ ID NO: 37382 - protein, 71 aa, Diabrotica virgifera
  misc_feature: Coding regions on vcDNA: vcDNA=SeqID_17079; Strand=+; Position=523-738
NLHSAGFLFGIWTLKSKFKTTFSQIFSFIVGPRSVLSQEMCFFEKNFPERYFAQATTTNFCLIFFRCFNQN

SEQ ID NO: 37383 - protein, 78 aa, Diabrotica virgifera
  misc_feature: Coding regions on vcDNA: vcDNA=SeqID_17080; Strand=-; Position=339-575
  misc_feature (62)..(70): Xaa can be any naturally occurring amino acid
VINYVFYAVWLDLFYVFWLGFHWKSPTAKSRDATVYIQTISSLIHFVNFLVSYLHTHPLYIXXXXXXXXXASLYVISE

SEQ ID NO: 37384 - protein, 31 aa, Diabrotica virgifera
  misc_feature: Coding regions on vcDNA: vcDNA=SeqID_17081; Strand=-; Position=1-93
KLGATLTFALAYVRAIRVLRPGNFRDKCKEF

SEQ ID NO: 37385 - protein, 84 aa, Diabrotica virgifera
  misc_feature: Coding regions on vcDNA: vcDNA=SeqID_17082; Strand=+; Position=553-807
  misc_feature (54)..(67): Xaa can be any naturally occurring amino acid
VLEPICRVAATQVRHRERCCIQISFSSGRYHNKYSYNFVFISNFLIKFVFLIKXXXXXXXXXXXXXXNVKVPLKQKIKYVVLFI

SEQ ID NO: 37386 - protein, 177 aa, Diabrotica virgifera
  misc_feature: Coding regions on vcDNA: vcDNA=SeqID_17083; Strand=-; Position=205-738
  misc_feature (11)..(132): Xaa can be any naturally occurring amino acid
  misc_feature (134)..(158): Xaa can be any naturally occurring amino acid
NFILYITLMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXIRINYLRDNSVILLESSNR

SEQ ID NO: 37387 - protein, 188 aa, Diabrotica virgifera
  misc_feature: Coding regions on vcDNA: vcDNA=SeqID_17084; Strand=+; Position=264-830
  misc_feature: Homolog annotation: Hit_ID=EAL49130.1; Match level="QueryCoverage =77%, HitCoverage=26%, E-value=8e-09, Identity=28%"; Hit description =hypothetical protein 51.t00026 [Entamoeba histolytica HM-1:IMSS]
MLSLVIFIPVNIAKTKITSKAIIKDEDPIHTEIILETVEPNTGSKLSRRHLVKENYRLLEENRELSSRFIELEGLSVNKITKLREKVNLLQLANSHFKKDIEELEENYEQVLYENNALKIELEKLKICKKCEEYRNEIAKCNSDNEKVMNENEILKAKRKELTEDLAMLKTVVYRLLQIGEVPRTSTQ

SEQ ID NO: 37388 - protein, 133 aa, Diabrotica virgifera
  misc_feature: Coding regions on vcDNA: vcDNA=SeqID_17085; Strand=+; Position=75-473
  misc_feature: Homolog annotation: Hit_ID=NP_957014.1; Match level="QueryCoverage =93%, HitCoverage=81%, E-value=3e-38, Identity=60%"; Hit description =sin3-associated polypeptide [Danio rerio] gb|AAH59482.1| Hypothetical protein MGC73118 [Danio
  misc_feature: Gene Ontology Annotation: Molecular function=transcription co -repressor activity; Cellular component=histone deacetylase complex; Biological process=regulation of transcription from Pol II promoter
  misc_feature: Pfam annotation: Pfam_ID=SAP18; Match level="Score=227.3, E-value =2.9e-65, Copies=1"; Pfam description=Sin3 associated polypeptide p18 (SAP18
  misc_feature (109)..(109): Xaa can be any naturally occurring amino acid
  misc_feature (118)..(118): Xaa can be any naturally occurring amino acid
  misc_feature (121)..(121): Xaa can be any naturally occurring amino acid
  misc_feature (125)..(125): Xaa can be any naturally occurring amino acid
MAAATVVIEEKSDAVDRQKVCPFLLRVFVTSNGSHHKPSDYIKGNTPQNELQIYTWKDATLHELTQLVKEVNPEARRKGTKFSFAFVYPDMRQSVYRIREIGNTVTGVXGPDDLKTLXLLXLNIXRYLDIAIT

SEQ ID NO: 37389 - protein, 71 aa, Diabrotica virgifera
  misc_feature: Coding regions on vcDNA: vcDNA=SeqID_17086; Strand=-; Position=3-215
  misc_feature (1)..(19): Xaa can be any naturally occurring amino acid
  misc_feature (32)..(40): Xaa can be any naturally occurring amino acid
  misc_feature (42)..(42): Xaa can be any naturally occurring amino acid
  misc_feature (44)..(44): Xaa can be any naturally occurring amino acid
  misc_feature (51)..(51): Xaa can be any naturally occurring amino acid
  misc_feature (53)..(71): Xaa can be any naturally occurring amino acid
XXXXXXXXXXXXXXXXXXXPSFSFNKKLMICXXXXXXXXXHXIXQWPGETXYXXXXXXXXXXXXXXXXXXX

SEQ ID NO: 37390 - protein, 158 aa, Diabrotica virgifera
  misc_feature: Coding regions on vcDNA: vcDNA=SeqID_17087; Strand=+; Position=1-477
  misc_feature (1)..(138): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKKLPLRITRGIFIGRVQNA

SEQ ID NO: 37391 - protein, 65 aa, Diabrotica virgifera
  misc_feature: Coding regions on vcDNA: vcDNA=SeqID_17088; Strand=+; Position=278-475
  misc_feature (4)..(20): Xaa can be any naturally occurring amino acid
FTPXXXXXXXXXXXXXXXXXCTYDLRFQNSPNQLYVYSLIYDLLFTATFIIRKWPNNHIFLKPIL

SEQ ID NO: 37392 - protein, 107 aa, Diabrotica virgifera
  misc_feature: Coding regions on vcDNA: vcDNA=SeqID_17089; Strand=+; Position=1-321
  misc_feature (1)..(50): Xaa can be any naturally occurring amino acid
  misc_feature (57)..(64): Xaa can be any naturally occurring amino acid
  misc_feature (68)..(79): Xaa can be any naturally occurring amino acid
  misc_feature (81)..(98): Xaa can be any naturally occurring amino acid
XXXXXXXXXXXXXXXXXXXXXXXXXXXXXXXXXXXXXXXXXXXXXXXXXXAEKHPIXXXXXXXXGFLXXXXXXXXXXXXGXXXXXXXXXXXXXXXXXXLFWSPFLWT

SEQ ID NO: 37393 - protein, 73 aa, Diabrotica virgifera
  misc_feature: Coding regions on vcDNA: vcDNA=SeqID_17090; Strand=+; Position=589-806
  misc_feature: Homolog annotation: Hit_ID=XP_525925.1; Match level="QueryCoverage =89%, HitCoverage=51%, E-value=4e-14, Identity=66%"; Hit description =PREDICTED: similar to rRNA intron-encoded homing endonuclease [Pan troglodytes]
  misc_feature (45)..(45): Xaa can be any naturally occurring amino acid
  misc_feature (63)..(63): Xaa can be any naturally occurring amino acid
NSWIVARRTEAKAFAKNAFIDQERKLEVRRRSDTALVLTINDASXRFADVPPMTRRAAFRETXSFLGSGGSMV

SEQ ID NO: 37394 - protein, 49 aa, Diabrotica virgifera
  misc_feature: Coding regions on vcDNA: vcDNA=SeqID_17091; Strand=-; Position=139-288
RWYLLYGKTEECRISIADRERYLKYSRFNNSDILLSSLESENNIYIITN

SEQ ID NO: 37395 - protein, 38 aa, Diabrotica virgifera
  misc_feature: Coding regions on vcDNA: vcDNA=SeqID_17092; Strand=-; Position=1-114
  misc_feature (1)..(37): Xaa can be any naturally occurring amino acid
XXXXXXXXXXXXXXXXXXXXXXXXXXXXXXXXXXXXXL

SEQ ID NO: 37396 - protein, 59 aa, Diabrotica virgifera
  misc_feature: Coding regions on vcDNA: vcDNA=SeqID_17093; Strand=-; Position=235-414
GINFILHVMIQFTTWSDNQSIGANLNIVYSIMTTSTWRITRLYAVSLVVNEQLGVVRLL

SEQ ID NO: 37397 - protein, 55 aa, Diabrotica virgifera
  misc_feature: Coding regions on vcDNA: vcDNA=SeqID_17094; Strand=+; Position=165-332
FMNHQFLLHHHIFTYCSVKIFISEIRFKTTFLCHYSTRNSEAEFFFFSKRHEIDS

SEQ ID NO: 37398 - protein, 59 aa, Diabrotica virgifera
  misc_feature: Coding regions on vcDNA: vcDNA=SeqID_17095; Strand=-; Position=375-554
LHLTDVSEIQSAYSLISSHDITWPTKLSRSTFHTVLLSTPAIYWCYIRPGGSSSLKNSI

SEQ ID NO: 37399 - protein, 190 aa, Diabrotica virgifera
  misc_feature: Coding regions on vcDNA: vcDNA=SeqID_17096; Strand=+; Position=229-798
  misc_feature: Homolog annotation: Hit_ID=XP_392287.1; Match level="QueryCoverage =91%, HitCoverage=32%, E-value=3e-17, Identity=32%"; Hit description =similar to CG3533-PA [Apis mellifera]
MKQIQWTLILAQFWFVFVNAEPSVHILAENLEQVITSTTLEWIPFNGDDKGFLKNAVVAAYQTIEEPKSNEAEVSENETGGNGLVQKSVYVCRAKINSVWISGQLRPNRNVCVVSLYKKVSDYKEFDVLVSIEGSARLSWIHKNKYTLISQGAVTSGENALKSFVARREANSHNKESSLSYYVGKYSPNR

SEQ ID NO: 37400 - protein, 178 aa, Diabrotica virgifera
  misc_feature: Coding regions on vcDNA: vcDNA=SeqID_17097; Strand=+; Position=12-545
  misc_feature: Homolog annotation: Hit_ID=NP_649757.1; Match level="QueryCoverage =98%, HitCoverage=57%, E-value=1e-41, Identity=48%"; Hit description =CG2767-PA [Drosophila melanogaster] gb|AAF54175.1| CG2767-PA [Drosophila melanogaster]
  misc_feature: Gene Ontology Annotation: Molecular function=aldo-keto reductase activity; Cellular component=cytoplasm; Biological process =xenobiotic metabolism
  misc_feature: Pfam annotation: Pfam_ID=Aldo_ket_red; Match level="Score=16.7, E -value=2.1e-10, Copies=1"; Pfam description=Aldo/keto reductase family
  misc_feature (134)..(140): Xaa can be any naturally occurring amino acid
MSLTMIGGVKIPIVGLGTWQATNEEELEAAVEAALETGYRHIDTASAYQNEHVIGKVLNKWLTSGKLKREDIFITTKLPMTHIHPDLVETALKESLQKLQLDYVDLYLVHSPIYMKFVEAGKPMEPLPTDHLAXXXXXXXQVDAKRTRTIGISNFNVNQIDRIQPANTQVELHVYYQQ

SEQ ID NO: 37401 - protein, 52 aa, Diabrotica virgifera
  misc_feature: Coding regions on vcDNA: vcDNA=SeqID_17098; Strand=-; Position=142-300
LITYRGFYKINGALYIEAIISGNFSTVISIINVFVISLSIFGKPRMIGFISF

SEQ ID NO: 37402 - protein, 245 aa, Diabrotica virgifera
  misc_feature: Coding regions on vcDNA: vcDNA=SeqID_17099; Strand=-; Position=0-734
  misc_feature (5)..(62): Xaa can be any naturally occurring amino acid
  misc_feature (65)..(202): Xaa can be any naturally occurring amino acid
  misc_feature (205)..(243): Xaa can be any naturally occurring amino acid
INSIXXXXXXXXXXXXXXXXXXXXXXXXXXXXXXXXXXXXXXXXXXXXXXXXXXXXXXXXXXVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXGT

SEQ ID NO: 37403 - protein, 192 aa, Diabrotica virgifera
  misc_feature: Coding regions on vcDNA: vcDNA=SeqID_17100; Strand=-; Position=166-744
  misc_feature (6)..(19): Xaa can be any naturally occurring amino acid
  misc_feature (26)..(35): Xaa can be any naturally occurring amino acid
  misc_feature (37)..(160): Xaa can be any naturally occurring amino acid
  misc_feature (167)..(177): Xaa can be any naturally occurring amino acid
  misc_feature (180)..(189): Xaa can be any naturally occurring amino acid
FQLKNXXXXXXXXXXXXXXLQINPVXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRVTFRXXXXXXXXXXXGEXXXXXXXXXXRRL

SEQ ID NO: 37404 - protein, 85 aa, Diabrotica virgifera
  misc_feature: Coding regions on vcDNA: vcDNA=SeqID_17101; Strand=+; Position=40-300
  misc_feature: Homolog annotation: Hit_ID=XP_391841.1; Match level="QueryCoverage =97%, HitCoverage=33%, E-value=5e-19, Identity=56%"; Hit description =similar to ENSANGP00000009311 [Apis mellifera]
  misc_feature: Gene Ontology Annotation: Molecular function=protein domain specific binding; Cellular component=cellular_component unknown; Biological process=regulation of mitosis
  misc_feature (15)..(15): Xaa can be any naturally occurring amino acid
  misc_feature (28)..(28): Xaa can be any naturally occurring amino acid
  misc_feature (42)..(42): Xaa can be any naturally occurring amino acid
TTHDIREGLAVRFSXIYYDILKSPPTPXDYPHRSIEGAIVRXDTLNGKSYEDSTLIMLLLRDSLTLWASDTKGEADATHEAGDNS

SEQ ID NO: 37405 - protein, 138 aa, Diabrotica virgifera
  misc_feature: Coding regions on vcDNA: vcDNA=SeqID_17102; Strand=-; Position=42-458
  misc_feature (81)..(87): Xaa can be any naturally occurring amino acid
HLIPMSPTISCFVFCSSRTVSGRFAHIACGSFFPSETIIFLLPLLCSPWSIPRFPNSAAPLAWTSLSVALSLLGSGGARSXXXXXXXLSSPFSLPSQMSFCPRALPLLVLPSLSLFYNKRKRVFALSPSLFLPFSLFF

SEQ ID NO: 37406 - protein, 58 aa, Diabrotica virgifera
  misc_feature: Coding regions on vcDNA: vcDNA=SeqID_17103; Strand=+; Position=71-247
  misc_feature (13)..(26): Xaa can be any naturally occurring amino acid
QFSIYYIRNHNRXXXXXXXXXXXXXXIFSLDRKVSLILTTTNVFRKLNKSIYKPHLYR

SEQ ID NO: 37407 - protein, 186 aa, Diabrotica virgifera
  misc_feature: Coding regions on vcDNA: vcDNA=SeqID_17104; Strand=+; Position=392-952
  misc_feature (12)..(91): Xaa can be any naturally occurring amino acid
  misc_feature (94)..(156): Xaa can be any naturally occurring amino acid
  misc_feature (160)..(167): Xaa can be any naturally occurring amino acid
  misc_feature (175)..(186): Xaa can be any naturally occurring amino acid
ITIRIKKSHILXXXXXXXXXXXXXXXXXXXXXXXXXXXXXXXXXXXXXXXXXXXXXXXXXXXXXXXXXXXXXXXXXXXXXXXXXXXXXXXXEWXXXXXXXXXXXXXXXXXXXXXXXXXXXXXXXXXXXXXXXXXXXXXXXXXXXXXXXXXXXXXXXFLEXXXXXXXXLFQLGVGXXXXXXXXXXXX

SEQ ID NO: 37408 - protein, 79 aa, Diabrotica virgifera
  misc_feature: Coding regions on vcDNA: vcDNA=SeqID_17105; Strand=-; Position=2-238
  misc_feature (15)..(21): Xaa can be any naturally occurring amino acid
  misc_feature (36)..(56): Xaa can be any naturally occurring amino acid
  misc_feature (58)..(65): Xaa can be any naturally occurring amino acid
  misc_feature (73)..(79): Xaa can be any naturally occurring amino acid
TPQSPPFPKKHFAPXXXXXXXLSLRGASFLFQKEFXXXXXXXXXXXXXXXXXXXXXPXXXXXXXXHNFNSKKXXXXXXX

SEQ ID NO: 37409 - protein, 37 aa, Diabrotica virgifera
  misc_feature: Coding regions on vcDNA: vcDNA=SeqID_17106; Strand=-; Position=1-111
  misc_feature (2)..(35): Xaa can be any naturally occurring amino acid
SXXXXXXXXXXXXXXXXXXXXXXXXXXXXXXXXXXNN

SEQ ID NO: 37410 - protein, 95 aa, Diabrotica virgifera
  misc_feature: Coding regions on vcDNA: vcDNA=SeqID_17107; Strand=+; Position=399-683
QLRLKMFTLVKYVTMLLLCIIIFISYMIFYIHYKSNLFKYNHAENIILRKMRISTHYIDLPPEFAYLFFTWTLCHMPFCLIHKRLPCPLPHYRGR

SEQ ID NO: 37411 - protein, 336 aa, Diabrotica virgifera
  misc_feature: Coding regions on vcDNA: vcDNA=SeqID_17108; Strand=-; Position=1-1008
  misc_feature (8)..(27): Xaa can be any naturally occurring amino acid
  misc_feature (29)..(332): Xaa can be any naturally occurring amino acid
YNPKKFGXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRVR

SEQ ID NO: 37412 - protein, 58 aa, Diabrotica virgifera
  misc_feature: Coding regions on vcDNA: vcDNA=SeqID_17109; Strand=-; Position=88-264
LGLFIDCHLFRASATCHITLIYPRHTSLVCIIGYIKTYDVDILILCDTRQKPETNDCE

SEQ ID NO: 37413 - protein, 40 aa, Diabrotica virgifera
  misc_feature: Coding regions on vcDNA: vcDNA=SeqID_17110; Strand=-; Position=105-227
GFDLGIEWGLRARRSKKRLGRRGFHIQKFQTIYLESYNSS

SEQ ID NO: 37414 - protein, 207 aa, Diabrotica virgifera
  misc_feature: Coding regions on vcDNA: vcDNA=SeqID_17111; Strand=+; Position=117-737
  misc_feature (27)..(49): Xaa can be any naturally occurring amino acid
  misc_feature (53)..(206): Xaa can be any naturally occurring amino acid
MENFFSSTSCIRDYLINNSHHLLSFSXXXXXXXXXXXXXXXXXXXXXXXIETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 37415 - protein, 110 aa, Diabrotica virgifera
  misc_feature: Coding regions on vcDNA: vcDNA=SeqID_17112; Strand=-; Position=7-339
IIEICRDFTREILTAAPCRMCSGDNKGRYILSSYSLDSFFHTISEVLSVARSPASGVPYGPPRLFSRCLRCVLVAVFRSAVLFVLLFSLVPVLSYVSKIFPSLLSSPFRP

SEQ ID NO: 37416 - protein, 53 aa, Diabrotica virgifera
  misc_feature: Coding regions on vcDNA: vcDNA=SeqID_17113; Strand=+; Position=2-163
  misc_feature (1)..(21): Xaa can be any naturally occurring amino acid
  misc_feature (23)..(30): Xaa can be any naturally occurring amino acid
XXXXXXXXXXXXXXXXXXXXXRXXXXXXXXDRNQPGSHRFKLRSCKILKVEQT

SEQ ID NO: 37417 - protein, 66 aa, Diabrotica virgifera; identical to SEQ ID NO: 26808
  misc_feature: Coding regions on vcDNA: vcDNA=SeqID_17114; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37418 - protein, 271 aa, Diabrotica virgifera
  misc_feature: Coding regions on vcDNA: vcDNA=SeqID_17115; Strand=-; Position=1-813
  misc_feature: Homolog annotation: Hit_ID=CAA10770.1; Match level="QueryCoverage =85%, HitCoverage=70%, E-value=3e-28, Identity=32%"; Hit description =reverse transcriptase-like [Bos taurus]
  misc_feature (56)..(56): Xaa can be any naturally occurring amino acid
  misc_feature (100)..(100): Xaa can be any naturally occurring amino acid
  misc_feature (219)..(219): Xaa can be any naturally occurring amino acid
KYFDKDVYHPRQLSKKPKGLEHMEEGNLLKGELLNNFRYADDTVIFADTAQGLQLXMNKAEVSSKYGLKINTSKTKVMIITIEKVQFTINQKVVERVPAXDHSQEIKARIEKARAAFIQVSKLFKSHNLNLELKLRLLRCYIFYILYGVDSWTLTEATTNRLDAFEMWTYRRILKIFWMDKISNGKILQKLNKEKEIMCTVKRRKLEYLGHITRNEKNXNLLKSLLQVNGKRGKVNGKRGVGRRRISWLRNSRTWFATSTTGLFKAAVNKI

SEQ ID NO: 37419 - protein, 54 aa, Diabrotica virgifera
  misc_feature: Coding regions on vcDNA: vcDNA=SeqID_17116; Strand=+; Position=18-182
QQTIHQRWNRVLPQLSIHDVHEVLHAVTKTYGLNALSATTNTFKGPMILFPHQD

SEQ ID NO: 37420 - protein, 158 aa, Diabrotica virgifera
  misc_feature: Coding regions on vcDNA: vcDNA=SeqID_17117; Strand=+; Position=68-544
  misc_feature: Homolog annotation: Hit_ID=XP_309718.1; Match level="QueryCoverage =91%, HitCoverage=25%, E-value=9e-50, Identity=64%"; Hit description =ENSANGP00000012528 [Anopheles gambiae]
  misc_feature: Gene Ontology Annotation: Molecular function=calcium, potassium:sodium antiporter activity; Cellular component=integral to plasma membrane; Biological process=calcium ion homeostasis
  misc_feature: Pfam annotation: Pfam_ID=Na_Ca_ex; Match level="Score=94.7, E-value =2.4e-25, Copies=1"; Pfam description=Sodium/calcium exchanger protein
ESIPIHKIHITNATGIGDTLRIPDSVMGISFLAIGAGVPEAVSSIVVVKKGKGAMGISNSLGSNTFDILLCLGVPWLLKATVVSSNKWVNINSSGLQYSTVTLLVTLIAFYFALTCNKFKLDKWIGLYCLIIYILFVILATLIELNVFFPVNSPTCGR

SEQ ID NO: 37421 - protein, 34 aa, Diabrotica virgifera; identical to SEQ ID NO: 27603
  misc_feature: Coding regions on vcDNA: vcDNA=SeqID_17118; Strand=-; Position=80-184

SEQ ID NO: 37422 - protein, 233 aa, Diabrotica virgifera
  misc_feature: Coding regions on vcDNA: vcDNA=SeqID_17119; Strand=-; Position=171-872
  misc_feature (2)..(9): Xaa can be any naturally occurring amino acid
  misc_feature (11)..(11): Xaa can be any naturally occurring amino acid
  misc_feature (13)..(197): Xaa can be any naturally occurring amino acid
  misc_feature (200)..(224): Xaa can be any naturally occurring amino acid
SXXXXXXXXAXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXIINYDELLN

SEQ ID NO: 37423 - protein, 222 aa, Diabrotica virgifera
  misc_feature: Coding regions on vcDNA: vcDNA=SeqID_17120; Strand=+; Position=230-896
  misc_feature: Homolog annotation: Hit_ID=NP_609604.1; Match level="QueryCoverage =50%, HitCoverage=14%, E-value=2e-38, Identity=66%"; Hit description =CG5204-PA [Drosophila melanogaster] gb|AAF53246.1| CG5204-PA [Drosophila melanogaster]
  misc_feature (124)..(124): Xaa can be any naturally occurring amino acid
  misc_feature (135)..(139): Xaa can be any naturally occurring amino acid
MEMKPHPMENKVFVWNDIVVPMDIEVDDSNYEYTEDKVDDNVSLDLSIRTQSPLDSENSCLGQESVTPNSIHHSPLASTEKIPTHGNDISVAQHKRVFKCPHCTFWASTASRFHVHIVGHLNKXPFECSLCAYRXXXXXDITKHIKLKSVRDQAHEQAKVLMTDETGRRNYTKYNKYLTEIPVTSEQCMDWVATRPKHHDRNSSPSTSKTDLPKLNKIPNKQ

SEQ ID NO: 37424 - protein, 77 aa, Diabrotica virgifera
  misc_feature: Coding regions on vcDNA: vcDNA=SeqID_17121; Strand=-; Position=188-421
GYDICLIGTRFSQRAAGELVPSVSSWLISYLWEDRDDTRFYILLLSNFSLHVKWFDILILVYANLCISIHGKYFFLR

SEQ ID NO: 37425 - protein, 113 aa, Diabrotica virgifera
  misc_feature: Coding regions on vcDNA: vcDNA=SeqID_17122; Strand=+; Position=184-525
  misc_feature (35)..(42): Xaa can be any naturally occurring amino acid
  misc_feature (47)..(62): Xaa can be any naturally occurring amino acid
  misc_feature (70)..(91): Xaa can be any naturally occurring amino acid
  misc_feature (98)..(107): Xaa can be any naturally occurring amino acid
QVYVLTYPILILLRLDILYLPHELYHYITFIVEIXXXXXXXXILIDXXXXXXXXXXXXXXXXLLQYTCKXXXXXXXXXXXXXXXXXXXXXXSFNNPIXXXXXXXXXXNMSFLY

SEQ ID NO: 37426 - protein, 65 aa, Diabrotica virgifera
  misc_feature: Coding regions on vcDNA: vcDNA=SeqID_17123; Strand=-; Position=172-369
  misc_feature (10)..(21): Xaa can be any naturally occurring amino acid
  misc_feature (25)..(30): Xaa can be any naturally occurring amino acid
  misc_feature (42)..(48): Xaa can be any naturally occurring amino acid
YLCGCLPVAXXXXXXXXXXXXEKKXXXXXXLPPPGFKPPGPXXXXXXXRTQTLIIKAFLPPIINL

SEQ ID NO: 37427 - protein, 247 aa, Diabrotica virgifera
  misc_feature: Coding regions on vcDNA: vcDNA=SeqID_17124; Strand=-; Position=1-741
  misc_feature (3)..(4): Xaa can be any naturally occurring amino acid
  misc_feature (7)..(24): Xaa can be any naturally occurring amino acid
  misc_feature (26)..(171): Xaa can be any naturally occurring amino acid
  misc_feature (174)..(184): Xaa can be any naturally occurring amino acid
  misc_feature (186)..(198): Xaa can be any naturally occurring amino acid
  misc_feature (202)..(213): Xaa can be any naturally occurring amino acid
  misc_feature (215)..(223): Xaa can be any naturally occurring amino acid
  misc_feature (237)..(245): Xaa can be any naturally occurring amino acid
STXXHPXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXGXXXXXXXXXXXXXEEMXXXXXXXXXXXXGXXXXXXXXXKKDILSRYELTIVXXXXXXXXXRK

SEQ ID NO: 37428 - protein, 18 aa, Diabrotica virgifera
  misc_feature: Coding regions on vcDNA: vcDNA=SeqID_17125; Strand=-; Position=1-54
  misc_feature (4)..(10): Xaa can be any naturally occurring amino acid
  misc_feature (14)..(18): Xaa can be any naturally occurring amino acid
PISXXXXXXXLILXXXXX

SEQ ID NO: 37429 - protein, 62 aa, Diabrotica virgifera
  misc_feature: Coding regions on vcDNA: vcDNA=SeqID_17126; Strand=+; Position=2-190
RGGIFMEAKKYPLCRTDATFHSEIDMVLHRFIRFLDLGFNYFVLANNRSSPSDDNVTLIELE

SEQ ID NO: 37430 - protein, 66 aa, Diabrotica virgifera
  misc_feature: Coding regions on vcDNA: vcDNA=SeqID_17127; Strand=+; Position=175-372
CRKYNLINLKSTACRAELSRSIRERIAKIEHLRNLPRSIHVIRMRYMISLEYSPKTIIFLHRHSDP

SEQ ID NO: 37431 - protein, 261 aa, Diabrotica virgifera
  misc_feature: Coding regions on vcDNA: vcDNA=SeqID_17128; Strand=+; Position=1-787
  misc_feature: Homolog annotation: Hit_ID=NP_997907.1; Match level="QueryCoverage =91%, HitCoverage=47%, E-value=2e-89, Identity=65%"; Hit description =MYST histone acetyltransferase 1 [Danio rerio] gb|AAH55629.1| MYST histone acetyltransferase 1
  misc_feature: Gene Ontology Annotation: Molecular function=protein binding; Cellular component=dosage compensation complex (sensu Drosophila); Biological process=dosage compensation, by hyperactivation of X chromosome
  misc_feature (210)..(210): Xaa can be any naturally occurring amino acid
  misc_feature (255)..(255): Xaa can be any naturally occurring amino acid
  misc_feature (260)..(260): Xaa can be any naturally occurring amino acid
RTRGKKSDNENKPNIQDEDSESAEEQPLDVGEHYLVRRSDDTWHPAEIIQSRFNELERQYEYYVHYEGYNRRLDEWVPRGRIMSSRFNMTESGQKGMLDMKVLRDRPLINDLLSDNSDRKITRNQKRRHDEINHIQKTYAEMDPTTAALEKEHEQITKVKYIDKIQIGRFEIDTWYFSPFPEEYGRQSKLWICEYCLKYMRLEKSYRYHXSECTQRQPVGKEIYRKGTLSVYEVDGKDHKVYCQNLCLQAKLFLXHKTLXF

SEQ ID NO: 37432 - protein, 332 aa, Diabrotica virgifera
  misc_feature: Coding regions on vcDNA: vcDNA=SeqID_17129; Strand=+; Position=1-996
  misc_feature (33)..(329): Xaa can be any naturally occurring amino acid
KKISSLQSISSIQYPWSEIFSFSKRKISSFRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRE

SEQ ID NO: 37433 - protein, 251 aa, Diabrotica virgifera
  misc_feature: Coding regions on vcDNA: vcDNA=SeqID_17130; Strand=+; Position=119-874
  misc_feature: Homolog annotation: Hit_ID=XP_311751.1; Match level="QueryCoverage =68%, HitCoverage=52%, E-value=2e-52, Identity=58%"; Hit description =ENSANGP00000014322 [Anopheles gambiae]
  misc_feature: Pfam annotation: Pfam_ID=DUF1279; Match level="Score=166.4, E-value =6.1e-47, Copies=1"; Pfam description=Protein of unknown function (DUF1279)
  misc_feature (235)..(235): Xaa can be any naturally occurring amino acid
  misc_feature (238)..(238): Xaa can be any naturally occurring amino acid
MANVLTRIVSRAACGRLVKREFSILSYYHYPCITRLNKRINDYSFSCDHYNLTFRINPQKYRICNYSDKGGEKPPEKLTLFQKFKQMYRDYWYILVPVHLVTSSIWFGGFYYMAKSGIDIVHILESWHVSEKVLNPLRDSSMGYLAVAYACYKIATPARYTVTLGGTTISINYLKKWGYIKPVPSAERMKEIYHEKKENITKTVREGIKEKKETFMDSFHETTEGIKEKKDNLLXTVXKSADQKTEFKKKT

SEQ ID NO: 37434 - protein, 124 aa, Diabrotica virgifera
  misc_feature: Coding regions on vcDNA: vcDNA=SeqID_17131; Strand=+; Position=227-601
  misc_feature (48)..(54): Xaa can be any naturally occurring amino acid
SILKIFSAELTNTSLLKHRFQLTNTLRNLPIITHVITDSYKSSSSFTXXXXXXXTTFIYMKLNMYDTTHTKIVEYSVRHLGLRSGFAYISLHMSITDTTDQNHFPDSSSPQIKFTAPRIPDPCP

SEQ ID NO: 37435 - protein, 82 aa, Diabrotica virgifera
  misc_feature: Coding regions on vcDNA: vcDNA=SeqID_17132; Strand=+; Position=345-590
  misc_feature: Homolog annotation: Hit_ID=NP_997907.1; Match level="QueryCoverage =91%, HitCoverage=15%, E-value=1e-17, Identity=57%"; Hit description =MYST histone acetyltransferase 1 [Danio rerio] gb|AAH55629.1| MYST histone acetyltransferase 1
  misc_feature: Gene Ontology Annotation: Cellular component=dosage compensation complex (sensu Drosophila); Biological process=dosage compensation, by hyperactivation of X chromosome
  misc_feature (68)..(68): Xaa can be any naturally occurring amino acid
MITDLISDRSENYTTRTQKRNNGEMHHIQETYDEPHPTTGALESSHELITKVEGIDKRQIGRFEIDTXGFSPFPEEYDRQSK

SEQ ID NO: 37436 - protein, 34 aa, Diabrotica virgifera; identical to SEQ ID NO: 27603
  misc_feature: Coding regions on vcDNA: vcDNA=SeqID_17133; Strand=-; Position=80-184

SEQ ID NO: 37437 - protein, 69 aa, Diabrotica virgifera
  misc_feature: Coding regions on vcDNA: vcDNA=SeqID_17134; Strand=-; Position=108-317
SFSFCIRFMFLVDDDIYLSVITSLIIGRFLIVFVACGLGSNRLVFLGSALGMLHIGSLIVFPFKYIVNR

SEQ ID NO: 37438 - protein, 70 aa, Diabrotica virgifera
  misc_feature: Coding regions on vcDNA: vcDNA=SeqID_17135; Strand=-; Position=1-210
  misc_feature (4)..(16): Xaa can be any naturally occurring amino acid
  misc_feature (27)..(36): Xaa can be any naturally occurring amino acid
  misc_feature (41)..(47): Xaa can be any naturally occurring amino acid
  misc_feature (49)..(66): Xaa can be any naturally occurring amino acid
GGGXXXXXXXXXXXXXRVGGVGVREGXXXXXXXXXXEVEGXXXXXXXEXXXXXXXXXXXXXXXXXXSWLG

SEQ ID NO: 37439 - protein, 54 aa, Diabrotica virgifera
  misc_feature: Coding regions on vcDNA: vcDNA=SeqID_17136; Strand=+; Position=6-170
AARSLLQNQKISLMTYPQNFNDGYEYHSNDISNFLNVRRTECVRGNDNKNREWI

SEQ ID NO: 37440 - protein, 212 aa, Diabrotica virgifera
  misc_feature: Coding regions on vcDNA: vcDNA=SeqID_17137; Strand=-; Position=2-637
  misc_feature (9)..(21): Xaa can be any naturally occurring amino acid
  misc_feature (24)..(55): Xaa can be any naturally occurring amino acid
  misc_feature (57)..(115): Xaa can be any naturally occurring amino acid
  misc_feature (121)..(137): Xaa can be any naturally occurring amino acid
  misc_feature (145)..(152): Xaa can be any naturally occurring amino acid
  misc_feature (163)..(187): Xaa can be any naturally occurring amino acid
  misc_feature (189)..(201): Xaa can be any naturally occurring amino acid
  misc_feature (205)..(212): Xaa can be any naturally occurring amino acid
TLSTIEVAXXXXXXXXXXXXXLLXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXDSELSXXXXXXXXXXXXXXXXXVQINRWAXXXXXXXXKDRVFNKRVRXXXXXXXXXXXXXXXXXXXXXXXXXIXXXXXXXXXXXXXKIYXXXXXXXX

SEQ ID NO: 37441 - protein, 130 aa, Diabrotica virgifera
  misc_feature: Coding regions on vcDNA: vcDNA=SeqID_17138; Strand=+; Position=2-391
LFASENIGQNLDIINSAMVTIANQVLKPEKDPIKKKDWMTDKILDLIQQRRNWKNKDEIRYREIYRQIRYEVKRTKEDWMGQRCREMEELQRKHDEFNIHKKLKEITYTQRKRTPHFMRNSKGKIILDLD

SEQ ID NO: 37442 - protein, 77 aa, Diabrotica virgifera
  misc_feature: Coding regions on vcDNA: vcDNA=SeqID_17139; Strand=-; Position=68-301
  misc_feature (21)..(29): Xaa can be any naturally occurring amino acid
KISPYNKSTRYLEVPWSKNRXXXXXXXXXLISDTIFIRSFRSFGAKKVSRNFSSKPIVVEFNAIQNPKNAKIITLKI

SEQ ID NO: 37443 - protein, 230 aa, Diabrotica virgifera
  misc_feature: Coding regions on vcDNA: vcDNA=SeqID_17140; Strand=+; Position=117-810
  misc_feature: Homolog annotation: Hit_ID=XP_396161.1; Match level="QueryCoverage =95%, HitCoverage=94%, E-value=8e-42, Identity=45%"; Hit description =similar to Hypothetical protein zgc:76993 [Apis mellifera]
  misc_feature: Pfam annotation: Pfam_ID=SGS; Match level="Score=48.6, E-value=1.8e -11, Copies=1"; Pfam description=SGS domain
  misc_feature (96)..(104): Xaa can be any naturally occurring amino acid
  misc_feature (108)..(116): Xaa can be any naturally occurring amino acid
  misc_feature (170)..(170): Xaa can be any naturally occurring amino acid
  misc_feature (183)..(183): Xaa can be any naturally occurring amino acid
  misc_feature (196)..(196): Xaa can be any naturally occurring amino acid
MTMEKITELKKDIAELESLEKQATRQKNKDILSIEIRKLVSEVVLLEEKLKTQSNPVTSPIASLSTGTVNKRYQVKINNYAWDQSDKYVKFYITLXXXXXXXXXNVSXXXXXXXXXLTVTDLDNKDHSWQIKNLLKNIDPVKSTWKVKTDMVLINAAKTSSDNWSHVTEXEKKASDSKAPKMXTLDKLDPSEGLMXLMKNMYDSGDDEMKRTIAKAWTESQGKNQAASFM

SEQ ID NO: 37444 - protein, 106 aa, Diabrotica virgifera
  misc_feature: Coding regions on vcDNA: vcDNA=SeqID_17141; Strand=+; Position=34-351
  misc_feature: Pfam annotation: Pfam_ID=zf-AD; Match level="Score=61.5, E-value=2.4e- 15, Copies=1"; Pfam description=Zinc-finger associated domain (zf-AD)
  misc_feature (74)..(74): Xaa can be any naturally occurring amino acid
  misc_feature (90)..(90): Xaa can be any naturally occurring amino acid
  misc_feature (102)..(103): Xaa can be any naturally occurring amino acid
LIYISAHCAVGLYRSKMAYNKVVCRLCLSEKELNCVFENNSEKKDLQDVIFTTTGVKILEKDVISRKICANCSXVVVKMNEFRERSIRTXQYLKEKCIEHLXXDEM

SEQ ID NO: 37445 - protein, 247 aa, Diabrotica virgifera
  misc_feature: Coding regions on vcDNA: vcDNA=SeqID_17142; Strand=+; Position=104-844
  misc_feature: Homolog annotation: Hit_ID=NP_477354.1; Match level="QueryCoverage =98%, HitCoverage=84%, E-value=1e-108, Identity=46%"; Hit description= CG2720-PA [Drosophila melanogaster] gb|AAF51511.1| CG2720-PA [Drosophila melanogaster]
  misc_feature: Gene Ontology Annotation: Molecular function=enzyme inhibitor activity; Cellular component=cytoplasm; Biological process=protein folding
  misc_feature: Pfam annotation: Pfam_ID=TPR_1; Match level="Score=165.3, E-value =1.3e-46, Copies=6"; Pfam description=Tetratricopeptide repeat
MEQGNNFYKNKDFENAIVHYNKAIEHDPTDITFYNNLAAVYFEQKEYEQCIKECQRAIDLGRENRADFKLIAKSFMRIGNAYKKLKDYKTAKTYYEKSMSEHRTPEIKTLLSDVERIIKDEERKSYINPELAEKEKEMGNDMFKKGDYATAVKHYTEAIKRNPDDAKLYSNRAACYTKLAAFDLGLKDCDKCVELDPKFIKGWIRKGHILQGMQQQSKAISAFQKALDLDPNNQEALQGYRACTIEN

SEQ ID NO: 37446 - protein, 66 aa, Diabrotica virgifera; identical to SEQ ID NO: 26808
  misc_feature: Coding regions on vcDNA: vcDNA=SeqID_17143; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37447 - protein, 269 aa, Diabrotica virgifera
  misc_feature: Coding regions on vcDNA: vcDNA=SeqID_17144; Strand=+; Position=73-879
  misc_feature (14)..(22): Xaa can be any naturally occurring amino acid
  misc_feature (24)..(34): Xaa can be any naturally occurring amino acid
  misc_feature (38)..(51): Xaa can be any naturally occurring amino acid
  misc_feature (53)..(63): Xaa can be any naturally occurring amino acid
  misc_feature (71)..(83): Xaa can be any naturally occurring amino acid
  misc_feature (86)..(254): Xaa can be any naturally occurring amino acid
  misc_feature (258)..(258): Xaa can be any naturally occurring amino acid
  misc_feature (262)..(262): Xaa can be any naturally occurring amino acid
LIKYSVERIIFSFXXXXXXXXXLXXXXXXXXXXXSFIXXXXXXXXXXXXXXSXXXXXXXXXXXTETLFVFXXXXXXXXXXXXXFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKAXIFFXDERPYRV

SEQ ID NO: 37448 - protein, 71 aa, Diabrotica virgifera
  misc_feature: Coding regions on vcDNA: vcDNA=SeqID_17145; Strand=-; Position=2-214
  misc_feature (44)..(71): Xaa can be any naturally occurring amino acid
VRHYSVYAVSAGKTSRVPSTPSAGIVLIMFMAKSHVLYKQLKKXXXXXXXXXXXXXXXXXXXXXXXXXXXX

SEQ ID NO: 37449 - protein, 209 aa, Diabrotica virgifera
  misc_feature: Coding regions on vcDNA: vcDNA=SeqID_17146; Strand=+; Position=174-800
  misc_feature (53)..(75): Xaa can be any naturally occurring amino acid
  misc_feature (86)..(141): Xaa can be any naturally occurring amino acid
  misc_feature (143)..(202): Xaa can be any naturally occurring amino acid
FSIIFLRNGNGIRFSIYLIFSENKLNFIFISQYISSIKSFFIIHLILNIFQGXXXXXXXXXXXXXXXXXXXXXXXILKYALFIFSXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXSFNFLKT

SEQ ID NO: 37450 - protein, 145 aa, Diabrotica virgifera
  misc_feature: Coding regions on vcDNA: vcDNA=SeqID_17147; Strand=-; Position=21-458
LETMLRDSPGKYSSRGLAALSLLCDMFLLLFFTLILYILFMSSIHFFITTFHYLFIATCFPLLHWTAILPRLRPLRLPSAVILLFTQFLGSHFLRRLPLRFLLFMSVFGYVRSSDVYFLVSRHPYQLSCSCGLYSARHRQSRKDR

SEQ ID NO: 37451 - protein, 83 aa, Diabrotica virgifera
  misc_feature: Coding regions on vcDNA: vcDNA=SeqID_17148; Strand=+; Position=140-391
  misc_feature: Homolog annotation: Hit_ID=XP_396640.1; Match level="QueryCoverage =97%, HitCoverage=10%, E-value=1e-20, Identity=59%"; Hit description =similar to CG1776-PA [Apis mellifera]
MIKVDENDPVGEVQLSFPHREVQIQRGKDPKDFYTLEEEIGRGKFGTVYRCKEKSTGLCLAAKFIGCPKKEGKQAPVIEPEEV

SEQ ID NO: 37452 - protein, 91 aa, Diabrotica virgifera
  misc_feature: Coding regions on vcDNA: vcDNA=SeqID_17149; Strand=-; Position=1-273
  misc_feature (66)..(73): Xaa can be any naturally occurring amino acid
IVSKFGENSSTFSCHEHKYKDKDFTSCVIKTLCYSSLLIFMGLLCHHKLIITKNICWAYGKTSLCXXXXXXXXHKGGRCNALMTITYQTLE

SEQ ID NO: 37453 - protein, 147 aa, Diabrotica virgifera
  misc_feature: Coding regions on vcDNA: vcDNA=SeqID_17150; Strand=+; Position=7-448
  misc_feature: Homolog annotation: Hit_ID=AAF13316.1; Match level="QueryCoverage =76%, HitCoverage=70%, E-value=5e-19, Identity=46%"; Hit description =translation initiation factor 5A [Spodoptera frugiperda] gb|AAF13315.1| translation initiation factor 5A [
  misc_feature: Gene Ontology Annotation: Molecular function=translation initiation factor activity; Cellular component=ribosome; Biological process =protein biosynthesis
  misc_feature (54)..(54): Xaa can be any naturally occurring amino acid
  misc_feature (90)..(90): Xaa can be any naturally occurring amino acid
  misc_feature (117)..(117): Xaa can be any naturally occurring amino acid
PPFKREREREGEAPSGAQQARRETKRIVPLEYNLEDSHFETGNSEVSATYTPQXHTLRKDVHDTITHRPRKSDETSASIAVKHRHARVHXVERDIFTPQKYKDILPSTHNMKRPQAXSADKRSTSISDEIYPSLMIDRATLPDECIV

SEQ ID NO: 37454 - protein, 48 aa, Diabrotica virgifera
  misc_feature: Coding regions on vcDNA: vcDNA=SeqID_17151; Strand=-; Position=18-164
LMCFFGCSMSQTLPCIMSYMVKTVEHIPDPGDIDKSRNIVVTHVEFCG

SEQ ID NO: 37455 - protein, 43 aa, Diabrotica virgifera
  misc_feature: Coding regions on vcDNA: vcDNA=SeqID_17152; Strand=-; Position=0-128
  misc_feature (3)..(41): Xaa can be any naturally occurring amino acid
PFXXXXXXXXXXXXXXXXXXXXXXXXXXXXXXXXXXXXXXXGT

SEQ ID NO: 37456 - protein, 234 aa, Diabrotica virgifera
  misc_feature: Coding regions on vcDNA: vcDNA=SeqID_17153; Strand=+; Position=1-702
  misc_feature (3)..(227): Xaa can be any naturally occurring amino acid
  misc_feature (231)..(231): Xaa can be any naturally occurring amino acid
  misc_feature (233)..(233): Xaa can be any naturally occurring amino acid
YLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKAXIXF

SEQ ID NO: 37457 - protein, 170 aa, Diabrotica virgifera
  misc_feature: Coding regions on vcDNA: vcDNA=SeqID_17154; Strand=-; Position=251-763
  misc_feature: Homolog annotation: Hit_ID=XP_313674.1; Match level="QueryCoverage =100%, HitCoverage=23%, E-value=9e-76, Identity=80%"; Hit description= ENSANGP00000012684 [Anopheles gambiae]
  misc_feature (4)..(4): Xaa can be any naturally occurring amino acid
KDIXENLVYMGNLSVLGLLLLKQLSNKVKKNDFSICRYIQASIRFLWDAYNVDESNDPTALVVSMAYKEHWMEIMELWFLGMQTLSGVISVIPWISEFAIESGWAEGIVQLLKKVKIGTLPANVKSAYEDFLCNLVDANEDVVDVLKKAEALRVCRNHRLMDLGKKLFGD

SEQ ID NO: 37458 - protein, 257 aa, Diabrotica virgifera
  misc_feature: Coding regions on vcDNA: vcDNA=SeqID_17155; Strand=-; Position=2-772
  misc_feature (11)..(31): Xaa can be any naturally occurring amino acid
  misc_feature (36)..(239): Xaa can be any naturally occurring amino acid
  misc_feature (243)..(257): Xaa can be any naturally occurring amino acid
INSIGLLVFKXXXXXXXXXXXXXXXXXXXXXHPTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRYXXXXXXXXXXXXXXX

SEQ ID NO: 37459 - protein, 76 aa, Diabrotica virgifera
  misc_feature: Coding regions on vcDNA: vcDNA=SeqID_17156; Strand=-; Position=198-428
  misc_feature (8)..(43): Xaa can be any naturally occurring amino acid
  misc_feature (48)..(56): Xaa can be any naturally occurring amino acid
LKPGPPPXXXXXXXXXXXXXXXXXXXXXXXXXXXXXXXXXXXXGLSFXXXXXXXXXNHPGLHRLNSDQVKFKVDQT

SEQ ID NO: 37460 - protein, 102 aa, Diabrotica virgifera
  misc_feature: Coding regions on vcDNA: vcDNA=SeqID_17157; Strand=+; Position=843 -1148
  misc_feature (52)..(61): Xaa can be any naturally occurring amino acid
  misc_feature (74)..(97): Xaa can be any naturally occurring amino acid
SFELFIENVNFYKMVYFSLVNLLFLSFHKLISNLPRPKLGIYLFNKDIPIKXXXXXXXXXXPFISPRPKGIPPXXXXXXXXXXXXXXXXXXXXXXXXKNGEP

SEQ ID NO: 37461 - protein, 262 aa, Diabrotica virgifera
  misc_feature: Coding regions on vcDNA: vcDNA=SeqID_17158; Strand=+; Position=92-879
  misc_feature: Homolog annotation: Hit_ID=EAA09127.2; Match level="QueryCoverage =99%, HitCoverage=96%, E-value=1e-100, Identity=66%"; Hit description= ENSANGP00000003767 [Anopheles gambiae str. PEST] ref|XP_562157.1| ENSANGP00000003767 [Anopheles gambiae s
  misc_feature: Gene Ontology Annotation: Molecular function=diphthine synthase activity; Cellular component=cellular_component unknown; Biological process=peptidyl-diphthamide biosynthesis from peptidyl-histidine
  misc_feature: Pfam annotation: Pfam_ID=TP_methylase; Match level="Score=68.7, E -value=1.6e-17, Copies=1"; Pfam description=Tetrapyrrole (Corrin/Porphyrin) Methy
  misc_feature (191)..(196): Xaa can be any naturally occurring amino acid
  misc_feature (226)..(226): Xaa can be any naturally occurring amino acid
  misc_feature (238)..(238): Xaa can be any naturally occurring amino acid
  misc_feature (254)..(254): Xaa can be any naturally occurring amino acid
MFYIIGLGLGDPKDITVKGLEIVKKCDRVYLEAYTSILTCGKEELEKFYGRPLIVADRDLVELGADDILAGAEEKDVALLVVGDPFGATTHTDFILRAKEKGIKFQVVHNASILNAVGCCGLQLYSFGETVSIPFWTDQWQPDSFFDKIVNNVKNRLHTLCLLDIKVKEPTLESLTMKKKVYMPPKFMMVXXXXXXLLQIIDKRKEQGEDPGISEKNVCVGLARVXSESQKIVTCSLXDMSTVDLGGPLHSLIXCRAIIHPG

SEQ ID NO: 37462 - protein, 108 aa, Diabrotica virgifera; identical to SEQ ID NO: 27732
  misc_feature: Coding regions on vcDNA: vcDNA=SeqID_17159; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37463 - protein, 271 aa, Diabrotica virgifera
  misc_feature: Coding regions on vcDNA: vcDNA=SeqID_17160; Strand=-; Position=2-814
  misc_feature (2)..(26): Xaa can be any naturally occurring amino acid
  misc_feature (28)..(254): Xaa can be any naturally occurring amino acid
  misc_feature (257)..(271): Xaa can be any naturally occurring amino acid
IXXXXXXXXXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 37464 - protein, 25 aa, Diabrotica virgifera
  misc_feature: Coding regions on vcDNA: vcDNA=SeqID_17161; Strand=-; Position=0-74
NYYIPRANGKDVTCNTCCSPGRVRG

SEQ ID NO: 37465 - protein, 51 aa, Diabrotica virgifera
  misc_feature: Coding regions on vcDNA: vcDNA=SeqID_17162; Strand=+; Position=74-229
  misc_feature (34)..(45): Xaa can be any naturally occurring amino acid
LLLEHVLYILIVLAFSICIKTRTKNFHMLQDGMXXXXXXXXXXXXTILIIL

SEQ ID NO: 37466 - protein, 254 aa, Diabrotica virgifera
  misc_feature: Coding regions on vcDNA: vcDNA=SeqID_17163; Strand=-; Position=2-763
  misc_feature (2)..(2): Xaa can be any naturally occurring amino acid
  misc_feature (4)..(187): Xaa can be any naturally occurring amino acid
  misc_feature (190)..(228): Xaa can be any naturally occurring amino acid
  misc_feature (230)..(245): Xaa can be any naturally occurring amino acid
SXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXXXXXXXXXXXXXXXXXXXXXXXXXXXXGXXXXXXXXXXXXXXXXNTELTIRLR

SEQ ID NO: 37467 - protein, 47 aa, Diabrotica virgifera
  misc_feature: Coding regions on vcDNA: vcDNA=SeqID_17164; Strand=+; Position=1-144
TTTAHREKKQAAKIAEIQMITMLPRTLLFCNTRIMWDIRREFILCPQ

SEQ ID NO: 37468 - protein, 36 aa, Diabrotica virgifera; identical to SEQ ID NO: 37268
  misc_feature: Coding regions on vcDNA: vcDNA=SeqID_17165; Strand=-; Position=1-108
  misc_feature (1)..(36): Xaa can be any naturally occurring amino acid

SEQ ID NO: 37469 - protein, 102 aa, Diabrotica virgifera
  misc_feature: Coding regions on vcDNA: vcDNA=SeqID_17166; Strand=+; Position=90-398
  misc_feature (6)..(13): Xaa can be any naturally occurring amino acid
  misc_feature (17)..(26): Xaa can be any naturally occurring amino acid
  misc_feature (32)..(43): Xaa can be any naturally occurring amino acid
  misc_feature (45)..(55): Xaa can be any naturally occurring amino acid
ENIFFXXXXXXXXVPRXXXXXXXXXXSSFSLXXXXXXXXXXXXSXXXXXXXXXXXNETVLVFQYHLISLRNKLNFFPHNIFLIQSLSLSHHIQYLFGIELSK

SEQ ID NO: 37470 - protein, 257 aa, Diabrotica virgifera
  misc_feature: Coding regions on vcDNA: vcDNA=SeqID_17167; Strand=+; Position=88-856
  misc_feature: Homolog annotation: Hit_ID=XP_396693.1; Match level="QueryCoverage =86%, HitCoverage=37%, E-value=8e-55, Identity=44%"; Hit description =similar to ENSANGP00000021660 [Apis mellifera]
  misc_feature: Gene Ontology Annotation: Molecular function=cholinesterase activity; Cellular component=endoplasmic reticulum; Biological process=acyl-CoA metabolism
  misc_feature: Pfam annotation: Pfam_ID=COesterase; Match level="Score=-203.9, E -value=0.0095, Copies=1"; Pfam description=Carboxylesterase
  misc_feature (202)..(202): Xaa can be any naturally occurring amino acid
  misc_feature (212)..(212): Xaa can be any naturally occurring amino acid
  misc_feature (216)..(216): Xaa can be any naturally occurring amino acid
  misc_feature (225)..(225): Xaa can be any naturally occurring amino acid
  misc_feature (240)..(240): Xaa can be any naturally occurring amino acid
MFAIFKRIFLQRSSFFLLIYITGICLSLAKDFKTIIEIPNQGKLRGVELSKLRIQKIIAYYGIPYAQAPVNNLRFAPPVTDPLPAWDGVKNDTEYAPSCLQTEEDYKESEKPFLQLISKLNFTLAEDCLYLNVFIPYGDEPKQGFATVIWFHPGNFTTGTPAMWNPHTLVYRQRVIIVTVSFRLNIMGFFTTMDGEASGNFXLLDQQAAMMXVKKXIKLFGGNPXNICIMGLRTGAMSVXLHLINPQSEGYLIKALP

SEQ ID NO: 37471 - protein, 79 aa, Diabrotica virgifera
  misc_feature: Coding regions on vcDNA: vcDNA=SeqID_17168; Strand=-; Position=3-239
  misc_feature (3)..(12): Xaa can be any naturally occurring amino acid
  misc_feature (20)..(20): Xaa can be any naturally occurring amino acid
  misc_feature (22)..(22): Xaa can be any naturally occurring amino acid
  misc_feature (34)..(34): Xaa can be any naturally occurring amino acid
  misc_feature (41)..(42): Xaa can be any naturally occurring amino acid
  misc_feature (46)..(59): Xaa can be any naturally occurring amino acid
  misc_feature (66)..(78): Xaa can be any naturally occurring amino acid
ILXXXXXXXXXXGPFVLKYXNXLKIETNLGSHRXKLRSCKXXKVEXXXXXXXXXXXXXXSNIEVAXXXXXXXXXXXXXC

SEQ ID NO: 37472 - protein, 105 aa, Diabrotica virgifera
  misc_feature: Coding regions on vcDNA: vcDNA=SeqID_17169; Strand=-; Position=371-688
  misc_feature (7)..(7): Xaa can be any naturally occurring amino acid
  misc_feature (14)..(14): Xaa can be any naturally occurring amino acid
  misc_feature (52)..(58): Xaa can be any naturally occurring amino acid
NCVEAVXRKISHNXRNISLNRTIQLLSFSDDVDFVCTKTLEQNLILRKERDXXXXXXXERLIKTIKKTQRNVKRFAILQIGIVGLSNAGTKINFVVEVVPLLDLL

SEQ ID NO: 37473 - protein, 264 aa, Diabrotica virgifera
  misc_feature: Coding regions on vcDNA: vcDNA=SeqID_17170; Strand=-; Position=2-793
  misc_feature (12)..(12): Xaa can be any naturally occurring amino acid
  misc_feature (15)..(30): Xaa can be any naturally occurring amino acid
  misc_feature (35)..(35): Xaa can be any naturally occurring amino acid
  misc_feature (39)..(200): Xaa can be any naturally occurring amino acid
  misc_feature (203)..(239): Xaa can be any naturally occurring amino acid
  misc_feature (243)..(262): Xaa can be any naturally occurring amino acid
FINSIGSLVFKXIKXXXXXXXXXXXXXXXXFHPPXPSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXPRYXXXXXXXXXXXXXXXXXXXXVK

SEQ ID NO: 37474 - protein, 88 aa, Diabrotica virgifera
  misc_feature: Coding regions on vcDNA: vcDNA=SeqID_17171; Strand=-; Position=320-586
  misc_feature (11)..(67): Xaa can be any naturally occurring amino acid
EICKAVKAKGXXXXXXXXXXXXXXXXXXXXXXXXXXXXXXXXXXXXXXXXXXXXXXXXXXXXXXXXXFISLKSYNRSITSYVRTKYTC

SEQ ID NO: 37475 - protein, 267 aa, Diabrotica virgifera
  misc_feature: Coding regions on vcDNA: vcDNA=SeqID_17172; Strand=+; Position=2-806
  misc_feature: Homolog annotation: Hit_ID=XP_391976.1; Match level="QueryCoverage =82%, HitCoverage=13%, E-value=5e-39, Identity=40%"; Hit description =similar to ENSANGP00000022171 [Apis mellifera]
  misc_feature: Gene Ontology Annotation: Cellular component=focal adhesion; Biological process=cell-substrate junction assembly
  misc_feature (158)..(158): Xaa can be any naturally occurring amino acid
  misc_feature (246)..(246): Xaa can be any naturally occurring amino acid
  misc_feature (254)..(254): Xaa can be any naturally occurring amino acid
LVDRGERSEDRSDGRPPVDGARLEALNDLIANLSSGSDKSNESPNNVAPAWQYQREESIQSWRSQTGTELDSSPSHNSSPRPQTPAFPVHARTPYINASTPTVQFDIPSERLPPKSPTTQRKDRPTSPSDLTNGSSEYTHTITNRSISATPTSGFRDXPISISIVQKVQATMGSSSPTVYYGTSRRSSINSNNESPHEVSAANVKFVRDTSKFWYKPSITREQAIIMLREQQPGTFVVRDSNSFPXAFGLAYEXAQCHRTCKTEWLQ

SEQ ID NO: 37476 - protein, 242 aa, Diabrotica virgifera
  misc_feature: Coding regions on vcDNA: vcDNA=SeqID_17173; Strand=-; Position=1-726
  misc_feature (9)..(103): Xaa can be any naturally occurring amino acid
  misc_feature (108)..(185): Xaa can be any naturally occurring amino acid
  misc_feature (189)..(225): Xaa can be any naturally occurring amino acid
  misc_feature (228)..(242): Xaa can be any naturally occurring amino acid
NKILSELNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKIYXXXXXXXXXXXXXXXXXXXXXXXXXXXXXXXXXXXXXXXXXXXXXXXXXXXXXXXXXXXXXXXXXXXXXXXXXXXXXXRFDXXXXXXXXXXXXXXXXXXXXXXXXXXXXXXXXXXXXXEVXXXXXXXXXXXXXXX

SEQ ID NO: 37477 - protein, 299 aa, Diabrotica virgifera
  misc_feature: Coding regions on vcDNA: vcDNA=SeqID_17174; Strand=+; Position=1-896
  misc_feature: Homolog annotation: Hit_ID=XP_393330.1; Match level="QueryCoverage =98%, HitCoverage=26%, E-value=1e-153, Identity=87%"; Hit description= similar to ENSANGP00000004153 [Apis mellifera]
  misc_feature: Gene Ontology Annotation: Molecular function=RNA binding; Cellular component=cytoplasm; Biological process=mRNA catabolism, nonsense -mediated
  misc_feature (62)..(69): Xaa can be any naturally occurring amino acid
  misc_feature (249)..(249): Xaa can be any naturally occurring amino acid
  misc_feature (271)..(271): Xaa can be any naturally occurring amino acid
  misc_feature (274)..(274): Xaa can be any naturally occurring amino acid
  misc_feature (291)..(291): Xaa can be any naturally occurring amino acid
GETILECYSCGVRNVFVLGFIPAKADSVVVLLCRQPCAAQNSLKDMNWDQEQWKPLIADRCXXXXXXXXPSEQEQLRARQISAQQINKLEELWKENVDATFQDLEKPGVDEEPQQVLLRYEDGYQYQNIFGPLVKLEADYDKRLKESQTQENIEVRWDVGLNKKTIAYFTLAKTDGDMKLMHGDELRLRYVGEMHKTWAGVGHVIKVPDNYGEDIGIELKNGSGAPVDCGSNFVVDFIWKSTSFDRMQXGLRKFAVDDASVSAYIYHPTVXHEXEEVLFRCHLPKHFSAPXLPDLNPIS

SEQ ID NO: 37478 - protein, 126 aa, Diabrotica virgifera
  misc_feature: Coding regions on vcDNA: vcDNA=SeqID_17175; Strand=+; Position=2-382
  misc_feature: Homolog annotation: Hit_ID=EAA05258.2; Match level="QueryCoverage =86%, HitCoverage=50%, E-value=1e-33, Identity=57%"; Hit description =ENSANGP00000018466 [Anopheles gambiae str. PEST] ref|XP_564172.1| ENSANGP00000018466 [Anopheles gambiae st
  misc_feature: Gene Ontology Annotation: Cellular component=integral to plasma membrane
KHFVLGDLGFSAFWAFLYFVGFWYLASQWGKSEPPPNGVGVNNVQAAIAFSFFSIFAWAGSAFFAYQRFRQGAGAAFATNYENEAGMPASYPSYPGGPETDTPYQEPPFSAGPNQRGQTDFQAPTY

SEQ ID NO: 37479 - protein, 71 aa, Diabrotica virgifera
  misc_feature: Coding regions on vcDNA: vcDNA=SeqID_17176; Strand=+; Position=129-344
  misc_feature (28)..(33): Xaa can be any naturally occurring amino acid
RILMPYISYDLFRWEIPVKILKLLTDFXXXXXXRVVKYANFGTRFKRFIIYRYDQNFVFIFTYPTPCIDLL

SEQ ID NO: 37480 - protein, 108 aa, Diabrotica virgifera; identical to SEQ ID NO: 27732
  misc_feature: Coding regions on vcDNA: vcDNA=SeqID_17177; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37481 - protein, 193 aa, Diabrotica virgifera
  misc_feature: Coding regions on vcDNA: vcDNA=SeqID_17178; Strand=+; Position=119-697
  misc_feature (1)..(73): Xaa can be any naturally occurring amino acid
  misc_feature (76)..(128): Xaa can be any naturally occurring amino acid
  misc_feature (136)..(155): Xaa can be any naturally occurring amino acid
  misc_feature (158)..(164): Xaa can be any naturally occurring amino acid
  misc_feature (178)..(190): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXEEXXXXXXXXXXXXXXXXXXXXXXXXXXXXXXXXXXXXXXXXXXXXXXXXXXXXXILVLSNCXXXXXXXXXXXXXXXXXXXXYDXXXXXXXIYRLACPLINLNDXXXXXXXXXXXXXIFY

SEQ ID NO: 37482 - protein, 199 aa, Diabrotica virgifera
  misc_feature: Coding regions on vcDNA: vcDNA=SeqID_17179; Strand=+; Position=3-602
  misc_feature (176)..(176): Xaa can be any naturally occurring amino acid
  misc_feature (181)..(181): Xaa can be any naturally occurring amino acid
ETFEDDEESEEKPKKDWVKFEDEPKNSKNLKLELSFAETAKREPTSSLTGLPKPLFSDLPVNNNNTYSYDIMENDLRSAEPVVFMPTTIEKPRRLADKLEVLKQLTFYKSLLTVLTTKFSMFIFYTLFPLYVYQEVERLTLREMSVMVGLLSISGLLFTGVSHWINIDKKRRPICXLGVMXGLEPLDISCLQIRIPSKS

SEQ ID NO: 37483 - protein, 78 aa, Diabrotica virgifera
  misc_feature: Coding regions on vcDNA: vcDNA=SeqID_17180; Strand=-; Position=2-235
  misc_feature (2)..(11): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
IXXXXXXXXXXVFWXXXXXXXXXXXPNWPHTVLNXXXXXXXXSNXXXXXXXXXXXXXXPTSRSXXXXXXXXXXXXXXV

SEQ ID NO: 37484 - protein, 242 aa, Diabrotica virgifera
  misc_feature: Coding regions on vcDNA: vcDNA=SeqID_17181; Strand=-; Position=1-726
  misc_feature (1)..(18): Xaa can be any naturally occurring amino acid
  misc_feature (20)..(20): Xaa can be any naturally occurring amino acid
  misc_feature (24)..(242): Xaa can be any naturally occurring amino acid
XXXXXXXXXXXXXXXXXXTXPFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37485 - protein, 230 aa, Diabrotica virgifera
  misc_feature: Coding regions on vcDNA: vcDNA=SeqID_17182; Strand=-; Position=0-689
  misc_feature (1)..(2): Xaa can be any naturally occurring amino acid
  misc_feature (6)..(6): Xaa can be any naturally occurring amino acid
  misc_feature (10)..(228): Xaa can be any naturally occurring amino acid
XXLKIXILIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 37486 - protein, 18 aa, Diabrotica virgifera
  misc_feature: Coding regions on vcDNA: vcDNA=SeqID_17183; Strand=+; Position=2-55
  misc_feature (2)..(2): Xaa can be any naturally occurring amino acid
  misc_feature (5)..(5): Xaa can be any naturally occurring amino acid
  misc_feature (10)..(10): Xaa can be any naturally occurring amino acid
EXYFXSKSLXFFKDERPY

SEQ ID NO: 37487 - protein, 69 aa, Diabrotica virgifera
  misc_feature: Coding regions on vcDNA: vcDNA=SeqID_17184; Strand=-; Position=89-298
  misc_feature (1)..(8): Xaa can be any naturally occurring amino acid
  misc_feature (37)..(43): Xaa can be any naturally occurring amino acid
XXXXXXXXDLQFFVSIYFAASSKFANFVINIFNIQVXXXXXXXSLVQKYECDEHFDIFIDSKKSSNPYV

SEQ ID NO: 37488 - protein, 257 aa, Diabrotica virgifera
  misc_feature: Coding regions on vcDNA: vcDNA=SeqID_17185; Strand=-; Position=1-771
  misc_feature (3)..(4): Xaa can be any naturally occurring amino acid
  misc_feature (15)..(15): Xaa can be any naturally occurring amino acid
  misc_feature (18)..(171): Xaa can be any naturally occurring amino acid
  misc_feature (174)..(198): Xaa can be any naturally occurring amino acid
  misc_feature (203)..(212): Xaa can be any naturally occurring amino acid
  misc_feature (214)..(222): Xaa can be any naturally occurring amino acid
  misc_feature (238)..(257): Xaa can be any naturally occurring amino acid
FFXXPPPSSFPIKKXNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXKKYMXXXXXXXXXXGXXXXXXXXXKKIFSHEYLINYPIKXXXXXXXXXXXXXXXXXXXX

SEQ ID NO: 37489 - protein, 294 aa, Diabrotica virgifera
  misc_feature: Coding regions on vcDNA: vcDNA=SeqID_17186; Strand=+; Position=2-882
  misc_feature: Homolog annotation: Hit_ID=XP_392864.1; Match level="QueryCoverage =100%, HitCoverage=32%, E-value=1e-109, Identity=63%"; Hit description=similar to lethal giant larvae homolog 1; Lethal giant larvae (Drosophila) homolog 1 [Apis
  misc_feature: Gene Ontology Annotation: Molecular function=myosin II binding; Cellular component=septate junction; Biological process=synaptic vesicle priming
  misc_feature (236)..(236): Xaa can be any naturally occurring amino acid
  misc_feature (263)..(263): Xaa can be any naturally occurring amino acid
  misc_feature (268)..(268): Xaa can be any naturally occurring amino acid
LVSVGTAHGLALLDYIKNKPILVKCTLNPNDLTGAGDTPISRRKSFKKSLRESFRRLRKGRSQRRNTNKDDKKSATSPPTKRTLPAATDENVNPLEAKPVERQIEARPADDSMGSFVRCLYFARTFLVSVQNTNPTLWAATNNGTVYAFTITVPSSSKRDTDDVSCMLAKEIQLKHRAPVIGIAVLDGSSKPLPEPLEVEKGVAPLPDTTQAHRVVIASEEQFKIFTLPSLKPFCXYKLTAHEGARVRRMAFANFSCQVDEVXHSEVXLLCLNNMGDCLVLSIPDLKRQLNAAA

SEQ ID NO: 37490 - protein, 276 aa, Diabrotica virgifera
  misc_feature: Coding regions on vcDNA: vcDNA=SeqID_17187; Strand=-; Position=3-830
  misc_feature (8)..(9): Xaa can be any naturally occurring amino acid
  misc_feature (19)..(47): Xaa can be any naturally occurring amino acid
  misc_feature (49)..(273): Xaa can be any naturally occurring amino acid
IFIIDLTXXNKITLYPKRXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFH

SEQ ID NO: 37491 - protein, 228 aa, Diabrotica virgifera
  misc_feature: Coding regions on vcDNA: vcDNA=SeqID_17188; Strand=+; Position=121-804
  misc_feature: Homolog annotation: Hit_ID=EAL32392.1; Match level="QueryCoverage =97%, HitCoverage=38%, E-value=3e-44, Identity=43%"; Hit description =GA14924-PA [Drosophila pseudoobscura]
  misc_feature: Gene Ontology Annotation: Molecular function=transporter activity; Cellular component=actin cytoskeleton; Biological process =intracellular protein transport
  misc_feature: Pfam annotation: Pfam_ID=BTB; Match level="Score=90.7, E-value=3.8e -24, Copies=1"; Pfam description=BTB/POZ domain
MDYQGDRDDSPEPSPSKSRRKGSYEFGTGDSSESCQKMVDNSENVLKVLKRLYFEKEMCDVYFVVGHKEYGAHRIILCASSDVFHVMLMRPEWSECHESRIELQEMSVCEPVFPMFLEYFYTGKIMITHTNVMPILALADKYMVKSLSRICISYMCKHVPHAVYHNQLFSWWQYATACAHNVVFETCQNYIKRNFEIVANTPDFCNFDINMFSHILEQNDIVAHNEIV

SEQ ID NO: 37492 - protein, 81 aa, Diabrotica virgifera
  misc_feature: Coding regions on vcDNA: vcDNA=SeqID_17189; Strand=+; Position=411-656
CAFIKSYYWGTVSRRPYYSICYHLAYVDILFLLFLTHLSLFSTLHLSRISVLLALSHSVLPSICRRVLISDVSSYLFATSV

SEQ ID NO: 37493 - protein, 256 aa, Diabrotica virgifera
  misc_feature: Coding regions on vcDNA: vcDNA=SeqID_17190; Strand=-; Position=1-768
  misc_feature (1)..(25): Xaa can be any naturally occurring amino acid
  misc_feature (29)..(49): Xaa can be any naturally occurring amino acid
  misc_feature (51)..(254): Xaa can be any naturally occurring amino acid
XXXXXXXXXXXXXXXXXXXXXXXXXRLLXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEV

SEQ ID NO: 37494 - protein, 111 aa, Diabrotica virgifera
  misc_feature: Coding regions on vcDNA: vcDNA=SeqID_17191; Strand=+; Position=327-663
  misc_feature: Homolog annotation: Hit_ID=AAQ77188.1; Match level="QueryCoverage =69%, HitCoverage=10%, E-value=3e-12, Identity=50%"; Hit description =elongation factor 2 [Siphonocybe sp. 'Siph']
  misc_feature: Gene Ontology Annotation: Molecular function=translation elongation factor activity
  misc_feature (103)..(103): Xaa can be any naturally occurring amino acid
LHHPILSILNICRYKLKYPNLFSLNLLILIRATSSHRGTGDDLVLYVSISIFYTLSKSTLPQSIADRIEPNIYKYKMYHVLLEIQLKSEDLYQTFQRIVENVXVMIATYHA

SEQ ID NO: 37495 - protein, 69 aa, Diabrotica virgifera
  misc_feature: Coding regions on vcDNA: vcDNA=SeqID_17192; Strand=+; Position=273-482
ENLTKRTEVYYCLICDKTGSIIIILPIMCYYIFLYQNIFLIRANTRLVCNKSMYFFFSHELFYILVTKK

SEQ ID NO: 37496 - protein, 59 aa, Diabrotica virgifera
  misc_feature: Coding regions on vcDNA: vcDNA=SeqID_17193; Strand=-; Position=652-831
  misc_feature (18)..(18): Xaa can be any naturally occurring amino acid
  misc_feature (23)..(23): Xaa can be any naturally occurring amino acid
  misc_feature (40)..(40): Xaa can be any naturally occurring amino acid
SYLYYRVFNVNPHLELTXLNPIXNFFRKCFKKLDLTIGLXKLCRKYKTLLVTIPTKIYI

SEQ ID NO: 37497 - protein, 74 aa, Diabrotica virgifera
  misc_feature: Coding regions on vcDNA: vcDNA=SeqID_17194; Strand=+; Position=198-422
  misc_feature (44)..(44): Xaa can be any naturally occurring amino acid
  misc_feature (46)..(52): Xaa can be any naturally occurring amino acid
  misc_feature (70)..(70): Xaa can be any naturally occurring amino acid
CFKIFKALQLKVNCQIVKRQNIYISFININIISTTCPIGKRWFXRXXXXXXXLYYCIFNTFVEKTVYVMXIYFC

SEQ ID NO: 37498 - protein, 78 aa, Diabrotica virgifera
  misc_feature: Coding regions on vcDNA: vcDNA=SeqID_17195; Strand=+; Position=317-553
MTICILLILTIIRYVLLNTLVLTIEFEILLMMIDFHILKDHIINTHLLSLLCLMTDLLIYDIYIISNLLTMHISPLCN

SEQ ID NO: 37499 - protein, 215 aa, Diabrotica virgifera
  misc_feature: Coding regions on vcDNA: vcDNA=SeqID_17196; Strand=+; Position=140-787
  misc_feature: Homolog annotation: Hit_ID=BAB01062.1; Match level="QueryCoverage =38%, HitCoverage=23%, E-value=1e-09, Identity=37%"; Hit description =DNA-binding protein GT-1 [Arabidopsis thaliana] dbj|BAB91255.1| transcription factor GT-4 [Arabidopsis tha
MGIQENQHRYILYPEEIEDDEAVPIQVDHPTDLGENQRTWSQNETLALINIFSLHKDKFKHFKMKKDRWKLISKELAKIGIDKLPIKCEIKWRNLLRSYRSYKATDRAQGKFEFYNEIDDIVSNDPQFRNMFDNFQTPEKGLSKQLESRHALQHDINASELSSKKRKCATCKSEKQKRHEDRMALLKKLGIEERKVTAFEDYVRFLNNVVAISNV

SEQ ID NO: 37500 - protein, 222 aa, Diabrotica virgifera
  misc_feature: Coding regions on vcDNA: vcDNA=SeqID_17197; Strand=-; Position=1-666
  misc_feature (6)..(15): Xaa can be any naturally occurring amino acid
  misc_feature (18)..(222): Xaa can be any naturally occurring amino acid
NKILMXXXXXXXXXXPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37501 - protein, 38 aa, Diabrotica virgifera
  misc_feature: Coding regions on vcDNA: vcDNA=SeqID_17198; Strand=-; Position=3-116
  misc_feature (9)..(9): Xaa can be any naturally occurring amino acid
  misc_feature (11)..(17): Xaa can be any naturally occurring amino acid
  misc_feature (21)..(38): Xaa can be any naturally occurring amino acid
KNLLIIYNXYXXXXXXXELSXXXXXXXXXXXXXXXXXX

SEQ ID NO: 37502 - protein, 85 aa, Diabrotica virgifera
  misc_feature: Coding regions on vcDNA: vcDNA=SeqID_17199; Strand=-; Position=3-257
  misc_feature (9)..(19): Xaa can be any naturally occurring amino acid
  misc_feature (23)..(23): Xaa can be any naturally occurring amino acid
  misc_feature (25)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (37)..(37): Xaa can be any naturally occurring amino acid
  misc_feature (39)..(40): Xaa can be any naturally occurring amino acid
  misc_feature (46)..(47): Xaa can be any naturally occurring amino acid
  misc_feature (52)..(59): Xaa can be any naturally occurring amino acid
  misc_feature (64)..(64): Xaa can be any naturally occurring amino acid
  misc_feature (73)..(73): Xaa can be any naturally occurring amino acid
  misc_feature (76)..(84): Xaa can be any naturally occurring amino acid
PVNGGNIIXXXXXXXXXXXFVLXYXXXXKIEXNLXSXRXXLRSCKXXKVDRXXXXXXXXPIINXNPPSRSPIXIIXXXXXXXXXC

SEQ ID NO: 37503 - protein, 75 aa, Diabrotica virgifera
  misc_feature: Coding regions on vcDNA: vcDNA=SeqID_17200; Strand=-; Position=177-404
MISSSCSVLDYRAIGYQIGYSNFVHGSSEKGCRGSVKPFSQVFKPMTFFFDLPLFFRLPCLVLLNDVYYISLGAT

SEQ ID NO: 37504 - protein, 25 aa, Diabrotica virgifera
  misc_feature: Coding regions on vcDNA: vcDNA=SeqID_17201; Strand=-; Position=1-75
  misc_feature (1)..(25): Xaa can be any naturally occurring amino acid
XXXXXXXXXXXXXXXXXXXXXXXXX

SEQ ID NO: 37505 - protein, 66 aa, Diabrotica virgifera; identical to SEQ ID NO: 26808
  misc_feature: Coding regions on vcDNA: vcDNA=SeqID_17202; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37506 - protein, 234 aa, Diabrotica virgifera
  misc_feature: Coding regions on vcDNA: vcDNA=SeqID_17203; Strand=+; Position=3-707
  misc_feature: Homolog annotation: Hit_ID=XP_311833.1; Match level="QueryCoverage =91%, HitCoverage=62%, E-value=7e-49, Identity=41%"; Hit description =ENSANGP00000023630 [Anopheles gambiae] gb|EAA44830.1| ENSANGP00000023630 [Anopheles gambiae
GQLVKYSYKITIGTQRVNSPVKLLRVPIRVLPLCETLLNEAVALCNDTTEELTPANPFLEIRKKESPLEIALQSLQNITARRNPNSYMITNTWGRGARFCLFKPNYKLGEDIIGTFDFTVATVSCIQVSVSLQCEEKTIIEGAAEDNSKQTRIITFGNFHEVCLGYDPLYVKLVSLTWRLHFEFVTSTNKGLSPPSLEDTDWRAPSEVTVETMGLEFAHKTILNYTYTWVLGVF

SEQ ID NO: 37507 - protein, 66 aa, Diabrotica virgifera; identical to SEQ ID NO: 26808
  misc_feature: Coding regions on vcDNA: vcDNA=SeqID_17204; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37508 - protein, 184 aa, Diabrotica virgifera
  misc_feature: Coding regions on vcDNA: vcDNA=SeqID_17205; Strand=+; Position=1-555
  misc_feature (7)..(20): Xaa can be any naturally occurring amino acid
  misc_feature (26)..(61): Xaa can be any naturally occurring amino acid
  misc_feature (65)..(154): Xaa can be any naturally occurring amino acid
  misc_feature (160)..(182): Xaa can be any naturally occurring amino acid
DSKLEWXXXXXXXXXXXXXXEPGESXXXXXXXXXXXXXXXXXXXXXXXXXXXXXXXXXXXXKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDNIXXXXXXXXXXXXXXXXXXXXXXXTC

SEQ ID NO: 37509 - protein, 38 aa, Diabrotica virgifera; identical to SEQ ID NO: 35237
  misc_feature: Coding regions on vcDNA: vcDNA=SeqID_17206; Strand=-; Position=1-114
  misc_feature (1)..(38): Xaa can be any naturally occurring amino acid

SEQ ID NO: 37510 - protein, 51 aa, Diabrotica virgifera
  misc_feature: Coding regions on vcDNA: vcDNA=SeqID_17207; Strand=+; Position=1-156
HVLDDMANAMNKLVILDEQWPNILHNFVQNTLLDYSQLDLYMKQKMQELSK

SEQ ID NO: 37511 - protein, 241 aa, Diabrotica virgifera
  misc_feature: Coding regions on vcDNA: vcDNA=SeqID_17208; Strand=+; Position=76-802
  misc_feature: Homolog annotation: Hit_ID=NP_610592.1; Match level="QueryCoverage =80%, HitCoverage=98%, E-value=1e-64, Identity=60%"; Hit description =CG17765-PA [Drosophila melanogaster] gb|AAF58783.1| CG17765-PA [Drosophila melanogaster]
  misc_feature: Gene Ontology Annotation: Molecular function=receptor binding; Cellular component=cytoplasm; Biological process=regulation of action potential
  misc_feature: Pfam annotation: Pfam_ID=efhand; Match level="Score=77.9, E-value =2.7e-20, Copies=3"; Pfam description=EF hand
  misc_feature (227)..(227): Xaa can be any naturally occurring amino acid
MYPNPAYGAYNPGGYGGQPQGGNYGQPQGRSYDQHQGGGFAQQQGFGQPQGGFGQPQGGGFAAPGGYGQPNQINPDVQSWFQAVDKDRSGQISWEELQAALINGQGENFSPTACKLMISMFDIDHSGTIGVNEFQLLYNYINQWLAVFKNYDRDGSGSIDETELTQAFQQMGFRFSPEFVKFLLVKSDLKTHSRMSVDQFIVVCIQIQQFTEAFKKKDRELKGVITXGFEEFLGIALSCSV

SEQ ID NO: 37512 - protein, 79 aa, Diabrotica virgifera
  misc_feature: Coding regions on vcDNA: vcDNA=SeqID_17209; Strand=-; Position=3-239
  misc_feature (3)..(13): Xaa can be any naturally occurring amino acid
  misc_feature (16)..(26): Xaa can be any naturally occurring amino acid
  misc_feature (41)..(41): Xaa can be any naturally occurring amino acid
  misc_feature (46)..(59): Xaa can be any naturally occurring amino acid
  misc_feature (66)..(78): Xaa can be any naturally occurring amino acid
LLXXXXXXXXXXXPFXXXXXXXXXXXTNLGSHRFKLRSCKXLKVEXXXXXXXXXXXXXXSNIEVAXXXXXXXXXXXXXC

SEQ ID NO: 37513 - protein, 259 aa, Diabrotica virgifera
  misc_feature: Coding regions on vcDNA: vcDNA=SeqID_17210; Strand=+; Position=1-780
  misc_feature: Homolog annotation: Hit_ID=XP_396494.1; Match level="QueryCoverage =98%, HitCoverage=51%, E-value=1e-30, Identity=32%"; Hit description =similar to CG5498-PB [Apis mellifera]
  misc_feature: Pfam annotation: Pfam_ID=DUF852; Match level="Score=-89.7, E-value =0.1, Copies=1"; Pfam description=Eukaryotic protein of unknown functio
  misc_feature (244)..(244): Xaa can be any naturally occurring amino acid
KNITKMFNISEENLPECLQDENRLNVLFAPIRNRSVNPKDWDNKISSWKTIIKAYCDSTDVYTFTLSSLNAVFVRNGRPPSCLPEVLSEMERIGDIQPLEVFLKKNDHSWTGWATDLLVKRPFIWSFNKVKSSMFTQDKSQQSMVILEVIKSKCDQLLKSVPDNFKNKLVSLKDILEILNKSPKYLDDVKLILHYMSNNNLVDITHLTSKNENELETTLIKFTDGSKNNRISELDIGIYTLEQXEKIVLKGIEEMEDTH

SEQ ID NO: 37514 - protein, 154 aa, Diabrotica virgifera
  misc_feature: Coding regions on vcDNA: vcDNA=SeqID_17211; Strand=-; Position=1-462
  misc_feature (13)..(24): Xaa can be any naturally occurring amino acid
  misc_feature (89)..(105): Xaa can be any naturally occurring amino acid
  misc_feature (107)..(113): Xaa can be any naturally occurring amino acid
  misc_feature (117)..(131): Xaa can be any naturally occurring amino acid
  misc_feature (133)..(149): Xaa can be any naturally occurring amino acid
SHNHKYRIINLLXXXXXXXXXXXXHFLFHSILHILLTIIILNDYTTISRSLYRVHSYYSVGRRVFIFITKSHVFNKPVKKTFPHSFLHXXXXXXXXXXXXXXXXXLXXXXXXXLYFXXXXXXXXXXXXXXXVXXXXXXXXXXXXXXXXXDPRKD

SEQ ID NO: 37515 - protein, 14 aa, Diabrotica virgifera
  misc_feature: Coding regions on vcDNA: vcDNA=SeqID_17212; Strand=+; Position=2-46
  misc_feature (6)..(14): Xaa can be any naturally occurring amino acid
MERVDXXXXXXXXX

SEQ ID NO: 37516 - protein, 17 aa, Diabrotica virgifera
  misc_feature: Coding regions on vcDNA: vcDNA=SeqID_17213; Strand=-; Position=1-51
  misc_feature (6)..(11): Xaa can be any naturally occurring amino acid
EFGTFXXXXXXPVFPLR

SEQ ID NO: 37517 - protein, 261 aa, Diabrotica virgifera
  misc_feature: Coding regions on vcDNA: vcDNA=SeqID_17214; Strand=+; Position=10-792
  misc_feature: Homolog annotation: Hit_ID=XP_546946.1; Match level="QueryCoverage =84%, HitCoverage=22%, E-value=2e-47, Identity=47%"; Hit description =PREDICTED: similar to acetylcholinesterase collagen-tailed or globular form precursor
  misc_feature: Gene Ontology Annotation: Molecular function=cholinesterase activity; Cellular component=synaptic junction
  misc_feature: Pfam annotation: Pfam_ID=COesterase; Match level="Score=-59.4, E -value=1.1e-08, Copies=1"; Pfam description=Carboxylesterase
  misc_feature (237)..(237): Xaa can be any naturally occurring amino acid
  misc_feature (243)..(243): Xaa can be any naturally occurring amino acid
MAHLNLFVFCALVNFANNGVTSAVTGLTDDDLIITLSTGSKVRGHVLQSFEGNNFHAFESIPYAEPPIGKNRFQPPVIKTPWEGILNATANEKMCPQLLSHNDPVVIGEEDCLILNVYTPLKSDLQTPLPVFFWIYGGGFDSGHSALYDPRLLIDFDIVIVTINYRVGSLGFLTTIDDNIPGNVGLKDQLLALQWVHDNIIAFGGDPKQVTVGGESAGSMSAGFHLLSKAAKGLYSXIIQQSXSPLGPFYPSNDREIAFEF

SEQ ID NO: 37518 - protein, 171 aa, Diabrotica virgifera
  misc_feature: Coding regions on vcDNA: vcDNA=SeqID_17215; Strand=+; Position=40-555
  misc_feature: Homolog annotation: Hit_ID=XP_321441.1; Match level="QueryCoverage =99%, HitCoverage=94%, E-value=1e-66, Identity=71%"; Hit description =ENSANGP00000022106 [Anopheles gambiae]
  misc_feature: Gene Ontology Annotation: Molecular function=transcription co -repressor activity; Cellular component=histone deacetylase complex
  misc_feature (75)..(82): Xaa can be any naturally occurring amino acid
MNGFSTGEEDSRGPTDQICCLIDNSERCIKPAGNASYSKKIEKTAIQRRLNFGIDSNARHNYICDHHKMIIQCAXXXXXXXXSEDDSNETDTDLPEVDLYQLQVNTLRRYKKHYKVPMRQGLNKAQLADTLMKHFKTIPVKEKEVVTFFIYTVKTNANKLDQKNGINNDTT

SEQ ID NO: 37519 - protein, 66 aa, Diabrotica virgifera
  misc_feature: Coding regions on vcDNA: vcDNA=SeqID_17216; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
SFXXXXXXXXXXXTNLAHTGLNXXXXXXXXSNXXXXXXXXXXXXXXPTSRSXXXXXXXXXXXXXXV

SEQ ID NO: 37520 - protein, 287 aa, Diabrotica virgifera
  misc_feature: Coding regions on vcDNA: vcDNA=SeqID_17217; Strand=-; Position=2-862
  misc_feature (4)..(24): Xaa can be any naturally occurring amino acid
  misc_feature (26)..(46): Xaa can be any naturally occurring amino acid
  misc_feature (53)..(287): Xaa can be any naturally occurring amino acid
KIVXXXXXXXXXXXXXXXXXXXXXPXXXXXXXXXXXXXXXXXXXXXSIGFFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37521 - protein, 75 aa, Diabrotica virgifera
  misc_feature: Coding regions on vcDNA: vcDNA=SeqID_17218; Strand=+; Position=403-630
  misc_feature: Homolog annotation: Hit_ID=CAE47497.1; Match level="QueryCoverage =96%, HitCoverage=23%, E-value=1e-10, Identity=50%"; Hit description =cathepsin L-like proteinase [Diabrotica virgifera virgifera]
CEHQDHCHSCCLYGSTDSLELPLLILKNQCVPLRVQELVHCDTKNGVRDAGILTYDFKYYQMHERSSKSQHAYTG

SEQ ID NO: 37522 - protein, 66 aa, Diabrotica virgifera; identical to SEQ ID NO: 28562
  misc_feature: Coding regions on vcDNA: vcDNA=SeqID_17219; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37523 - protein, 288 aa, Diabrotica virgifera
  misc_feature: Coding regions on vcDNA: vcDNA=SeqID_17220; Strand=-; Position=1-864
  misc_feature (7)..(13): Xaa can be any naturally occurring amino acid
  misc_feature (19)..(19): Xaa can be any naturally occurring amino acid
  misc_feature (23)..(23): Xaa can be any naturally occurring amino acid
  misc_feature (26)..(34): Xaa can be any naturally occurring amino acid
  misc_feature (37)..(49): Xaa can be any naturally occurring amino acid
  misc_feature (56)..(68): Xaa can be any naturally occurring amino acid
  misc_feature (71)..(286): Xaa can be any naturally occurring amino acid
LYIGPFXXXXXXXLKIETXLAHXGLXXXXXXXXXRTXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDE

SEQ ID NO: 37524 - protein, 265 aa, Diabrotica virgifera
  misc_feature: Coding regions on vcDNA: vcDNA=SeqID_17221; Strand=-; Position=1-795
  misc_feature (1)..(15): Xaa can be any naturally occurring amino acid
  misc_feature (18)..(265): Xaa can be any naturally occurring amino acid
XXXXXXXXXXXXXXXLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37525 - protein, 95 aa, Diabrotica virgifera
  misc_feature: Coding regions on vcDNA: vcDNA=SeqID_17222; Strand=+; Position=220-507
  misc_feature (72)..(94): Xaa can be any naturally occurring amino acid
NLQIINVERFGQSLPVLITEALTFAHRNTIVSRSDIRTGLCTGRSGKKAIDMAVSSEYFSSRNSTKKTRYCXXXXXXXXXXXXXXXXXXXXXXXF

SEQ ID NO: 37526 - protein, 145 aa, Diabrotica virgifera
  misc_feature: Coding regions on vcDNA: vcDNA=SeqID_17223; Strand=+; Position=2-443
  misc_feature: Homolog annotation: Hit_ID=AAB87785.2; Match level="QueryCoverage =95%, HitCoverage=76%, E-value=9e-25, Identity=44%"; Hit description =cytochrome oxidase subunit II [Gonioctena kamikawai]
  misc_feature: Pfam annotation: Pfam_ID=COX2_TM; Match level="Score=-14.7, E-value =0.0061, Copies=1"; Pfam description=Cytochrome C oxidase subunit II, tran
  misc_feature (17)..(17): Xaa can be any naturally occurring amino acid
  misc_feature (30)..(30): Xaa can be any naturally occurring amino acid
  misc_feature (58)..(58): Xaa can be any naturally occurring amino acid
  misc_feature (65)..(65): Xaa can be any naturally occurring amino acid
  misc_feature (97)..(97): Xaa can be any naturally occurring amino acid
  misc_feature (106)..(106): Xaa can be any naturally occurring amino acid
ILQDRPSPLIPSTSYLXEHALINLHIISVXSTSIILSYFLLITLHLNLREGHVIEIIXTILPTIXLKFYCYPILSNSHILDQSSYPFITMKNIEHRXTRAYVYSNXKNETVDSYIMPTIETKDIDFRLLDVYHLIVVPLVFSILK

SEQ ID NO: 37527 - protein, 303 aa, Diabrotica virgifera
  misc_feature: Coding regions on vcDNA: vcDNA=SeqID_17224; Strand=-; Position=1-909
  misc_feature (4)..(4): Xaa can be any naturally occurring amino acid
  misc_feature (24)..(299): Xaa can be any naturally occurring amino acid
  misc_feature (303)..(303): Xaa can be any naturally occurring amino acid
TLIXHRGRNLYYRFDSPIKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRVX

SEQ ID NO: 37528 - protein, 301 aa, Diabrotica virgifera
  misc_feature: Coding regions on vcDNA: vcDNA=SeqID_17225; Strand=+; Position=1-903
  misc_feature (7)..(13): Xaa can be any naturally occurring amino acid
  misc_feature (39)..(45): Xaa can be any naturally occurring amino acid
  misc_feature (51)..(62): Xaa can be any naturally occurring amino acid
  misc_feature (65)..(89): Xaa can be any naturally occurring amino acid
  misc_feature (93)..(231): Xaa can be any naturally occurring amino acid
  misc_feature (234)..(298): Xaa can be any naturally occurring amino acid
FISFILXXXXXXXSLSVNVKKNSLSLTIVNSYRERISFXXXXXXXISLRTXXXXXXXXXXXXIYXXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTXXXXXXXXXXXXXXXXXXXXXXXXXXXXXXXXXXXXXXXXXXXXXXXXXXXXXXXXXXXXXXXXXLLI

SEQ ID NO: 37529 - protein, 285 aa, Diabrotica virgifera
  misc_feature: Coding regions on vcDNA: vcDNA=SeqID_17226; Strand=-; Position=1-855
  misc_feature (1)..(285): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37530 - protein, 86 aa, Diabrotica virgifera
  misc_feature: Coding regions on vcDNA: vcDNA=SeqID_17227; Strand=-; Position=2-259
  misc_feature (2)..(20): Xaa can be any naturally occurring amino acid
  misc_feature (23)..(33): Xaa can be any naturally occurring amino acid
  misc_feature (43)..(50): Xaa can be any naturally occurring amino acid
  misc_feature (53)..(66): Xaa can be any naturally occurring amino acid
  misc_feature (72)..(85): Xaa can be any naturally occurring amino acid
RXXXXXXXXXXXXXXXXXXXPIXXXXXXXXXXXTNLAHTGLNXXXXXXXXSNXXXXXXXXXXXXXXPTSRSXXXXXXXXXXXXXXV

SEQ ID NO: 37531 - protein, 60 aa, Diabrotica virgifera
  misc_feature: Coding regions on vcDNA: vcDNA=SeqID_17228; Strand=-; Position=78-260
YMSFSSLGHPVIPTSHCKYIELMRSNMLLICKHNILLISTLQTEVFRVLAFIGVIKSITR

SEQ ID NO: 37532 - protein, 130 aa, Diabrotica virgifera
  misc_feature: Coding regions on vcDNA: vcDNA=SeqID_17229; Strand=-; Position=135-527
  misc_feature (116)..(122): Xaa can be any naturally occurring amino acid
SPELGRYSFATRCTTDTFLLLKEFLFSTKFFVCHCSPTLSIHFIHRYGLGAIIVTLSVNRCLSLLNIMSDLILTKKKLFVLFTCYHSHFNVIFNWRIIFFLDLLPLPSRINTSRCXXXXXXXTIYLDDFS

SEQ ID NO: 37533 - protein, 290 aa, Diabrotica virgifera
  misc_feature: Coding regions on vcDNA: vcDNA=SeqID_17230; Strand=-; Position=1-870
  misc_feature (1)..(5): Xaa can be any naturally occurring amino acid
  misc_feature (8)..(206): Xaa can be any naturally occurring amino acid
  misc_feature (210)..(247): Xaa can be any naturally occurring amino acid
  misc_feature (250)..(288): Xaa can be any naturally occurring amino acid
XXXXXINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISXXXXXXXXXXXXXXXXXXXXXXXXXXXXXXXXXXXXXXRYXXXXXXXXXXXXXXXXXXXXXXXXXXXXXXXXXXXXXXXIN

SEQ ID NO: 37534 - protein, 119 aa, Diabrotica virgifera
  misc_feature: Coding regions on vcDNA: vcDNA=SeqID_17231; Strand=-; Position=2-358
  misc_feature (71)..(76): Xaa can be any naturally occurring amino acid
HRNFKWCSLQCVCLFKSLTEEVEEWGAVCLELVIQNYIRTLQSINLHRFQKRQLKAFTPNMQNFKLFTEIXXXXXXAKCACRSVCPSTVESPPVLCHPFVKGSASPTDASLRTVRTRKG

SEQ ID NO: 37535 - protein, 189 aa, Diabrotica virgifera
  misc_feature: Coding regions on vcDNA: vcDNA=SeqID_17232; Strand=+; Position=91-660
  misc_feature (161)..(161): Xaa can be any naturally occurring amino acid
  misc_feature (170)..(170): Xaa can be any naturally occurring amino acid
  misc_feature (181)..(181): Xaa can be any naturally occurring amino acid
TKELKLYFKMNERPSNIPFSIIRELRCRNCQNIISCAPVHVLPDENVLCGRCKQYAKEIYRNYPFEALASMFFYPCRNWDGRCPRILRWNECMVHEDGCSYESGCSRFWKHPKAFLKGKRDMPYGDIRLVAIPEKLLDFIKCIQCESYLSCEPVYIRSDGXTSAIDVSTXNVSHQIASEIXDTRYCPAS

SEQ ID NO: 37536 - protein, 38 aa, Diabrotica virgifera
  misc_feature: Coding regions on vcDNA: vcDNA=SeqID_17233; Strand=+; Position=2-115
  misc_feature (31)..(31): Xaa can be any naturally occurring amino acid
  misc_feature (34)..(34): Xaa can be any naturally occurring amino acid
VLGCVFMCGAPLATMAANSSTFPEIFTLDMXQRXLSYH

SEQ ID NO: 37537 - protein, 26 aa, Diabrotica virgifera
  misc_feature: Coding regions on vcDNA: vcDNA=SeqID_17234; Strand=-; Position=1-78
  misc_feature (1)..(26): Xaa can be any naturally occurring amino acid
XXXXXXXXXXXXXXXXXXXXXXXXXX

SEQ ID NO: 37538 - protein, 37 aa, Diabrotica virgifera
  misc_feature: Coding regions on vcDNA: vcDNA=SeqID_17235; Strand=+; Position=187-300
MMILQLAHLGVFKTLSRISELYYWPKMRPFVVNYVHK

SEQ ID NO: 37539 - protein, 136 aa, Diabrotica virgifera
  misc_feature: Coding regions on vcDNA: vcDNA=SeqID_17236; Strand=-; Position=84-494
LRIIALSRHLFSRRARLLGTPHVLVYKSFYKHSYHMSFMCIITTLHTLSYVTLSSSNNLSKNFIFISSQSCKIVPFDLYHQYTQFNPFLTQSSTTTPGTSECALDPLSFPERSYVHETPLVTPNLLLSSFTVVRLW

SEQ ID NO: 37540 - protein, 147 aa, Diabrotica virgifera
  misc_feature: Coding regions on vcDNA: vcDNA=SeqID_17237; Strand=+; Position=339-782
  misc_feature (8)..(14): Xaa can be any naturally occurring amino acid
  misc_feature (62)..(70): Xaa can be any naturally occurring amino acid
  misc_feature (147)..(147): Xaa can be any naturally occurring amino acid
LSYRYSAXXXXXXXFTLGCRKRYFFQGSIVSLLFRKAMLILKLEDGIKLAIFIMVTTYRSIXXXXXXXXXTKNRITKNFKIDIIITFYVKVFLWISKWKMASFSEHLTSLCFHTFVLYIYFHHFCPLRGFVVSHNTNKQTSEPRPWX

SEQ ID NO: 37541 - protein, 76 aa, Diabrotica virgifera
  misc_feature: Coding regions on vcDNA: vcDNA=SeqID_17238; Strand=+; Position=88-318
  misc_feature (9)..(32): Xaa can be any naturally occurring amino acid
  misc_feature (46)..(53): Xaa can be any naturally occurring amino acid
IILPLLKDXXXXXXXXXXXXXXXXXXXXXXXXEMLLSIFIYYCNNXXXXXXXXVNFNYRSYRIDDIIYFNKLKIYE

SEQ ID NO: 37542 - protein, 260 aa, Diabrotica virgifera
  misc_feature: Coding regions on vcDNA: vcDNA=SeqID_17239; Strand=-; Position=3-784
  misc_feature: Homolog annotation: Hit_ID=AAC60281.1; Match level="QueryCoverage =93%, HitCoverage=24%, E-value=6e-37, Identity=38%"; Hit description =unknown [Gallus gallus]
  misc_feature (20)..(20): Xaa can be any naturally occurring amino acid
  misc_feature (54)..(54): Xaa can be any naturally occurring amino acid
KKRFLSVFHKDSVLGPLLFXLYASDLESHIKSRKAFYADDTKIFADPLLNGQDXQSDLDSIFKWCSDWMLPLNRDKCVVLHLGKNNPRLSYSIDGHLLDTVESYSDLGVTITENLSWSEHISNVTKKANSKLYLLSKTFTKISFSGSIRLYKTYVRPLLEYCGTVWCPELVRDRTLLENIQKKATRLCFKRRRPDYQQRLSLAGLSTFEARRLRGDLIITFRILKYGYGDLQHLFILDDHSRLRGHSLKVKKEPFSSIKR

SEQ ID NO: 37543 - protein, 102 aa, Diabrotica virgifera
  misc_feature: Coding regions on vcDNA: vcDNA=SeqID_17240; Strand=+; Position=276-581
VRLGLTLKLPGQCPLQLCLKALHRLLRIIIGDYMICGICLIVELFISMLSIYSERSNISLVILPYLGSVLSIELSQTVSPGVTTMILQKVLMIQIISCYLSL

SEQ ID NO: 37544 - protein, 39 aa, Diabrotica virgifera
  misc_feature: Coding regions on vcDNA: vcDNA=SeqID_17241; Strand=+; Position=92-211
ITDVISMRSSNTSSNKWPINSENYKDCIYIRSKYKKSRF

SEQ ID NO: 37545 - protein, 150 aa, Diabrotica virgifera
  misc_feature: Coding regions on vcDNA: vcDNA=SeqID_17242; Strand=+; Position=40-492
  misc_feature: Homolog annotation: Hit_ID=AAL17607.1; Match level="QueryCoverage =100%, HitCoverage=99%, E-value=4e-54, Identity=67%"; Hit description= cytochrome c oxidase subunit Va [Rhyzopertha dominica]
  misc_feature: Gene Ontology Annotation: Molecular function=cytochrome c oxidase activity; Cellular component=mitochondrion; Biological process =electron transport
  misc_feature: Pfam annotation: Pfam_ID=COX5A; Match level="Score=226.1, E-value =6.7e-65, Copies=1"; Pfam description=Cytochrome c oxidase subunit Va
MFRNTALRAHSILRTALVAPKPNVSTMRLMSSHSTETDEQFDSRYENFFNRKDIDGWEIRRGINDLWGHDLVPEPKILIAALKACRRVNDFALAVRILEATKDKCGSKVNEIYPYIIQELRPTLTELGLNTPEELGYDKPELHLQSVFHM

SEQ ID NO: 37546 - protein, 70 aa, Diabrotica virgifera
  misc_feature: Coding regions on vcDNA: vcDNA=SeqID_17243; Strand=+; Position=3-215
LSRAREREQSRTDPFCLQNNLLYFPISLVDLTGKSGNMFRTAHTTMIFYLKAVFANQNISNDNEALMPLQ

SEQ ID NO: 37547 - protein, 129 aa, Diabrotica virgifera
  misc_feature: Coding regions on vcDNA: vcDNA=SeqID_17244; Strand=-; Position=1-387
FTSKRIFLVRSLIVDAVHSLVQCLRTNQSMICRSFVYPLVCLSLECICMGNLATAAPGNVAEAALAVLAYCSSGMSSIGRLPSDVRVLLLFRCSSLGSRFCPLQSSLSFFIPFSHSVITDQDASLGRER

SEQ ID NO: 37548 - protein, 277 aa, Diabrotica virgifera
  misc_feature: Coding regions on vcDNA: vcDNA=SeqID_17245; Strand=+; Position=87-920
  misc_feature: Homolog annotation: Hit_ID=XP_541574.1; Match level="QueryCoverage =94%, HitCoverage=73%, E-value=2e-37, Identity=38%"; Hit description =PREDICTED: similar to ZNF228 protein [Canis familiaris]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=69.6, E-value =8.5e-18, Copies=4"; Pfam description=Zinc finger, C2H2 type
  misc_feature (141)..(146): Xaa can be any naturally occurring amino acid
  misc_feature (150)..(165): Xaa can be any naturally occurring amino acid
  misc_feature (197)..(202): Xaa can be any naturally occurring amino acid
  misc_feature (206)..(221): Xaa can be any naturally occurring amino acid
  misc_feature (276)..(276): Xaa can be any naturally occurring amino acid
MEMEETCKIEIEDNHLDELKCEIQEESNGQSTYHTYDSLDLKKCPITTETETEQHHGNKLKGMGYLQGESKMKVMEKMEDSSYEGDDMGRPMKGVTGKRLYKCEICYKRFSEANTLKKHSRVHTGQKPYKCEICFQMFSQXXXXXXHLKXXXXXXXXXXXXXXXXFSQAGNFKKHSRVHTGQKPYKCEICFQMFSQXXXXXXHLKXXXXXXXXXXXXXXXXFSQAGTLKKHSRVHTGEKPYKCNICFKQFSQVGNLTGHLRVHTEEKPIQCEILSXA

SEQ ID NO: 37549 - protein, 247 aa, Diabrotica virgifera
  misc_feature: Coding regions on vcDNA: vcDNA=SeqID_17246; Strand=+; Position=97-840
  misc_feature: Homolog annotation: Hit_ID=CAG02360.1; Match level="QueryCoverage =78%, HitCoverage=59%, E-value=2e-45, Identity=54%"; Hit description =unnamed protein product [Tetraodon nigroviridis]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=41.2, E-value =2.9e-09, Copies=1"; Pfam description=short chain dehydrogenase
MAFALTILISVLIILGIIKIYNILKAKSCSSKVFLVGKVAIVTGANTGIGYETALNFATRGAKVILACRDLEKAEEAKDRIICQTENKNVVVKSLNLTSLESVREFAKDINENEERLDILVNNAGSGGLNHKYTEDGLQLLMQINYFAPVLLTILLTGLLKKSAPSRVINVSSMMAKKTNLTPANINDPPPGPYISYGNSKLANILFTIKLAEILKNSNVTVYQTDIFRRITGISKLILMPVYRMFF

SEQ ID NO: 37550 - protein, 232 aa, Diabrotica virgifera
  misc_feature: Coding regions on vcDNA: vcDNA=SeqID_17247; Strand=-; Position=1-696
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(228): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGREV

SEQ ID NO: 37551 - protein, 318 aa, Diabrotica virgifera
  misc_feature: Coding regions on vcDNA: vcDNA=SeqID_17248; Strand=+; Position=3-956
  misc_feature (14)..(24): Xaa can be any naturally occurring amino acid
  misc_feature (26)..(59): Xaa can be any naturally occurring amino acid
  misc_feature (62)..(174): Xaa can be any naturally occurring amino acid
  misc_feature (179)..(205): Xaa can be any naturally occurring amino acid
  misc_feature (208)..(227): Xaa can be any naturally occurring amino acid
  misc_feature (229)..(241): Xaa can be any naturally occurring amino acid
  misc_feature (243)..(259): Xaa can be any naturally occurring amino acid
  misc_feature (263)..(274): Xaa can be any naturally occurring amino acid
  misc_feature (279)..(317): Xaa can be any naturally occurring amino acid
ADPGPESPAPPTRXXXXXXXXXXXDXXXXXXXXXXXXXXXXXXXXXXXXXXXXXXXXXXHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLLEXXXXXXXXXXXXXXXXXXXXXXXXXXXLIXXXXXXXXXXXXXXXXXXXXIXXXXXXXXXXXXXYXXXXXXXXXXXXXXXXXMKSXXXXXXXXXXXXRILSXXXXXXXXXXXXXXXXXXXXXXXXXXXXXXXXXXXXXXXG

SEQ ID NO: 37552 - protein, 76 aa, Diabrotica virgifera
  misc_feature: Coding regions on vcDNA: vcDNA=SeqID_17249; Strand=-; Position=675-905
  misc_feature (22)..(28): Xaa can be any naturally occurring amino acid
QGENIELHKNNILKCKFRLEEXXXXXXXNKSEFHTISINQGNDKEDMQKRRFCQITSNTIYILSAIKSFTNKLDLK

SEQ ID NO: 37553 - protein, 270 aa, Diabrotica virgifera
  misc_feature: Coding regions on vcDNA: vcDNA=SeqID_17250; Strand=+; Position=114-929
  misc_feature: Homolog annotation: Hit_ID=XP_311042.1; Match level="QueryCoverage =94%, HitCoverage=52%, E-value=4e-52, Identity=44%"; Hit description =ENSANGP00000019848 [Anopheles gambiae]
  misc_feature: Gene Ontology Annotation: Molecular function=ubiquinone biosynthesis monooxygenase activity; Cellular component=extracellular space; Biological process=electron transport
  misc_feature (42)..(57): Xaa can be any naturally occurring amino acid
  misc_feature (171)..(171): Xaa can be any naturally occurring amino acid
  misc_feature (177)..(177): Xaa can be any naturally occurring amino acid
  misc_feature (196)..(196): Xaa can be any naturally occurring amino acid
  misc_feature (248)..(248): Xaa can be any naturally occurring amino acid
  misc_feature (260)..(260): Xaa can be any naturally occurring amino acid
DISPQQNVQRNTIDIVIAGGGMIGTTLACALGKNSRFSGRKXXXXXXXXXXXXXXXXKYSNRVVSLTPGTKNLLNNIGTWKHIEEARFATVKRLQVMDALSDASITFGEIKSSDDVSYIVENNLILHSAKKEIKNTNVEILYESKVKNYELPGVDDSQVNIFLENGNQYTXDLLIGXDGVNSKVRQTMGSTLFKLXYNSTGVVATLKFCEEFDNSIAWQRWLPTGPLALLPLNSSQSSIVWSTTPEDXQRLLKLTNEQLXDAVNESFWEV

SEQ ID NO: 37554 - protein, 242 aa, Diabrotica virgifera
  misc_feature: Coding regions on vcDNA: vcDNA=SeqID_17251; Strand=+; Position=238-963
  misc_feature (23)..(79): Xaa can be any naturally occurring amino acid
  misc_feature (98)..(154): Xaa can be any naturally occurring amino acid
  misc_feature (157)..(239): Xaa can be any naturally occurring amino acid
IIFQIIFFVIETLFVFKYHLIFXXXXXXXXXXXXXXXXXXXXXXXXXXXXXXXXXXXXXXXXXXXXXXXXXXXXXXXXXYYLSFHHIIIFHLFHKFFXXXXXXXXXXXXXXXXXXXXXXXXXXXXXXXXXXXXXXXXXXXXXXXXXXXXXXXXXAHXXXXXXXXXXXXXXXXXXXXXXXXXXXXXXXXXXXXXXXXXXXXXXXXXXXXXXXXXXXXXXXXXXXXXXXXXXXXXXXXXXXWGD

SEQ ID NO: 37555 - protein, 94 aa, Diabrotica virgifera
  misc_feature: Coding regions on vcDNA: vcDNA=SeqID_17252; Strand=+; Position=271-555
DEVSDNIRIARFGKKNKNGHHPFKVFLSSTENVQTADMQFLNRNTLTMLKPSLSALIRPLIKGRYLNLYIKFELLSPQEAGDRTCRYGIIISQR

SEQ ID NO: 37556 - protein, 69 aa, Diabrotica virgifera
  misc_feature: Coding regions on vcDNA: vcDNA=SeqID_17253; Strand=-; Position=164-373
VIFCLSDAEYIIDVNGPDRCIYSYSLHKCHLSKYLSNDKCIVIHGMLVYQGDSSLIILRVYDVHMLYFS

SEQ ID NO: 37557 - protein, 59 aa, Diabrotica virgifera
  misc_feature: Coding regions on vcDNA: vcDNA=SeqID_17254; Strand=+; Position=449-625
YGYRRGKFMEDVIKKVYEIVESSEGKYVMRVFIEIYGDLDNIWWVEFFERVRRMRRKGY

SEQ ID NO: 37558 - protein, 277 aa, Diabrotica virgifera
  misc_feature: Coding regions on vcDNA: vcDNA=SeqID_17255; Strand=-; Position=1-831
  misc_feature (1)..(232): Xaa can be any naturally occurring amino acid
  misc_feature (235)..(249): Xaa can be any naturally occurring amino acid
  misc_feature (251)..(274): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXVXXXXXXXXXXXXXXXXXXXXXXXXGKE

SEQ ID NO: 37559 - protein, 286 aa, Diabrotica virgifera
  misc_feature: Coding regions on vcDNA: vcDNA=SeqID_17256; Strand=+; Position=37-890
  misc_feature: Homolog annotation: Hit_ID=XP_319693.1; Match level="QueryCoverage =97%, HitCoverage=23%, E-value=5e-62, Identity=47%"; Hit description =ENSANGP00000021368 [Anopheles gambiae]
  misc_feature: Gene Ontology Annotation: Molecular function=single-stranded DNA specific endodeoxyribonuclease activity; Cellular component =nucleotide excision repair complex; Biological process=DNA repair
  misc_feature: Pfam annotation: Pfam_ID=XPG_N; Match level="Score=67.5, E-value=3.7e- 17, Copies=1"; Pfam description=XPG N-terminal domain
  misc_feature (9)..(9): Xaa can be any naturally occurring amino acid
  misc_feature (47)..(47): Xaa can be any naturally occurring amino acid
  misc_feature (101)..(101): Xaa can be any naturally occurring amino acid
  misc_feature (182)..(182): Xaa can be any naturally occurring amino acid
  misc_feature (197)..(197): Xaa can be any naturally occurring amino acid
  misc_feature (221)..(221): Xaa can be any naturally occurring amino acid
  misc_feature (227)..(227): Xaa can be any naturally occurring amino acid
  misc_feature (263)..(263): Xaa can be any naturally occurring amino acid
YGGSTGLWXKLIESSGKPIPPETLENKVLAMVSIWLHQAIKGFQGSXKELLVPNGSFIGGYTTEFGKLLYFKIKPIFVFDGGVPALKRQTIAKRNQYKSKXASEADRLQKQLLSTLLKHTAISKGLSEKTKASLPVIKKSSGKYDNLYAPPTEEFESVVSSSDDDLDEKVRNYDYRLQSYQXNGDLHTIDTTSHYFXSLPVEVKHDILTDLKETMKTNSWXKLHQLXPNKVMTFSSYQMKRWLKRKEVQSGLDEVSKEMGGKXLSLAELESLLKDQGIKTTNGSNI

SEQ ID NO: 37560 - protein, 300 aa, Diabrotica virgifera
  misc_feature: Coding regions on vcDNA: vcDNA=SeqID_17257; Strand=-; Position=1-900
  misc_feature (3)..(4): Xaa can be any naturally occurring amino acid
  misc_feature (17)..(75): Xaa can be any naturally occurring amino acid
  misc_feature (79)..(215): Xaa can be any naturally occurring amino acid
  misc_feature (219)..(256): Xaa can be any naturally occurring amino acid
  misc_feature (259)..(300): Xaa can be any naturally occurring amino acid
YKXXYTKKLLIIYKLYXXXXXXXXXXXXXXXXXXXXXXXXXXXXXXXXXXXXXXXXXXXXXXXXXXXXXXXXXXXQWAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFDXXXXXXXXXXXXXXXXXXXXXXXXXXXXXXXXXXXXXXEVXXXXXXXXXXXXXXXXXXXXXXXXXXXXXXXXXXXXXXXXXX

SEQ ID NO: 37561 - protein, 165 aa, Diabrotica virgifera
  misc_feature: Coding regions on vcDNA: vcDNA=SeqID_17258; Strand=-; Position=297-794
  misc_feature (22)..(51): Xaa can be any naturally occurring amino acid
TLSSPLICSMLRTRSSSSSSSXXXXXXXXXXXXXXXXXXXXXXXXXXXXXXIASQLFVTRCRVYYYCLLCLSALRHYFLLSHSKILSKGFYVTIPAIYLLLFLLAFIFLFHAIADLIISEFLHLAREVLTSLDIALQRKISFLPLFAFQLLDIFCGHWRLLLLDI

SEQ ID NO: 37562 - protein, 55 aa, Diabrotica virgifera
  misc_feature: Coding regions on vcDNA: vcDNA=SeqID_17259; Strand=+; Position=102-269
ELHQKLLVKTLIREFSFFSLVVLFKSFHSFLLHPILLNYLKLLIRCPKANLSISK

SEQ ID NO: 37563 - protein, 51 aa, Diabrotica virgifera
  misc_feature: Coding regions on vcDNA: vcDNA=SeqID_17260; Strand=+; Position=127-279
IVCIELLSKGYGLICCNVPHENSYISKDCSDMNIVCGFLMRGRVAEVLIAS

SEQ ID NO: 37564 - protein, 261 aa, Diabrotica virgifera
  misc_feature: Coding regions on vcDNA: vcDNA=SeqID_17261; Strand=-; Position=1-783
  misc_feature (2)..(244): Xaa can be any naturally occurring amino acid
  misc_feature (246)..(261): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 37565 - protein, 26 aa, Diabrotica virgifera
  misc_feature: Coding regions on vcDNA: vcDNA=SeqID_17262; Strand=+; Position=3-83
  misc_feature (12)..(12): Xaa can be any naturally occurring amino acid
NYLRDNSVILLXEFKSIIKIATSDVD

SEQ ID NO: 37566 - protein, 137 aa, Diabrotica virgifera
  misc_feature: Coding regions on vcDNA: vcDNA=SeqID_17263; Strand=+; Position=126-538
  misc_feature: Homolog annotation: Hit_ID=AAD13153.1; Match level="QueryCoverage =100%, HitCoverage=36%, E-value=1e-33, Identity=56%"; Hit description= actin [Setaria digitata]
  misc_feature: Gene Ontology Annotation: Molecular function=structural constituent of cytoskeleton; Cellular component=cytoskeleton; Biological process= reproduction
  misc_feature (43)..(43): Xaa can be any naturally occurring amino acid
  misc_feature (76)..(76): Xaa can be any naturally occurring amino acid
  misc_feature (118)..(118): Xaa can be any naturally occurring amino acid
MVNEDALNMNVKIDMMTEIMVKNFKTSVMNVDINSVLCLYESXGCKIDIELDSGDGVFQSVPIYEGKDLARVILIXELFGRVLSDYIMKILNERGYSFTSTVEREIVRDIKENICYVXLEFEEEMLTVASASYVENS

SEQ ID NO: 37567 - protein, 288 aa, Diabrotica virgifera
  misc_feature: Coding regions on vcDNA: vcDNA=SeqID_17264; Strand=+; Position=9-875
  misc_feature (7)..(18): Xaa can be any naturally occurring amino acid
  misc_feature (21)..(30): Xaa can be any naturally occurring amino acid
  misc_feature (35)..(172): Xaa can be any naturally occurring amino acid
  misc_feature (175)..(209): Xaa can be any naturally occurring amino acid
  misc_feature (214)..(286): Xaa can be any naturally occurring amino acid
LYHLFIXXXXXXXXXXXXSSXXXXXXXXXXVTETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLXXXXXXXXXXXXXXXXXXXXXXXXXXXXXXXXXXXFINLXXXXXXXXXXXXXXXXXXXXXXXXXXXXXXXXXXXXXXXXXXXXXXXXXXXXXXXXXXXXXXXXXXXXXXXXXLP

SEQ ID NO: 37568 - protein, 44 aa, Diabrotica virgifera
  misc_feature: Coding regions on vcDNA: vcDNA=SeqID_17265; Strand=-; Position=1-132
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
PFXXXXXXXXXXXTNLAHTGLNXXXXXXXXSNXXXXXXXXPIIN

SEQ ID NO: 37569 - protein, 104 aa, Diabrotica virgifera
  misc_feature: Coding regions on vcDNA: vcDNA=SeqID_17266; Strand=+; Position=317-631
TQISSNHLNYIRLHGSSNTGITIGSDETTLFLCLAYGSAIYIFLKKQRIPIYKICESDVLYYIYQPFSDKYLHYVAYHGRNDTYKGYRIWKLHQLEMMLCLINH

SEQ ID NO: 37570 - protein, 23 aa, Diabrotica virgifera
  misc_feature: Coding regions on vcDNA: vcDNA=SeqID_17267; Strand=-; Position=1-69
  misc_feature (3)..(23): Xaa can be any naturally occurring amino acid
EVXXXXXXXXXXXXXXXXXXXXX

SEQ ID NO: 37571 - protein, 131 aa, Diabrotica virgifera
  misc_feature: Coding regions on vcDNA: vcDNA=SeqID_17268; Strand=+; Position=2-397
  misc_feature (1)..(112): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKKILYLYLIITFTIYNMY

SEQ ID NO: 37572 - protein, 266 aa, Diabrotica virgifera
  misc_feature: Coding regions on vcDNA: vcDNA=SeqID_17269; Strand=+; Position=3-800
  misc_feature (1)..(16): Xaa can be any naturally occurring amino acid
  misc_feature (25)..(31): Xaa can be any naturally occurring amino acid
  misc_feature (36)..(47): Xaa can be any naturally occurring amino acid
  misc_feature (51)..(62): Xaa can be any naturally occurring amino acid
  misc_feature (64)..(73): Xaa can be any naturally occurring amino acid
  misc_feature (89)..(96): Xaa can be any naturally occurring amino acid
  misc_feature (99)..(145): Xaa can be any naturally occurring amino acid
  misc_feature (164)..(210): Xaa can be any naturally occurring amino acid
  misc_feature (214)..(222): Xaa can be any naturally occurring amino acid
  misc_feature (225)..(266): Xaa can be any naturally occurring amino acid
XXXXXXXXXXXXXXXXVREYLSHFXXXXXXXFPYLXXXXXXXXXXXXYLFXXXXXXXXXXXXNXXXXXXXXXXRNGKVSRFLNISNFSXXXXXXXXYLXXXXXXXXXXXXXXXXXXXXXXXXXXXXXXXXXXXXXXXXXXXXXXXGYHSTPTHHHSHPPQISHXXXXXXXXXXXXXXXXXXXXXXXXXXXXXXXXXXXXXXXXXXXXXXXRSFXXXXXXXXXPTXXXXXXXXXXXXXXXXXXXXXXXXXXXXXXXXXXXXXXXXXX

SEQ ID NO: 37573 - protein, 66 aa, Diabrotica virgifera; identical to SEQ ID NO: 28562
  misc_feature: Coding regions on vcDNA: vcDNA=SeqID_17270; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37574 - protein, 92 aa, Diabrotica virgifera
  misc_feature: Coding regions on vcDNA: vcDNA=SeqID_17271; Strand=-; Position=75-353
  misc_feature (4)..(13): Xaa can be any naturally occurring amino acid
KEVXXXXXXXXXXTRPRDKNNWNILKFDTHAQATTTGGVQIQFASALQYPALNPWLLQESLHAKLMHAKLGSFSWMISITCSGVNAGFSSWA

SEQ ID NO: 37575 - protein, 65 aa, Diabrotica virgifera
  misc_feature: Coding regions on vcDNA: vcDNA=SeqID_17272; Strand=+; Position=62-259
DIFSLIVPDILNNRRVKETGDPYSVSIDNLSTNDVVSLCHDIVISPSMIFFTLYPQWWMAVEINC

SEQ ID NO: 37576 - protein, 28 aa, Diabrotica virgifera
  misc_feature: Coding regions on vcDNA: vcDNA=SeqID_17273; Strand=-; Position=3-86
  misc_feature (4)..(5): Xaa can be any naturally occurring amino acid
  misc_feature (15)..(23): Xaa can be any naturally occurring amino acid
  misc_feature (26)..(27): Xaa can be any naturally occurring amino acid
RLTXXNKITLYPLRXXXXXXXXXGSXXY

SEQ ID NO: 37577 - protein, 271 aa, Diabrotica virgifera
  misc_feature: Coding regions on vcDNA: vcDNA=SeqID_17274; Strand=+; Position=51-866
MNTCDIIQLLNKQYEEPSFVVNSLNIDSTNVGRGFTKDPKDKKILNYIVQTHSLSVSQIVDDKLVPVESIGAFVNTNTYLVHWAFTMVYEQMELILENVFFYWKGSKAPKGLSPLPPDVDNETAIVNRIVQWSEPPVFFHLLEEKRMVVFEDNFDPSSPHLFIVLGELSEELHLYEVSFMKKNLRSRGVFVIAVPQKKTIYIWKGSQITNELDAVVKGACLFNTVRNYVDSWKNFEILEMKETEEDILFEGDTSEYWHVKEVCNYSPKLSF

SEQ ID NO: 37578 - protein, 223 aa, Diabrotica virgifera
  misc_feature: Coding regions on vcDNA: vcDNA=SeqID_17275; Strand=-; Position=82-753
  misc_feature (6)..(53): Xaa can be any naturally occurring amino acid
  misc_feature (58)..(187): Xaa can be any naturally occurring amino acid
  misc_feature (192)..(203): Xaa can be any naturally occurring amino acid
LGYLSXXXXXXXXXXXXXXXXXXXXXXXXXXXXXXXXXXXXXXXXXXXXXXXXQFFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVINNXXXXXXXXXXXXFIKDKDIRLYKCVIEASQLR

SEQ ID NO: 37579 - protein, 66 aa, Diabrotica virgifera
  misc_feature: Coding regions on vcDNA: vcDNA=SeqID_17276; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
SFXXXXXXXXXXXNYLAHTGLNXXXXXXXXSNXXXXXXXXXXXXXXPTSRSXXXXXXXXXXXXXXV

SEQ ID NO: 37580 - protein, 73 aa, Diabrotica virgifera
  misc_feature: Coding regions on vcDNA: vcDNA=SeqID_17277; Strand=-; Position=129-350
  misc_feature (12)..(24): Xaa can be any naturally occurring amino acid
IVSVREYFYIYXXXXXXXXXXXXXYCIHWLHVSILRLFLRISGHNKLNIFRYYIDSKNDYFFHCFQYLNVQFT

SEQ ID NO: 37581 - protein, 60 aa, Diabrotica virgifera
  misc_feature: Coding regions on vcDNA: vcDNA=SeqID_17278; Strand=+; Position=184-366
VIDVVIYRVFFHFSDRIVPLPSQSVLRTYIKEIICVILFYFKYFFNYANGRMVRVPLHIG

SEQ ID NO: 37582 - protein, 104 aa, Diabrotica virgifera
  misc_feature: Coding regions on vcDNA: vcDNA=SeqID_17279; Strand=+; Position=96-410
  misc_feature: Homolog annotation: Hit_ID=XP_307274.1; Match level="QueryCoverage =92%, HitCoverage=18%, E-value=8e-13, Identity=42%"; Hit description =ENSANGP00000023005 [Anopheles gambiae]
  misc_feature (71)..(71): Xaa can be any naturally occurring amino acid
  misc_feature (91)..(91): Xaa can be any naturally occurring amino acid
EIKQRIILSISKMDESLLLIFEQIILRGIFGGVCENGIWKRMYNYEIYHKYKYISNGKDVKSLIKIGRLRXAEHLARLRQNNPFRGILLLXPAGNRSRVRTKLR

SEQ ID NO: 37583 - protein, 36 aa, Diabrotica virgifera
  misc_feature: Coding regions on vcDNA: vcDNA=SeqID_17280; Strand=-; Position=1-108
  misc_feature (1)..(35): Xaa can be any naturally occurring amino acid
XXXXXXXXXXXXXXXXXXXXXXXXXXXXXXXXXXXL

SEQ ID NO: 37584 - protein, 69 aa, Diabrotica virgifera
  misc_feature: Coding regions on vcDNA: vcDNA=SeqID_17281; Strand=+; Position=3-212
HASVQKKRTVCTMQHEHREYSLQSLPLDKMKCVIKSYDLSSNSVTAIQPFGLEISASTLICVVARYIQP

SEQ ID NO: 37585 - protein, 142 aa, Diabrotica virgifera
  misc_feature: Coding regions on vcDNA: vcDNA=SeqID_17282; Strand=+; Position=49-477
  misc_feature: Homolog annotation: Hit_ID=XP_311647.1; Match level="QueryCoverage =97%, HitCoverage=74%, E-value=1e-24, Identity=42%"; Hit description =ENSANGP00000015077 [Anopheles gambiae]
  misc_feature: Gene Ontology Annotation: Molecular function=calcium ion binding; Cellular component=translocon; Biological process=intracellular protein transport
  misc_feature: Pfam annotation: Pfam_ID=TRAP-delta; Match level="Score=92.2, E-value= 1.3e-24, Copies=1"; Pfam description=Translocon-associated protein, delta
MSKATLVAFFTIISASFCLGCTNPEVSSKSFTTLDATIVTNIAYISEFSIKCGSGKLGNLYAALNGHISPVSLVGNDKFQVSWTEDIKTAKSGDRLIKLYDEEGYAAYKKANRANEDVSSVPSFADVVDTNSAADYGQWASI

SEQ ID NO: 37586 - protein, 84 aa, Diabrotica virgifera
  misc_feature: Coding regions on vcDNA: vcDNA=SeqID_17283; Strand=-; Position=1-252
  misc_feature (4)..(41): Xaa can be any naturally occurring amino acid
  misc_feature (44)..(55): Xaa can be any naturally occurring amino acid
  misc_feature (59)..(82): Xaa can be any naturally occurring amino acid
PISXXXXXXXXXXXXXXXXXXXXXXXXXXXXXXXXXXXXXXRYXXXXXXXXXXXXFSHXXXXXXXXXXXXXXXXXXXXXXXXIN

SEQ ID NO: 37587 - protein, 147 aa, Diabrotica virgifera
  misc_feature: Coding regions on vcDNA: vcDNA=SeqID_17284; Strand=+; Position=73-567
  misc_feature: Homolog annotation: Hit_ID=AAF87760.1; Match level="QueryCoverage =100%, HitCoverage=44%, E-value=3e-59, Identity=68%"; Hit description= cytochrome oxidase subunit I [Diabrotica virgifera zeae]
  misc_feature: Pfam annotation: Pfam_ID=COX1; Match level="Score=-184.9, E-value =5.8e-05, Copies=1"; Pfam description=Cytochrome C and Quinol oxidase polyp
  misc_feature (64)..(64): Xaa can be any naturally occurring amino acid
  misc_feature (99)..(99): Xaa can be any naturally occurring amino acid
VLAGAITILLTDRNLNTSFFDPAGGGDPILHPEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 37588 - protein, 67 aa, Diabrotica virgifera
  misc_feature: Coding regions on vcDNA: vcDNA=SeqID_17285; Strand=-; Position=740-943
  misc_feature (18)..(18): Xaa can be any naturally occurring amino acid
  misc_feature (34)..(34): Xaa can be any naturally occurring amino acid
  misc_feature (37)..(37): Xaa can be any naturally occurring amino acid
  misc_feature (59)..(59): Xaa can be any naturally occurring amino acid
IYVYIFQIADGTFSSKQXNKLIKASIILFDKQMXQFXAQASLGQTAWWGLEWVIPLKIXDETEWIII

SEQ ID NO: 37589 - protein, 254 aa, Diabrotica virgifera
  misc_feature: Coding regions on vcDNA: vcDNA=SeqID_17286; Strand=+; Position=136-897
  misc_feature: Homolog annotation: Hit_ID=XP_394279.1; Match level="QueryCoverage =100%, HitCoverage=43%, E-value=5e-88, Identity=64%"; Hit description= similar to solute carrier family 41 member 1 [Apis mellifera]
  misc_feature: Pfam annotation: Pfam_ID=MgtE; Match level="Score=-12.0, E-value =0.0014, Copies=1"; Pfam description=Divalent cation transporter
  misc_feature (168)..(175): Xaa can be any naturally occurring amino acid
  misc_feature (237)..(237): Xaa can be any naturally occurring amino acid
  misc_feature (241)..(241): Xaa can be any naturally occurring amino acid
  misc_feature (246)..(246): Xaa can be any naturally occurring amino acid
CQAIVVGFLGALVAVVMGGIKSNDVELDHVYLLCASSLVTVSIASFLLGLITAGVIVLSRYCHINPDNVATPIAASLGDITSLALLSWVATMLYESIGTQDWLAPSIIAAYLLAIPLWVWIAKRNYQTRDVLYYGWTPVIAAMVISSIGGLILDFMVSRFEGIAVFQXXXXXXXXNLVAVQASRISTALHKQAELGIHSSENNTDKEMVIFISPLTCFCGKDMHSRNTRVLWHGNTXSLIXIYLIXYIKNGDTS

SEQ ID NO: 37590 - protein, 42 aa, Diabrotica virgifera
  misc_feature: Coding regions on vcDNA: vcDNA=SeqID_17287; Strand=-; Position=2-127
  misc_feature (2)..(27): Xaa can be any naturally occurring amino acid
  misc_feature (30)..(41): Xaa can be any naturally occurring amino acid
KXXXXXXXXXXXXXXXXXXXXXXXXXXINXXXXXXXXXXXXA

SEQ ID NO: 37591 - protein, 104 aa, Diabrotica virgifera
  misc_feature: Coding regions on vcDNA: vcDNA=SeqID_17288; Strand=+; Position=499-812
  misc_feature: Homolog annotation: Hit_ID=NP_651416.1; Match level="QueryCoverage =87%, HitCoverage=22%, E-value=4e-13, Identity=43%"; Hit description =CG5028-PA [Drosophila melanogaster] gb|AAF56494.2| CG5028-PA [Drosophila melanogaster]
  misc_feature: Gene Ontology Annotation: Molecular function=isocitrate dehydrogenase (NAD+) activity; Cellular component=cellular_component unknown; Biological process=carbohydrate metabolism
  misc_feature (34)..(34): Xaa can be any naturally occurring amino acid
  misc_feature (47)..(47): Xaa can be any naturally occurring amino acid
  misc_feature (73)..(73): Xaa can be any naturally occurring amino acid
  misc_feature (86)..(86): Xaa can be any naturally occurring amino acid
CLIEICSPLESELLACFAHDLHAKSYPRVSARQXDMDIVTIRENDRXNIAMLEHERSIMLVIYRMEVVTESNXDRDASVAFDCRRXSGTRKIATIHKEHIMILS

SEQ ID NO: 37592 - protein, 85 aa, Diabrotica virgifera
  misc_feature: Coding regions on vcDNA: vcDNA=SeqID_17289; Strand=-; Position=351-608
  misc_feature (24)..(34): Xaa can be any naturally occurring amino acid
FKRTNLIFTIYQTQANNISNTLKXXXXXXXXXXXFSLKVYFFGYKTLNCCKQMPLRHPYLFVSRDSILIGCVYFVLFRDFHLYNL

SEQ ID NO: 37593 - protein, 145 aa, Diabrotica virgifera
  misc_feature: Coding regions on vcDNA: vcDNA=SeqID_17290; Strand=+; Position=2-439
  misc_feature (1)..(120): Xaa can be any naturally occurring amino acid
  misc_feature (123)..(130): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYLXXXXXXXXGFYGTYFSRNINNIS

SEQ ID NO: 37594 - protein, 225 aa, Diabrotica virgifera
  misc_feature: Coding regions on vcDNA: vcDNA=SeqID_17291; Strand=+; Position=1-675
  misc_feature (1)..(223): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKG

SEQ ID NO: 37595 - protein, 122 aa, Diabrotica virgifera
  misc_feature: Coding regions on vcDNA: vcDNA=SeqID_17292; Strand=+; Position=1-369
  misc_feature (1)..(69): Xaa can be any naturally occurring amino acid
XXXXXXXXXXXXXXXXXXXXXXXXXXXXXXXXXXXXXXXXXXXXXXXXXXXXXXXXXXXXXXXXXXXXXPCQSIALITQFLTTFVQFNSAFYDRYALTEIIYYTFQIFHDTGNPLILVPHLM

SEQ ID NO: 37596 - protein, 287 aa, Diabrotica virgifera
  misc_feature: Coding regions on vcDNA: vcDNA=SeqID_17293; Strand=+; Position=1-864
  misc_feature (1)..(20): Xaa can be any naturally occurring amino acid
  misc_feature (23)..(60): Xaa can be any naturally occurring amino acid
  misc_feature (63)..(200): Xaa can be any naturally occurring amino acid
  misc_feature (203)..(266): Xaa can be any naturally occurring amino acid
  misc_feature (268)..(275): Xaa can be any naturally occurring amino acid
  misc_feature (279)..(279): Xaa can be any naturally occurring amino acid
XXXXXXXXXXXXXXXXXXXXVPXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLXXXXXXXXXXXXXXXXXXXXXXXXXXXXXXXXXXXXXXXXXXXXXXXXXXXXXXXXXXXXXXXXIXXXXXXXXIIYXIKLFNLGD

SEQ ID NO: 37597 - protein, 71 aa, Diabrotica virgifera
  misc_feature: Coding regions on vcDNA: vcDNA=SeqID_17294; Strand=+; Position=726-941
  misc_feature (24)..(24): Xaa can be any naturally occurring amino acid
  misc_feature (54)..(55): Xaa can be any naturally occurring amino acid
HPMVRVDSNNRIYLFNGLIHGKEXNATEKWFDVDFTKYIHYTGCFIDKECFFVXXYVCVFESHNITLALRF

SEQ ID NO: 37598 - protein, 47 aa, Diabrotica virgifera
  misc_feature: Coding regions on vcDNA: vcDNA=SeqID_17295; Strand=-; Position=1-141
  misc_feature (1)..(11): Xaa can be any naturally occurring amino acid
  misc_feature (17)..(47): Xaa can be any naturally occurring amino acid
XXXXXXXXXXXYFLITXXXXXXXXXXXXXXXXXXXXXXXXXXXXXXX

SEQ ID NO: 37599 - protein, 266 aa, Diabrotica virgifera
  misc_feature: Coding regions on vcDNA: vcDNA=SeqID_17296; Strand=-; Position=1-801
  misc_feature (1)..(265): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 37600 - protein, 82 aa, Diabrotica virgifera
  misc_feature: Coding regions on vcDNA: vcDNA=SeqID_17297; Strand=+; Position=441-686
TISVKICPAFGVRHIQVIFMFFLYLLMYGTRYSFSVALEAMTQRTTSNPEIQVYNWTNTGILHSTFFCRYVIPHRHRSILRI

SEQ ID NO: 37601 - protein, 249 aa, Diabrotica virgifera
  misc_feature: Coding regions on vcDNA: vcDNA=SeqID_17298; Strand=-; Position=1-747
  misc_feature (2)..(232): Xaa can be any naturally occurring amino acid
  misc_feature (234)..(249): Xaa can be any naturally occurring amino acid
KXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 37602 - protein, 66 aa, Diabrotica virgifera
  misc_feature: Coding regions on vcDNA: vcDNA=SeqID_17299; Strand=-; Position=78-278
NIFVKNRGSSIIGYELITPFLYMDHLSNIWYDNMFYNSIIPTSFLNGKRRIKLYKLILLMYRVTDK

SEQ ID NO: 37603 - protein, 98 aa, Diabrotica virgifera
  misc_feature: Coding regions on vcDNA: vcDNA=SeqID_17300; Strand=+; Position=2-298
IPNTIRQYLYFSFFYQTHLHLNNIYLYSQREDHIYLFLSVVPFVMISSISVRVFLLLIVYITEIFCHLQPYIPHWTSQHLLRQSRHLVIYMTEDSIIN

SEQ ID NO: 37604 - protein, 63 aa, Diabrotica virgifera
  misc_feature: Coding regions on vcDNA: vcDNA=SeqID_17301; Strand=+; Position=12-200
  misc_feature (5)..(5): Xaa can be any naturally occurring amino acid
  misc_feature (19)..(19): Xaa can be any naturally occurring amino acid
  misc_feature (23)..(31): Xaa can be any naturally occurring amino acid
  misc_feature (33)..(41): Xaa can be any naturally occurring amino acid
  misc_feature (48)..(48): Xaa can be any naturally occurring amino acid
  misc_feature (53)..(53): Xaa can be any naturally occurring amino acid
  misc_feature (55)..(60): Xaa can be any naturally occurring amino acid
FYWRXSIDNKDCDLDVGLXFIIXXXXXXXXXFXXXXXXXXXLNRCEPXWFLSXIXXXXXXERT

SEQ ID NO: 37605 - protein, 56 aa, Diabrotica virgifera
  misc_feature: Coding regions on vcDNA: vcDNA=SeqID_17302; Strand=+; Position=472-642
PFKQISLCYVIVTSTLNDVRALLTPENLIDEYLVHMIENISIHFYLDLLQSKKEGY

SEQ ID NO: 37606 - protein, 102 aa, Diabrotica virgifera
  misc_feature: Coding regions on vcDNA: vcDNA=SeqID_17303; Strand=+; Position=329-634
  misc_feature: Homolog annotation: Hit_ID=AAW43693.1; Match level="QueryCoverage =95%, HitCoverage=45%, E-value=3e-11, Identity=38%"; Hit description =RAN small monomeric GTPase, putative [Cryptococcus neoformans var. neoformans JEC21] gb|EAL20930.1| hypoth
  misc_feature: Gene Ontology Annotation: Molecular function=RAN small monomeric GTPase activity; Cellular component=nucleus; Biological process =embryogenesis and morphogenesis
  misc_feature (47)..(47): Xaa can be any naturally occurring amino acid
  misc_feature (78)..(78): Xaa can be any naturally occurring amino acid
TDRSNYFRRFCYISIFDTTSIVKHRNAPNQYDDLDRVRENNPILLSXNKFTSCNRKIRIRGWSLHDYKIYKMMTSLVXSIYNFEKPVKWIYSSLIAYLKLEF

SEQ ID NO: 37607 - protein, 66 aa, Diabrotica virgifera; identical to SEQ ID NO: 26808
  misc_feature: Coding regions on vcDNA: vcDNA=SeqID_17304; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37608 - protein, 85 aa, Diabrotica virgifera
  misc_feature: Coding regions on vcDNA: vcDNA=SeqID_17305; Strand=+; Position=123-377
YRTRRIWTRCLFLTETLRVTSDMEKGIPILKLHRLFHTSCRLFPNILLSVTCMIVTKTYLISEWPPVNNLCDTYKKCCTTTSNKH

SEQ ID NO: 37609 - protein, 62 aa, Diabrotica virgifera
  misc_feature: Coding regions on vcDNA: vcDNA=SeqID_17306; Strand=+; Position=78-266
MKFYVASLAVNMFDEPRHIYLIMVMRTVTFYSDCVVGISRDCFYLVYRAYYFGSQIDVFIIV

SEQ ID NO: 37610 - protein, 197 aa, Diabrotica virgifera
  misc_feature: Coding regions on vcDNA: vcDNA=SeqID_17307; Strand=-; Position=1-591
  misc_feature (3)..(180): Xaa can be any naturally occurring amino acid
  misc_feature (182)..(197): Xaa can be any naturally occurring amino acid
VGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 37611 - protein, 41 aa, Diabrotica virgifera
  misc_feature: Coding regions on vcDNA: vcDNA=SeqID_17308; Strand=-; Position=1-123
  misc_feature (15)..(23): Xaa can be any naturally occurring amino acid
STEIKTKSLRGTNKXXXXXXXXXRTKTCLSMSKYFLVHGFF

SEQ ID NO: 37612 - protein, 108 aa, Diabrotica virgifera; identical to SEQ ID NO: 27732
  misc_feature: Coding regions on vcDNA: vcDNA=SeqID_17309; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37613 - protein, 66 aa, Diabrotica virgifera
  misc_feature: Coding regions on vcDNA: vcDNA=SeqID_17310; Strand=-; Position=0-197
  misc_feature (12)..(27): Xaa can be any naturally occurring amino acid
  misc_feature (30)..(64): Xaa can be any naturally occurring amino acid
EKKCCGFLLLTXXXXXXXXXXXXXXXXHTXXXXXXXXXXXXXXXXXXXXXXXXXXXXXXXXXXXNP

SEQ ID NO: 37614 - protein, 315 aa, Diabrotica virgifera
  misc_feature: Coding regions on vcDNA: vcDNA=SeqID_17311; Strand=-; Position=0-944
  misc_feature (1)..(29): Xaa can be any naturally occurring amino acid
  misc_feature (31)..(314): Xaa can be any naturally occurring amino acid
XXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 37615 - protein, 85 aa, Diabrotica virgifera
  misc_feature: Coding regions on vcDNA: vcDNA=SeqID_17312; Strand=-; Position=443-700
GFYFINRMLYVLIEGSHCFILTYLSHFNLKTNEQPNDLRSKLSRTVRLITWSGVSSFIFQIIHVYNTQMISTETRITFSNITYGY

SEQ ID NO: 37616 - protein, 59 aa, Diabrotica virgifera
  misc_feature: Coding regions on vcDNA: vcDNA=SeqID_17313; Strand=-; Position=1-177
  misc_feature (4)..(19): Xaa can be any naturally occurring amino acid
  misc_feature (21)..(30): Xaa can be any naturally occurring amino acid
  misc_feature (32)..(58): Xaa can be any naturally occurring amino acid
KSPXXXXXXXXXXXXXXXXYXXXXXXXXXXLXXXXXXXXXXXXXXXXXXXXXXXXXXXT

SEQ ID NO: 37617 - protein, 248 aa, Diabrotica virgifera
  misc_feature: Coding regions on vcDNA: vcDNA=SeqID_17314; Strand=+; Position=14-760
  misc_feature: Homolog annotation: Hit_ID=AAH27755.1; Match level="QueryCoverage =67%, HitCoverage=72%, E-value=9e-16, Identity=26%"; Hit description =9530008L14Rik protein [Mus musculus]
  misc_feature: Pfam annotation: Pfam_ID=Far-17a_AIG1; Match level="Score=25.2, E -value=1.9e-09, Copies=1"; Pfam description=FAR-17a/AIG1-like protein
MLDLANRFLGVIISKALGEQQPIKDSKQFLFHSVAVAHHLYVAWYSCTQVDLKDVTEPKIIIMVKYAPAYFTTWNFALQLCYFTLSAWCDLQNALPTKHERLSDILKIKSYIYTTFVFASGIFVTTLFWGLYHTDSEYIFPQVCQNFFPAMLNHSVHTVIFVFLVIEALYVDHPWYDLKLSVASFTIYFIIYHVVYFGVCAQLGYYIYPFFNLMSATGVATFIFSYYVWLIILIVIGIENKRKSIFKY

SEQ ID NO: 37618 - protein, 79 aa, Diabrotica virgifera; identical to SEQ ID NO: 27306
  misc_feature: Coding regions on vcDNA: vcDNA=SeqID_17315; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 37619 - protein, 165 aa, Diabrotica virgifera
  misc_feature: Coding regions on vcDNA: vcDNA=SeqID_17316; Strand=+; Position=80-577
  misc_feature: Homolog annotation: Hit_ID=XP_533035.1; Match level="QueryCoverage =99%, HitCoverage=94%, E-value=1e-49, Identity=56%"; Hit description =PREDICTED: similar to RNA-binding protein 8A (RNA binding motif protein 8A) (Ribonucleoprotein
  misc_feature: Gene Ontology Annotation: Molecular function=mRNA binding; Cellular component=nucleus; Biological process=microtubule cytoskeleton organization and biogenesis
  misc_feature: Pfam annotation: Pfam_ID=RRM_1; Match level="Score=70.2, E-value=5.8e- 18, Copies=1"; Pfam description=RNA recognition motif. (a.k.a. RRM, R
MADVLDINDAVDIDVEDEGEQSVLRLKDKVIKRKGRGFGPGEGREHEKVRGYESIDAGDHGDEPGPQKSVEGWILFATSVHEEATEEDLSKKFSDYGVIKNISINLDRRTGFLKGYALIEYGTYEEASTAREALNGSSLLGQTIGVDWCFVKGAKKSRSKRSKRH

SEQ ID NO: 37620 - protein, 50 aa, Diabrotica virgifera
  misc_feature: Coding regions on vcDNA: vcDNA=SeqID_17317; Strand=-; Position=1-150
  misc_feature (1)..(8): Xaa can be any naturally occurring amino acid
  misc_feature (10)..(50): Xaa can be any naturally occurring amino acid
XXXXXXXXVXXXXXXXXXXXXXXXXXXXXXXXXXXXXXXXXXXXXXXXXX

SEQ ID NO: 37621 - protein, 21 aa, Diabrotica virgifera
  misc_feature: Coding regions on vcDNA: vcDNA=SeqID_17318; Strand=-; Position=2-64
  misc_feature (2)..(18): Xaa can be any naturally occurring amino acid
IXXXXXXXXXXXXXXXXXLNN

SEQ ID NO: 37622 - protein, 26 aa, Diabrotica virgifera
  misc_feature: Coding regions on vcDNA: vcDNA=SeqID_17319; Strand=-; Position=5-85
  misc_feature (11)..(23): Xaa can be any naturally occurring amino acid
IINFNPTSRSXXXXXXXXXXXXXLLS

SEQ ID NO: 37623 - protein, 105 aa, Diabrotica virgifera
  misc_feature: Coding regions on vcDNA: vcDNA=SeqID_17320; Strand=+; Position=423-740
  misc_feature (70)..(79): Xaa can be any naturally occurring amino acid
  misc_feature (87)..(97): Xaa can be any naturally occurring amino acid
SVSLTGLKCLFLKGLWLKKLERVTNHECMQILNSHILTNFWLAEKQNETSIFIIEKPTFFYSLRFFLSLXXXXXXXXXXGNSSKIFXXXXXXXXXXXSKISTSNR

SEQ ID NO: 37624 - protein, 108 aa, Diabrotica virgifera; identical to SEQ ID NO: 27732
  misc_feature: Coding regions on vcDNA: vcDNA=SeqID_17321; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37625 - protein, 155 aa, Diabrotica virgifera
  misc_feature: Coding regions on vcDNA: vcDNA=SeqID_17322; Strand=+; Position=90-557
  misc_feature: Homolog annotation: Hit_ID=EAL26761.1; Match level="QueryCoverage =96%, HitCoverage=91%, E-value=2e-32, Identity=49%"; Hit description =GA13783-PA [Drosophila pseudoobscura]
MTESDSKIGRLEDEALKRKERLKNLKRKRQNDSSRDNNKKGAEGEALPTPLFRSYKPMNESLNEFALNPAEPGDVTTQVKNQLESAKSNVVIDQLDVTSLAPRKPDWDLKRDVAKKLAKLEKQTQKAIAELIRNRLKESKQEDLAAIVNAGASDL

SEQ ID NO: 37626 - protein, 103 aa, Diabrotica virgifera
  misc_feature: Coding regions on vcDNA: vcDNA=SeqID_17323; Strand=-; Position=1-309
  misc_feature (30)..(36): Xaa can be any naturally occurring amino acid
  misc_feature (43)..(56): Xaa can be any naturally occurring amino acid
  misc_feature (58)..(72): Xaa can be any naturally occurring amino acid
ITLISFLQSYIYLTDESHFTTKRLDKIFLXXXXXXXHSSPNSXXXXXXXXXXXXXXLXXXXXXXXXXXXXXXLPILITYHQTNRFYASNKKYPIIIKSLGRVK

SEQ ID NO: 37627 - protein, 91 aa, Diabrotica virgifera
  misc_feature: Coding regions on vcDNA: vcDNA=SeqID_17324; Strand=-; Position=21-296
LPALPINRSTTANNPQFLSRLTLIFHNCQLNRRTITTTFFLILHLAKLGSMARRLRYVKGTFSLSNNSKIPHQTIALILSRALKGRSIQTT

SEQ ID NO: 37628 - protein, 101 aa, Diabrotica virgifera
  misc_feature: Coding regions on vcDNA: vcDNA=SeqID_17325; Strand=+; Position=138-443
LFKEIIIGNSADVLERYSLKLKIIGDLDPYTIQSSELDFTVHSINYCYNAIIDRLVLESHSYYFKQQMKAYKSLQTHKSLHNWICFETFDVLMISILLLER

SEQ ID NO: 37629 - protein, 117 aa, Diabrotica virgifera
  misc_feature: Coding regions on vcDNA: vcDNA=SeqID_17326; Strand=+; Position=60-415
  misc_feature: Homolog annotation: Hit_ID=XP_309120.1; Match level="QueryCoverage =97%, HitCoverage=25%, E-value=3e-19, Identity=45%"; Hit description =ENSANGP00000024967 [Anopheles gambiae] gb|EAA04978.2| ENSANGP00000024967 [Anopheles gambiae
  misc_feature: Gene Ontology Annotation: Molecular function=peptidase activity; Cellular component=mitochondrion; Biological process=electron transport
  misc_feature: Pfam annotation: Pfam_ID=Peptidase_M16; Match level="Score=-22.1, E -value=0.012, Copies=1"; Pfam description=Insulinase (Peptidase family M16)
  misc_feature (32)..(32): Xaa can be any naturally occurring amino acid
  misc_feature (49)..(49): Xaa can be any naturally occurring amino acid
  misc_feature (53)..(53): Xaa can be any naturally occurring amino acid
  misc_feature (80)..(80): Xaa can be any naturally occurring amino acid
  misc_feature (94)..(94): Xaa can be any naturally occurring amino acid
KSEVAQIMEHLFINMTCIRTQRQLKNDIEYLXAPLNAYTIRKHTVYYSXCYKXENQKPYNTWFDISRMPYLIEAEVEREXGVFHIKMHEFQSNXQVDILDHLHAIAYQLTPLSNTIL

SEQ ID NO: 37630 - protein, 99 aa, Diabrotica virgifera
  misc_feature: Coding regions on vcDNA: vcDNA=SeqID_17327; Strand=+; Position=1-297
  misc_feature (1)..(90): Xaa can be any naturally occurring amino acid
  misc_feature (93)..(94): Xaa can be any naturally occurring amino acid
  misc_feature (97)..(98): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYIXXYLXXV

SEQ ID NO: 37631 - protein, 243 aa, Diabrotica virgifera
  misc_feature: Coding regions on vcDNA: vcDNA=SeqID_17328; Strand=+; Position=173-900
  misc_feature: Homolog annotation: Hit_ID=XP_395920.1; Match level="QueryCoverage =65%, HitCoverage=30%, E-value=2e-35, Identity=47%"; Hit description =similar to UV radiation resistance associated [Apis mellifera]
  misc_feature (229)..(229): Xaa can be any naturally occurring amino acid
  misc_feature (238)..(238): Xaa can be any naturally occurring amino acid
MDNASLEKDVSPSSGSMGNIRYAPQLLTMNSLNKLLYEKPTYVQKQEMAKNTTKLLSQEKAKKTVIIRTLKQNYAAILEKNEERNSDLMENYHKLSRGSEKLKEYKKNILHHKEIYYNIHSQLQQRRRQLLKELLFIFPIENICDDKYTIIGIHLPNSDVLADCSDTGLSVALGYIAHVLIMCSTFLQVPVRYSLTHYGSRSYIADNISPMLLDKDRLFPLFTRGKEKXQFTYAVYLXHKNLA

SEQ ID NO: 37632 - protein, 272 aa, Diabrotica virgifera
  misc_feature: Coding regions on vcDNA: vcDNA=SeqID_17329; Strand=+; Position=97-915
  misc_feature: Homolog annotation: Hit_ID=CAF89879.1; Match level="QueryCoverage =94%, HitCoverage=60%, E-value=1e-46, Identity=35%"; Hit description =unnamed protein product [Tetraodon nigroviridis]
  misc_feature: Gene Ontology Annotation: Biological process=regulation of transcription, DNA-dependent
  misc_feature: Pfam annotation: Pfam_ID=zf-C2H2; Match level="Score=18.4, E-value =0.023, Copies=1"; Pfam description=Zinc finger, C2H2 type
MDLPQPDDSKNLFGPLVFEESQYSDFQSDVETDCLLCEDRFNLKLSLPMFLAHIFDVHSVVIEDVQNIDNLHEYVSYWHQKFQKNSLEQIIPSLSLDSTGQKYYLLSSLLKEDKELRHKLKLDYVIKIQEYERNNKNFRRSCLMCKLEYEGPRPGYFEHLSSQHNLQLGNPQNLVFVDELINKIESKMTALQCIYCERTFPDRHVLKEHMRKKLHKRINPKNEEYDKYYIVNYLEENKTWKAIQKENDRYAANKESESNADEEYSRWNEKKI

SEQ ID NO: 37633 - protein, 67 aa, Diabrotica virgifera
  misc_feature: Coding regions on vcDNA: vcDNA=SeqID_17330; Strand=+; Position=2-205
SLQIPSGTLCAVVGPVGAGKSSLLQLLLAELPTISEKFSIEAIAHTDPLLFSESRFPKYTISLLSTN

SEQ ID NO: 37634 - protein, 315 aa, Diabrotica virgifera
  misc_feature: Coding regions on vcDNA: vcDNA=SeqID_17331; Strand=-; Position=0-944
  misc_feature (11)..(314): Xaa can be any naturally occurring amino acid
QKKWIKNLYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 37635 - protein, 241 aa, Diabrotica virgifera
  misc_feature: Coding regions on vcDNA: vcDNA=SeqID_17332; Strand=-; Position=1-723
  misc_feature (1)..(241): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37636 - protein, 56 aa, Diabrotica virgifera
  misc_feature: Coding regions on vcDNA: vcDNA=SeqID_17333; Strand=-; Position=27-197
ISIFNVEIIRKMAVNPVFNWRLSHEVENYRTTDIVNINLIHLMRQLIFFLIHWSYS

SEQ ID NO: 37637 - protein, 66 aa, Diabrotica virgifera; identical to SEQ ID NO: 26808
  misc_feature: Coding regions on vcDNA: vcDNA=SeqID_17334; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37638 - protein, 122 aa, Diabrotica virgifera
  misc_feature: Coding regions on vcDNA: vcDNA=SeqID_17335; Strand=+; Position=453-821
  misc_feature (1)..(7): Xaa can be any naturally occurring amino acid
XXXXXXXLLQDLHTNFLHRYMTFTCLILVLVSSFTLLFLLQVLSLLRRLTIIIAILIFESVALNSCFELCPNLSHEIRLLPMLLLLSTPPCIMSHRMPYFSLRITCPRYCSFCPCLRLLLFD

SEQ ID NO: 37639 - protein, 49 aa, Diabrotica virgifera
  misc_feature: Coding regions on vcDNA: vcDNA=SeqID_17336; Strand=+; Position=3-152
KKSKFVIAEMRFYFTCLMRRGSTIMKNVSIHSICTSSTRELNINNECCY

SEQ ID NO: 37640 - protein, 279 aa, Diabrotica virgifera
  misc_feature: Coding regions on vcDNA: vcDNA=SeqID_17337; Strand=+; Position=23-862
  misc_feature: Homolog annotation: Hit_ID=XP_309435.1; Match level="QueryCoverage =83%, HitCoverage=45%, E-value=3e-39, Identity=38%"; Hit description =ENSANGP00000011164 [Anopheles gambiae]
  misc_feature: Gene Ontology Annotation: Molecular function=polyamine oxidase activity; Biological process=spermine catabolism
  misc_feature (8)..(12): Xaa can be any naturally occurring amino acid
  misc_feature (23)..(29): Xaa can be any naturally occurring amino acid
  misc_feature (153)..(160): Xaa can be any naturally occurring amino acid
  misc_feature (279)..(279): Xaa can be any naturally occurring amino acid
INERYKDXXXXXDWCHKMSTCNXXXXXXXDLSVQGSVAGFIRSEGDQQLNWRNKGYKTILDVLMEKTPDRTKTLPVEDKILLNKEVNKIVWDGNTSNGSKPTVYCSYGSSYTADHILITTSVGVLKKFHKSWFVPELPPYKVNCIEHISLGVXXXXXXXXPSKWWPDGTKGFNLLWAEKDSLNLLNELPASGPVDEDGRSWLEDVFGFYIIDSQVNTLLGWVVGKMAAEVEYMSDTDVIAVCMFVLRKFLGKIYDICDADEILRSKWSSIPHFLWSYVX

SEQ ID NO: 37641 - protein, 193 aa, Diabrotica virgifera
  misc_feature: Coding regions on vcDNA: vcDNA=SeqID_17338; Strand=+; Position=32-696
  misc_feature: Homolog annotation: Hit_ID=XP_319829.1; Match level="QueryCoverage =93%, HitCoverage=38%, E-value=2e-56, Identity=52%"; Hit description =ENSANGP00000015949 [Anopheles gambiae]
  misc_feature (33)..(33): Xaa can be any naturally occurring amino acid
MKLPLQLPGEKETRTIEFAHCIIASGHESATVXKLAGIGMKPGMLSIPLPIENRRRFVFAFNCEKDVPSINTPMIEDFSGIYFRREGLAGSFIVGVAPQPEVPAFNDIKLTGSWSGDYDYNIFDGNGLVGPHPYYLNMYIATGFSDQGIQQAPGIGRAVSEMIIDGNFRTIDLTRLGFDRLLVDKPMFQLKIT

SEQ ID NO: 37642 - protein, 116 aa, Diabrotica virgifera
  misc_feature: Coding regions on vcDNA: vcDNA=SeqID_17339; Strand=+; Position=420-767
  misc_feature: Homolog annotation: Hit_ID=CAE47497.1; Match level="QueryCoverage =100%, HitCoverage=37%, E-value=2e-19, Identity=44%"; Hit description= cathepsin L-like proteinase [Diabrotica virgifera virgifera]
  misc_feature (28)..(28): Xaa can be any naturally occurring amino acid
  misc_feature (67)..(67): Xaa can be any naturally occurring amino acid
WPFTATTALELHIAIHINQNIPLIEQEXIECDSSNSGWKAVLVTNVIGYVTSHSLASYEMYAYADRXAKYITKSIILSTISKYVNLVTTDDAMAKDLSSACPVSIDVDVDACEIYG

SEQ ID NO: 37643 - protein, 66 aa, Diabrotica virgifera; identical to SEQ ID NO: 26808
  misc_feature: Coding regions on vcDNA: vcDNA=SeqID_17340; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37644 - protein, 232 aa, Diabrotica virgifera
  misc_feature: Coding regions on vcDNA: vcDNA=SeqID_17341; Strand=-; Position=1-696
  misc_feature (1)..(230): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEV

SEQ ID NO: 37645 - protein, 41 aa, Diabrotica virgifera
  misc_feature: Coding regions on vcDNA: vcDNA=SeqID_17342; Strand=+; Position=2-127
  misc_feature (2)..(15): Xaa can be any naturally occurring amino acid
  misc_feature (38)..(39): Xaa can be any naturally occurring amino acid
NXXXXXXXXXXXXXXRPRCWIKFIIGVAAISSSLFDFXXFT

SEQ ID NO: 37646 - protein, 283 aa, Diabrotica virgifera
  misc_feature: Coding regions on vcDNA: vcDNA=SeqID_17343; Strand=+; Position=97-945
  misc_feature: Homolog annotation: Hit_ID=XP_313838.1; Match level="QueryCoverage =96%, HitCoverage=70%, E-value=2e-49, Identity=39%"; Hit description =ENSANGP00000023297 [Anopheles gambiae]
  misc_feature: Pfam annotation: Pfam_ID=DUF1308; Match level="Score=59.2, E-value =1.2e-14, Copies=1"; Pfam description=Protein of unknown function (DUF1308)
  misc_feature (16)..(24): Xaa can be any naturally occurring amino acid
  misc_feature (260)..(260): Xaa can be any naturally occurring amino acid
  misc_feature (264)..(264): Xaa can be any naturally occurring amino acid
  misc_feature (272)..(272): Xaa can be any naturally occurring amino acid
  misc_feature (275)..(275): Xaa can be any naturally occurring amino acid
MHVEIEDDYALKDLAXXXXXXXXXLIKSIENFKHIEGSQKLSRKISQELKFLRKANKNNSLKKEHLQCSNLTHFSALIDTLKTVERCQSVNKVFVLDDRKITVDIISDGGLTWTKVIARNPKSVSQICMGNASYGVRSIIDQAEEYIRCAKQYPCLFQFPKIIFVFTNGIGSHIAAKLESRGIIVQGERVSDFPLDSDSDSDIEEEYPNISDLSTKDIANINKINLDVSAMLAYCSSVTNGSAELYDFNVPVLKQQAEWXRAEXQKPILDIXFRXKKLYCCQQ

SEQ ID NO: 37647 - protein, 265 aa, Diabrotica virgifera
  misc_feature: Coding regions on vcDNA: vcDNA=SeqID_17344; Strand=-; Position=1-795
  misc_feature (6)..(6): Xaa can be any naturally occurring amino acid
  misc_feature (8)..(208): Xaa can be any naturally occurring amino acid
  misc_feature (212)..(248): Xaa can be any naturally occurring amino acid
  misc_feature (251)..(265): Xaa can be any naturally occurring amino acid
KNYLIXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFVXXXXXXXXXXXXXXXXXXXXXXXXXXXXXXXXXXXXXEVXXXXXXXXXXXXXXX

SEQ ID NO: 37648 - protein, 113 aa, Diabrotica virgifera
  misc_feature: Coding regions on vcDNA: vcDNA=SeqID_17345; Strand=+; Position=10-351
  misc_feature: Homolog annotation: Hit_ID=EAL32629.1; Match level="QueryCoverage =76%, HitCoverage=13%, E-value=3e-19, Identity=55%"; Hit description =GA16389-PA [Drosophila pseudoobscura]
  misc_feature (48)..(48): Xaa can be any naturally occurring amino acid
  misc_feature (63)..(63): Xaa can be any naturally occurring amino acid
VPKSKRGYMLSFMIAFCTLDNLFVIGLCCMMIPDDIGYKNQDFVYNSXIIYLLICSFPSFILXSLLCIVPQSTKCLLTKYKSEQTLANLNYKYHETSEHDHRYCSIKNQIYKQ

SEQ ID NO: 37649 - protein, 66 aa, Diabrotica virgifera; identical to SEQ ID NO: 26808
  misc_feature: Coding regions on vcDNA: vcDNA=SeqID_17346; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37650 - protein, 251 aa, Diabrotica virgifera
  misc_feature: Coding regions on vcDNA: vcDNA=SeqID_17347; Strand=+; Position=118-871
  misc_feature: Homolog annotation: Hit_ID=EAA00988.2; Match level="QueryCoverage =80%, HitCoverage=93%, E-value=3e-55, Identity=52%"; Hit description =ENSANGP00000012004 [Anopheles gambiae str. PEST] ref|XP_551668.1| ENSANGP00000012004 [Anopheles gambiae st
  misc_feature: Pfam annotation: Pfam_ID=efhand; Match level="Score=53.5, E-value=6e -13, Copies=3"; Pfam description=EF hand
  misc_feature (89)..(96): Xaa can be any naturally occurring amino acid
  misc_feature (210)..(210): Xaa can be any naturally occurring amino acid
  misc_feature (233)..(233): Xaa can be any naturally occurring amino acid
MAFSIFRQCVKNGITVSNRSALMEGVLKNTLANVSCRCVPVAAVNFNNSIVARSYSKHAKHTHAERKYQSDSESDSDLEWIGHRGESDXXXXXXXXFHGILDLNKDGVISFDDFKLLSDRFINLGHLRSEQVKKFQDVLKNLWEKQFGEISPYNLVSVERYLENMHHVLNDKRLVRKAHSFLPYLFKAVDKDRSGEISVEEFKLFFNVLXLKEQDAILAFRAIDSNGNEKITXKEFVKHERDFFLTEDQER

SEQ ID NO: 37651 - protein, 170 aa, Diabrotica virgifera
  misc_feature: Coding regions on vcDNA: vcDNA=SeqID_17348; Strand=-; Position=0-509
  misc_feature (1)..(6): Xaa can be any naturally occurring amino acid
  misc_feature (163)..(169): Xaa can be any naturally occurring amino acid
XXXXXXVTLVAKQQQLRKNHTKTSTRTLRPSATYATLRKFIFHPKKLHDTAKRHCKLHQDRFNRPRKTNLEIKLSQKKFNPSKCYRTENKADSKLKLSLRTLHLQFVKLKLINYHGVRNFSKQTSITGATRRTAVLDSHKLISTKISFNLYLIYYFLTLYFVXXXXXXXT

SEQ ID NO: 37652 - protein, 277 aa, Diabrotica virgifera
  misc_feature: Coding regions on vcDNA: vcDNA=SeqID_17349; Strand=-; Position=2-832
  misc_feature (4)..(261): Xaa can be any naturally occurring amino acid
  misc_feature (263)..(277): Xaa can be any naturally occurring amino acid
LNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 37653 - protein, 73 aa, Diabrotica virgifera
  misc_feature: Coding regions on vcDNA: vcDNA=SeqID_17350; Strand=-; Position=658-879
  misc_feature (32)..(32): Xaa can be any naturally occurring amino acid
  misc_feature (37)..(47): Xaa can be any naturally occurring amino acid
VERMEEGEIPNKIFNQMPVGKRTRGRPKLRYXEQIEXXXXXXXXXXXKKKARNRSEWRRILEQAKTQKGLSSQ

SEQ ID NO: 37654 - protein, 54 aa, Diabrotica virgifera
  misc_feature: Coding regions on vcDNA: vcDNA=SeqID_17351; Strand=-; Position=1-162
  misc_feature (3)..(21): Xaa can be any naturally occurring amino acid
  misc_feature (23)..(53): Xaa can be any naturally occurring amino acid
KNXXXXXXXXXXXXXXXXXXXPXXXXXXXXXXXXXXXXXXXXXXXXXXXXXXXM

SEQ ID NO: 37655 - protein, 64 aa, Diabrotica virgifera
  misc_feature: Coding regions on vcDNA: vcDNA=SeqID_17352; Strand=-; Position=1-192
  misc_feature (3)..(41): Xaa can be any naturally occurring amino acid
  misc_feature (43)..(64): Xaa can be any naturally occurring amino acid
RFXXXXXXXXXXXXXXXXXXXXXXXXXXXXXXXXXXXXXXXGXXXXXXXXXXXXXXXXXXXXXX

SEQ ID NO: 37656 - protein, 45 aa, Diabrotica virgifera
  misc_feature: Coding regions on vcDNA: vcDNA=SeqID_17353; Strand=-; Position=3-137
  misc_feature (3)..(10): Xaa can be any naturally occurring amino acid
  misc_feature (13)..(26): Xaa can be any naturally occurring amino acid
FKXXXXXXXXSNXXXXXXXXXXXXXXQHRGRNLYYRFDSPIKLRC

SEQ ID NO: 37657 - protein, 22 aa, Diabrotica virgifera
  misc_feature: Coding regions on vcDNA: vcDNA=SeqID_17354; Strand=-; Position=1-66
  misc_feature (3)..(22): Xaa can be any naturally occurring amino acid
RYXXXXXXXXXXXXXXXXXXXX

SEQ ID NO: 37658 - protein, 61 aa, Diabrotica virgifera
  misc_feature: Coding regions on vcDNA: vcDNA=SeqID_17355; Strand=-; Position=50-235
  misc_feature (4)..(27): Xaa can be any naturally occurring amino acid
  misc_feature (31)..(42): Xaa can be any naturally occurring amino acid
  misc_feature (45)..(52): Xaa can be any naturally occurring amino acid
VSIXXXXXXXXXXXXXXXXXXXXXXXXEINXXXXXXXXXXXXRYXXXXXXXXEKKDILSRY

SEQ ID NO: 37659 - protein, 136 aa, Diabrotica virgifera
  misc_feature: Coding regions on vcDNA: vcDNA=SeqID_17356; Strand=+; Position=178-585
  misc_feature (13)..(28): Xaa can be any naturally occurring amino acid
  misc_feature (31)..(136): Xaa can be any naturally occurring amino acid
ISFNNFFLTKRYXXXXXXXXXXXXXXXXLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37660 - protein, 284 aa, Diabrotica virgifera
  misc_feature: Coding regions on vcDNA: vcDNA=SeqID_17357; Strand=-; Position=1-852
  misc_feature (3)..(37): Xaa can be any naturally occurring amino acid
  misc_feature (41)..(58): Xaa can be any naturally occurring amino acid
  misc_feature (61)..(202): Xaa can be any naturally occurring amino acid
  misc_feature (205)..(212): Xaa can be any naturally occurring amino acid
  misc_feature (217)..(225): Xaa can be any naturally occurring amino acid
  misc_feature (228)..(260): Xaa can be any naturally occurring amino acid
  misc_feature (267)..(282): Xaa can be any naturally occurring amino acid
SSXXXXXXXXXXXXXXXXXXXXXXXXXXXXXXXXXXXILHXXXXXXXXXXXXXXXXXXTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYXXXXXXXXKILMXXXXXXXXXSFXXXXXXXXXXXXXXXXXXXXXXXXXXXXXXXXXPILINYXXXXXXXXXXXXXXXXIN

SEQ ID NO: 37661 - protein, 224 aa, Diabrotica virgifera
  misc_feature: Coding regions on vcDNA: vcDNA=SeqID_17358; Strand=+; Position=52-726
  misc_feature: Homolog annotation: Hit_ID=EAA12037.2; Match level="QueryCoverage =94%, HitCoverage=37%, E-value=6e-52, Identity=47%"; Hit description =ENSANGP00000001916 [Anopheles gambiae str. PEST] ref|XP_555874.1| ENSANGP00000001916 [Anopheles gambiae st
  misc_feature: Gene Ontology Annotation: Molecular function=monooxygenase activity; Cellular component=extracellular space; Biological process =leukotriene metabolism
  misc_feature (77)..(83): Xaa can be any naturally occurring amino acid
  misc_feature (199)..(208): Xaa can be any naturally occurring amino acid
PVVQPLETETSSILTSNIPLILIGIISVLLGYQYWFKNQRYVQMGNKFPGPATLPFIGNAHLAFGKSAHGLFELAMXXXXXXXIDVGRIWLGPRLIIGVANADDIEIILGNSVHLEKSPDYGLFEPWLGDGLLISKGEKWRSHRKMIAPTFHTSILKSFMPVFNRNATALVETFRKEQGKVFDCHDYLSSTTVDTLLEXXXXXXXXXXSKAGFDYAMAVMRITN

SEQ ID NO: 37662 - protein, 28 aa, Diabrotica virgifera
  misc_feature: Coding regions on vcDNA: vcDNA=SeqID_17359; Strand=-; Position=3-86
  misc_feature (6)..(6): Xaa can be any naturally occurring amino acid
  misc_feature (9)..(25): Xaa can be any naturally occurring amino acid
  misc_feature (28)..(28): Xaa can be any naturally occurring amino acid
PKVIYXYIXXXXXXXXXXXXXXXXXLNX

SEQ ID NO: 37663 - protein, 238 aa, Diabrotica virgifera
  misc_feature: Coding regions on vcDNA: vcDNA=SeqID_17360; Strand=+; Position=13-726
  misc_feature (23)..(34): Xaa can be any naturally occurring amino acid
  misc_feature (38)..(62): Xaa can be any naturally occurring amino acid
  misc_feature (66)..(238): Xaa can be any naturally occurring amino acid
LISIVREYLYLLSKEKFHLSRTXXXXXXXXXXXXIYLXXXXXXXXXXXXXXXXXXXXXXXXXRNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37664 - protein, 76 aa, Diabrotica virgifera
  misc_feature: Coding regions on vcDNA: vcDNA=SeqID_17361; Strand=+; Position=496-726
SVKVIWIIISYNKYVNVTKRKNAKKTFDQECEQSLKLKTSKKTDLLPRSTDENSEAYHIIRTETRTLLKRKKTRGT

SEQ ID NO: 37665 - protein, 244 aa, Diabrotica virgifera
  misc_feature: Coding regions on vcDNA: vcDNA=SeqID_17362; Strand=-; Position=3-734
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(244): Xaa can be any naturally occurring amino acid
PFVLKYINNLKIETNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37666 - protein, 255 aa, Diabrotica virgifera
  misc_feature: Coding regions on vcDNA: vcDNA=SeqID_17363; Strand=-; Position=1-765
  misc_feature (4)..(197): Xaa can be any naturally occurring amino acid
  misc_feature (201)..(238): Xaa can be any naturally occurring amino acid
  misc_feature (240)..(255): Xaa can be any naturally occurring amino acid
FLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFIXXXXXXXXXXXXXXXXXXXXXXXXXXXXXXXXXXXXXXRXXXXXXXXXXXXXXXX

SEQ ID NO: 37667 - protein, 301 aa, Diabrotica virgifera
  misc_feature: Coding regions on vcDNA: vcDNA=SeqID_17364; Strand=-; Position=2-904
  misc_feature (3)..(258): Xaa can be any naturally occurring amino acid
  misc_feature (261)..(269): Xaa can be any naturally occurring amino acid
  misc_feature (294)..(300): Xaa can be any naturally occurring amino acid
IYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXKMKDILSRYELTIVKMKIFLYIYEXXXXXXXK

SEQ ID NO: 37668 - protein, 235 aa, Diabrotica virgifera
  misc_feature: Coding regions on vcDNA: vcDNA=SeqID_17365; Strand=-; Position=175-882
  misc_feature (1)..(59): Xaa can be any naturally occurring amino acid
  misc_feature (62)..(160): Xaa can be any naturally occurring amino acid
  misc_feature (163)..(170): Xaa can be any naturally occurring amino acid
  misc_feature (173)..(179): Xaa can be any naturally occurring amino acid
  misc_feature (184)..(195): Xaa can be any naturally occurring amino acid
  misc_feature (207)..(214): Xaa can be any naturally occurring amino acid
  misc_feature (221)..(228): Xaa can be any naturally occurring amino acid
XXXXXXXXXXXXXXXXXXXXXXXXXXXXXXXXXXXXXXXXXXXXXXXXXXXXXXXXXXXSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXXXXXXXXDNXXXXXXXDILLXXXXXXXXXXXXMILKNELPFRLXXXXXXXXFYFTDEXXXXXXXXEISKIMR

SEQ ID NO: 37669 - protein, 189 aa, Diabrotica virgifera
  misc_feature: Coding regions on vcDNA: vcDNA=SeqID_17366; Strand=+; Position=41-610
  misc_feature: Homolog annotation: Hit_ID=XP_392501.1; Match level="QueryCoverage =97%, HitCoverage=100%, E-value=7e-76, Identity=73%"; Hit description= similar to CG4696-PA [Apis mellifera]
  misc_feature: Gene Ontology Annotation: Molecular function=actin binding; Cellular component=intercellular junction; Biological process=cytoskeleton organization and biogenesis
  misc_feature: Pfam annotation: Pfam_ID=CH; Match level="Score=67.7, E-value=3.2e -17, Copies=1"; Pfam description=Calponin homology (CH) domain
  misc_feature (67)..(72): Xaa can be any naturally occurring amino acid
  misc_feature (149)..(154): Xaa can be any naturally occurring amino acid
MSLERQVRNKLAAKRDPQQDKEAQAWIETILGAKFPPGEAYEDVIRDGTVLCQLINKLAPGSVAKIXXXXXXFKMMENINNFQAAIKAYGVADIDVFQTVDLWEKKDIAQVTNTLFAIGRQTYKHPEWKGPYLGPKPADENKREFTEEXXXXXXTMIGLQAGQNKGASQAGQNMGAGRKIILGKFYTIF

SEQ ID NO: 37670 - protein, 57 aa, Diabrotica virgifera
  misc_feature: Coding regions on vcDNA: vcDNA=SeqID_17367; Strand=+; Position=591-761
EDLHHRELDDLLFPSVRADSVVSIFFAADGLCVNTLIAGHTHLWIVPFPPHNEQSLC

SEQ ID NO: 37671 - protein, 100 aa, Diabrotica virgifera; identical to SEQ ID NO: 30473
  misc_feature: Coding regions on vcDNA: vcDNA=SeqID_17368; Strand=-; Position=2-301
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(99): Xaa can be any naturally occurring amino acid

SEQ ID NO: 37672 - protein, 148 aa, Diabrotica virgifera
  misc_feature: Coding regions on vcDNA: vcDNA=SeqID_17369; Strand=+; Position=3-449
  misc_feature: Homolog annotation: Hit_ID=NP_525116.2; Match level="QueryCoverage =97%, HitCoverage=28%, E-value=5e-21, Identity=35%"; Hit description =CG10207-PA [Drosophila melanogaster] gb|AAF58199.1| CG10207-PA [Drosophila melanogaster]
  misc_feature: Gene Ontology Annotation: Molecular function=inorganic phosphate transporter activity; Cellular component=integral to membrane; Biological process=phosphate transport
  misc_feature (106)..(111): Xaa can be any naturally occurring amino acid
GLQGVFMLALAYSGCDKMTAIAMLSLAVAVNGAVSTGALATLVDISPNYSAILLGIVNSAVALVGFCTPAVVGFFTFQNQTTAQWQKVFWVCTVFLISTCLFFVLXXXXXXASWNNPVQSIPETEMMVITRDGDMNETEKITYNDESY

SEQ ID NO: 37673 - protein, 80 aa, Diabrotica virgifera
  misc_feature: Coding regions on vcDNA: vcDNA=SeqID_17370; Strand=+; Position=184-426
DKMLATYKKSENLLQNYNKTMKQRLVNNSCLRKLWTLIEKRTEVIALMHHRTSLCDFCKVEQREKLFSFIQNSPFSFSKI

SEQ ID NO: 37674 - protein, 294 aa, Diabrotica virgifera
  misc_feature: Coding regions on vcDNA: vcDNA=SeqID_17371; Strand=+; Position=2-886
  misc_feature (25)..(30): Xaa can be any naturally occurring amino acid
  misc_feature (54)..(64): Xaa can be any naturally occurring amino acid
  misc_feature (68)..(85): Xaa can be any naturally occurring amino acid
  misc_feature (90)..(103): Xaa can be any naturally occurring amino acid
  misc_feature (106)..(292): Xaa can be any naturally occurring amino acid
YGLGRYRGPGISQGSVPTVSPARGXXXXXXNLSSSSFSLSNFKTRSKEFKFVLXXXXXXXXXXXNETXXXXXXXXXXXXXXXXXXINNIXXXXXXXXXXXXXXLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGD

SEQ ID NO: 37675 - protein, 80 aa, Diabrotica virgifera
  misc_feature: Coding regions on vcDNA: vcDNA=SeqID_17372; Strand=+; Position=479-718
INSSLQEKDYIALIQAAIIQLSHLIITAFTASAQDTVSLCPLYMLTDRGRWLDLGQPMLTVFCSVMPRSLVYILYGVSLI

SEQ ID NO: 37676 - protein, 108 aa, Diabrotica virgifera; identical to SEQ ID NO: 27732
  misc_feature: Coding regions on vcDNA: vcDNA=SeqID_17373; Strand=+; Position=227-553
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37677 - protein, 51 aa, Diabrotica virgifera
  misc_feature: Coding regions on vcDNA: vcDNA=SeqID_17374; Strand=-; Position=352-507
SLYTGVNNGLSNPSIRLYRLLIIHSDCSCCGSTPLSVMLIFSLSLIARAVL

SEQ ID NO: 37678 - protein, 40 aa, Diabrotica virgifera
  misc_feature: Coding regions on vcDNA: vcDNA=SeqID_17375; Strand=+; Position=1-120
  misc_feature (13)..(19): Xaa can be any naturally occurring amino acid
IEESVLCFLAIVXXXXXXXKMREIVHIQAVQCGNQIGAKF

SEQ ID NO: 37679 - protein, 128 aa, Diabrotica virgifera
  misc_feature: Coding regions on vcDNA: vcDNA=SeqID_17376; Strand=-; Position=328-714
  misc_feature (71)..(82): Xaa can be any naturally occurring amino acid
LHFFPGKGLFREKLNFPDFLLLDQVRSQLIRIIAVLLYFYASSYKFIFLLFFYAVDFYRLTMIIFIEWNIXXXXXXXXXXXXPIKHLIDYSSMFYYKLNFVYSLILKIFFRKLKINIVILLEFFYIKY

SEQ ID NO: 37680 - protein, 99 aa, Diabrotica virgifera
  misc_feature: Coding regions on vcDNA: vcDNA=SeqID_17377; Strand=-; Position=91-390
  misc_feature (77)..(92): Xaa can be any naturally occurring amino acid
QLLPTTNSSRSSKRNTRFFRGGPIHPRKNCLAQKSICKSCDKKRHFAASRTRFAASRAVVRLPTYLKATITAPLQEXXXXXXXXXXXXXXXXTDSISIS

SEQ ID NO: 37681 - protein, 72 aa, Diabrotica virgifera
  misc_feature: Coding regions on vcDNA: vcDNA=SeqID_17378; Strand=+; Position=57-275
SSRRSNTGFMKIAFFDTSANFDNHRPDFLLPDNVNDPHEPYRLGYMSIMTLVYTVTPANNDMTYHILELKRD

SEQ ID NO: 37682 - protein, 93 aa, Diabrotica virgifera
  misc_feature: Coding regions on vcDNA: vcDNA=SeqID_17379; Strand=-; Position=264-545
LRISMVDFDPSGQKIVINKLIVYKALAHKLKENKRNVSNKICSVIKTKKKTFTKLKSNELELEIIVKLVHEYELRNNYFSKPYRSQLGFDECK

SEQ ID NO: 37683 - protein, 311 aa, Diabrotica virgifera
  misc_feature: Coding regions on vcDNA: vcDNA=SeqID_17380; Strand=+; Position=3-938
  misc_feature (120)..(145): Xaa can be any naturally occurring amino acid
  misc_feature (159)..(163): Xaa can be any naturally occurring amino acid
  misc_feature (300)..(300): Xaa can be any naturally occurring amino acid
KTSSSHSYGKDNYPVEPVVESNSKIVTTEHIDKPVEIIKVTSSGQPVTKDKTIDVTNENRDVSVSGGSKTTKTTITKTVHTSGQSADKNENEGASRVITTQKNNKHVDSGNTDEFVHEDXXXXXXXXXXXXXXXXXXXXXXXXXXKDSDILHKGSLDIXXXXXKDKDQDTVSKTTGSNIVKTTITKTSHSTDQVKEPSKSVKKTEVHEEDDMNSKENNGSKVTKTSQSGGTKTITTKITKTSSSSHSDENSSDLGGAATGIKTTITQTVHTSGQSTGKNENDGASKVITTQQINNHLDSXNTDELSTKIRL

SEQ ID NO: 37684 - protein, 23 aa, Diabrotica virgifera
  misc_feature: Coding regions on vcDNA: vcDNA=SeqID_17381; Strand=-; Position=1-69
  misc_feature (3)..(23): Xaa can be any naturally occurring amino acid
EVXXXXXXXXXXXXXXXXXXXXX

SEQ ID NO: 37685 - protein, 308 aa, Diabrotica virgifera
  misc_feature: Coding regions on vcDNA: vcDNA=SeqID_17382; Strand=+; Position=50-972
  misc_feature: Homolog annotation: Hit_ID=EAL29049.1; Match level="QueryCoverage =98%, HitCoverage=85%, E-value=8e-68, Identity=43%"; Hit description =GA18116-PA [Drosophila pseudoobscura]
  misc_feature: Pfam annotation: Pfam_ID=Zip; Match level="Score=124.9, E-value=2e -34, Copies=1"; Pfam description=ZIP Zinc transporter
  misc_feature (267)..(268): Xaa can be any naturally occurring amino acid
  misc_feature (295)..(295): Xaa can be any naturally occurring amino acid
MNLSQSKLFSAIILGVSSLFVGVVPNCFAQQGRRRWPLFISSLLCFGAGVLLATSVVHILPEVRESIPVQYENYAEILYCCGFFILYIIDEIVHYFYGDSEEANLFHNHGNNHDHHRRQSQQLKSSYGTAERHNLLHAESAPYNPSFYRTRSDSALFGDQQPSQLCHVGHQEPCHNAPTANFGLIVALSIHELLEGLVVGLETKPEKVLLLLGAVASHKLVISFCLGVELSSTPLISCTRHFIYILIFSVGSAAGIIAGMIVSDVPXXFKNVAMPILQALAGGTLLYVTVSEVYXSRKTRWHQQHDRK

SEQ ID NO: 37686 - protein, 68 aa, Diabrotica virgifera
  misc_feature: Coding regions on vcDNA: vcDNA=SeqID_17383; Strand=-; Position=1-204
  misc_feature (3)..(13): Xaa can be any naturally occurring amino acid
  misc_feature (38)..(47): Xaa can be any naturally occurring amino acid
  misc_feature (54)..(66): Xaa can be any naturally occurring amino acid
PFXXXXXXXXXXXTNLGSHRVKTQSHNDKFKSRTDLIXXXXXXXXXXIQHRGRXXXXXXXXXXXXXLL

SEQ ID NO: 37687 - protein, 275 aa, Diabrotica virgifera
  misc_feature: Coding regions on vcDNA: vcDNA=SeqID_17384; Strand=+; Position=2-829
  misc_feature (1)..(268): Xaa can be any naturally occurring amino acid
  misc_feature (271)..(271): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYLXYKFI

SEQ ID NO: 37688 - protein, 38 aa, Diabrotica virgifera
  misc_feature: Coding regions on vcDNA: vcDNA=SeqID_17385; Strand=+; Position=2-118
ACSYFLEEDPLPEPLPEDVIYIRAVTDQETKPKYVASN

SEQ ID NO: 37689 - protein, 101 aa, Diabrotica virgifera; identical to SEQ ID NO: 29675
  misc_feature: Coding regions on vcDNA: vcDNA=SeqID_17386; Strand=-; Position=205-510
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 37690 - protein, 63 aa, Diabrotica virgifera
  misc_feature: Coding regions on vcDNA: vcDNA=SeqID_17387; Strand=+; Position=106-297
  misc_feature (4)..(11): Xaa can be any naturally occurring amino acid
  misc_feature (31)..(40): Xaa can be any naturally occurring amino acid
PVLXXXXXXXXRTTLNNYYETKGYSPLYITXXXXXXXXXXNTDICIIECFDVIIIKLFLVYDY

SEQ ID NO: 37691 - protein, 223 aa, Diabrotica virgifera
  misc_feature: Coding regions on vcDNA: vcDNA=SeqID_17388; Strand=+; Position=1-672
  misc_feature: Homolog annotation: Hit_ID=XP_416885.1; Match level="QueryCoverage =73%, HitCoverage=10%, E-value=5e-11, Identity=27%"; Hit description =PREDICTED: similar to RW1 protein [Gallus gallus]
  misc_feature: Gene Ontology Annotation: Cellular component=integral to membrane
LKLQYYNIRLPPARETEEQGDQCVDVGTIIVDWKTAYETKDFSGKITVSYRNGKNKSEIPYHMTILKGGLTYDPLTTTYFINDKTVDLSARSFKVKNEFDEYIYVADVIFPRDIHHYFKIQSLWPKVIKPGDENIRLSDLQLQSFILLKTNISHVRSLEIGLLGFNTKKEVYFMIVNHNPVTLNVKHVHSSIPMTHADILGCGSGDFRLGVVFSFVSESHQMP

SEQ ID NO: 37692 - protein, 22 aa, Diabrotica virgifera
  misc_feature: Coding regions on vcDNA: vcDNA=SeqID_17389; Strand=-; Position=1-66
  misc_feature (3)..(19): Xaa can be any naturally occurring amino acid
SSXXXXXXXXXXXXXXXXXPRS

SEQ ID NO: 37693 - protein, 246 aa, Diabrotica virgifera
  misc_feature: Coding regions on vcDNA: vcDNA=SeqID_17390; Strand=+; Position=95-832
  misc_feature (23)..(35): Xaa can be any naturally occurring amino acid
  misc_feature (37)..(47): Xaa can be any naturally occurring amino acid
  misc_feature (50)..(243): Xaa can be any naturally occurring amino acid
KKNFSSSYLGYQGFLINNSIFLXXXXXXXXXXXXXIXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRK

SEQ ID NO: 37694 - protein, 254 aa, Diabrotica virgifera
  misc_feature: Coding regions on vcDNA: vcDNA=SeqID_17391; Strand=+; Position=120-880
  misc_feature: Homolog annotation: Hit_ID=XP_395309.1; Match level="QueryCoverage =96%, HitCoverage=45%, E-value=1e-117, Identity=85%"; Hit description= similar to DNop5 protein [Apis mellifera]
  misc_feature: Gene Ontology Annotation: Molecular function=snoRNP binding; Cellular component=nucleolus; Biological process=snRNP protein-nucleus import
  misc_feature: Pfam annotation: Pfam_ID=Nop; Match level="Score=107.5, E-value=3.2e -29, Copies=1"; Pfam description=Putative snoRNA binding domain
  misc_feature (15)..(15): Xaa can be any naturally occurring amino acid
  misc_feature (228)..(228): Xaa can be any naturally occurring amino acid
  misc_feature (233)..(233): Xaa can be any naturally occurring amino acid
  misc_feature (240)..(240): Xaa can be any naturally occurring amino acid
LLSKILIKDKFSLQXLSNSAVQELMRCIRSQLDSLLSGLPKKEMTGMALGLAHSLSRYKLKFSPDKVDTMIVQAVSLLDDLDKELNNYIMRCREWYGWHFPELGKIITDNVAFAKTVKIIGTRENTATSDLSDILPEEVEEKVKEAAEISMGTEISEEDIFNIQNLCDQILDLSNYRAQLYDYLKARMDGIAPNLTGLVGELVGARLISHGGSLINLAKHPASTVQIXLGAEXALFRALXTKKDTPKYGLIYIH

SEQ ID NO: 37695 - protein, 195 aa, Diabrotica virgifera
  misc_feature: Coding regions on vcDNA: vcDNA=SeqID_17392; Strand=+; Position=90-674
  misc_feature (26)..(42): Xaa can be any naturally occurring amino acid
  misc_feature (48)..(59): Xaa can be any naturally occurring amino acid
  misc_feature (65)..(114): Xaa can be any naturally occurring amino acid
  misc_feature (120)..(127): Xaa can be any naturally occurring amino acid
  misc_feature (129)..(147): Xaa can be any naturally occurring amino acid
  misc_feature (157)..(165): Xaa can be any naturally occurring amino acid
  misc_feature (180)..(190): Xaa can be any naturally occurring amino acid
PCARRILLYLINRKQFIFCVPCCIRXXXXXXXXXXXXXXXXXNKLQFXXXXXXXXXXXXNEMIFXXXXXXXXXXXXXXXXXXXXXXXXXXXXXXXXXXXXXXXXXXXXXXXXXXKNYDYXXXXXXXXYXXXXXXXXXXXXXXXXXXXTSHHHKCTNXXXXXXXXXHIQYKYIGLIQELIXXXXXXXXXXXLYVLT

SEQ ID NO: 37696 - protein, 179 aa, Diabrotica virgifera
  misc_feature: Coding regions on vcDNA: vcDNA=SeqID_17393; Strand=-; Position=2-538
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(179): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37697 - protein, 64 aa, Diabrotica virgifera
  misc_feature: Coding regions on vcDNA: vcDNA=SeqID_17394; Strand=-; Position=447-641
VLREHGLNTRPIQILQGAGQSISLYQQLHVFCVLQRVYAGQSAFISVHFCSIPAANHSVFSSSS

SEQ ID NO: 37698 - protein, 54 aa, Diabrotica virgifera
  misc_feature: Coding regions on vcDNA: vcDNA=SeqID_17395; Strand=-; Position=142-306
LSGPSSQEGISQKRTPYTYQYNLFDNLRFRYKSYMFRQKKKDKILKISFRFHNP

SEQ ID NO: 37699 - protein, 170 aa, Diabrotica virgifera
  misc_feature: Coding regions on vcDNA: vcDNA=SeqID_17396; Strand=+; Position=2-514
  misc_feature (6)..(26): Xaa can be any naturally occurring amino acid
  misc_feature (31)..(43): Xaa can be any naturally occurring amino acid
  misc_feature (48)..(83): Xaa can be any naturally occurring amino acid
  misc_feature (85)..(139): Xaa can be any naturally occurring amino acid
  misc_feature (153)..(168): Xaa can be any naturally occurring amino acid
PLKPRXXXXXXXXXXXXXXXXXXXXXRRERXXXXXXXXXXXXXKERKXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXGLKSLIFKNMILLXXXXXXXXXXXXXXXXVI

SEQ ID NO: 37700 - protein, 167 aa, Diabrotica virgifera
  misc_feature: Coding regions on vcDNA: vcDNA=SeqID_17397; Strand=+; Position=1-504
  misc_feature (1)..(58): Xaa can be any naturally occurring amino acid
  misc_feature (64)..(74): Xaa can be any naturally occurring amino acid
  misc_feature (134)..(140): Xaa can be any naturally occurring amino acid
  misc_feature (151)..(159): Xaa can be any naturally occurring amino acid
XXXXXXXXXXXXXXXXXXXXXXXXXXXXXXXXXXXXXXXXXXXXXXXXXXXXXXXXXXMNCYSXXXXXXXXXXXLKILITKILIIKYFYLLLINTSLGMSLQTIFYKHLLFKQDLGLKCFIYYKNILLYFNILXXXXXXXVFIQNKLIHDXXXXXXXXXPYYKLVIL

SEQ ID NO: 37701 - protein, 149 aa, Diabrotica virgifera
  misc_feature: Coding regions on vcDNA: vcDNA=SeqID_17398; Strand=-; Position=1-447
  misc_feature (17)..(30): Xaa can be any naturally occurring amino acid
  misc_feature (35)..(133): Xaa can be any naturally occurring amino acid
  misc_feature (139)..(149): Xaa can be any naturally occurring amino acid
IITYFKIRKFLDLYFFXXXXXXXXXXXXXXHKQYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFFTSXXXXXXXXXXX

SEQ ID NO: 37702 - protein, 74 aa, Diabrotica virgifera
  misc_feature: Coding regions on vcDNA: vcDNA=SeqID_17399; Strand=+; Position=511-735
LLLPFLEPASTYSLTYSLTEVRLRNDCYARKITLSSSRYMPTASYGLPMYNHSTERTLCLYRSLTRQTTIVTSK

SEQ ID NO: 37703 - protein, 77 aa, Diabrotica virgifera
  misc_feature: Coding regions on vcDNA: vcDNA=SeqID_17400; Strand=-; Position=182-415
QFSYLSLIVSFSYKHPSSSFVIVMVVVIQFCGHVVSFYSTFTIGYIYSSFRNVTVYYSVSMLVEIMNMHHSLNSFYS

SEQ ID NO: 37704 - protein, 61 aa, Diabrotica virgifera
  misc_feature: Coding regions on vcDNA: vcDNA=SeqID_17401; Strand=-; Position=35-220
FEVVRRCIEVDFVIFCVSEQVFVVGVKIDYCLYHDIMLRQHERRKISMRRITSVLSISYFR

SEQ ID NO: 37705 - protein, 94 aa, Diabrotica virgifera
  misc_feature: Coding regions on vcDNA: vcDNA=SeqID_17402; Strand=-; Position=485-769
  misc_feature (15)..(15): Xaa can be any naturally occurring amino acid
FLLEYMCKPTNLDAXGININGQQLSHLRFADDIVLITDKGSTMHHASTEVGLKINNSKTQVMTNLILSENFNITDTSIEHQQKNIWAQNSLKYR

SEQ ID NO: 37706 - protein, 143 aa, Diabrotica virgifera
  misc_feature: Coding regions on vcDNA: vcDNA=SeqID_17403; Strand=+; Position=167-599
  misc_feature: Homolog annotation: Hit_ID=AAA56741.1; Match level="QueryCoverage =99%, HitCoverage=74%, E-value=6e-29, Identity=52%"; Hit description =lacZ alpha peptide
  misc_feature (17)..(17): Xaa can be any naturally occurring amino acid
  misc_feature (36)..(36): Xaa can be any naturally occurring amino acid
  misc_feature (54)..(54): Xaa can be any naturally occurring amino acid
  misc_feature (68)..(68): Xaa can be any naturally occurring amino acid
  misc_feature (120)..(120): Xaa can be any naturally occurring amino acid
DLYSIHCVVVLQRSDRXKPDLTQLKRLAEHPPFVSXGVTSEHDLLTIDPSQQVXSQNGECDATSSGAXSAARVEVTRTATAKLASDQQPDPFSFFPSNLDTLGAFPREDLNSRLPYRVMXSALLNHDPRKIEQVEGSRSGPTH

SEQ ID NO: 37707 - protein, 65 aa, Diabrotica virgifera
  misc_feature: Coding regions on vcDNA: vcDNA=SeqID_17404; Strand=+; Position=375-572
YIIRYTQDSTHSKHEYIHQDLICMLPIIQYALSYDITHIMEIRSRLPYLFYRPLINVVFLNLCNE

SEQ ID NO: 37708 - protein, 284 aa, Diabrotica virgifera
  misc_feature: Coding regions on vcDNA: vcDNA=SeqID_17405; Strand=+; Position=68-922
  misc_feature: Homolog annotation: Hit_ID=EAL28478.1; Match level="QueryCoverage =83%, HitCoverage=59%, E-value=2e-56, Identity=43%"; Hit description =GA14973-PA [Drosophila pseudoobscura]
  misc_feature: Gene Ontology Annotation: Molecular function=serine protease inhibitor activity; Cellular component=cytoplasm; Biological process= regulation of proteolysis and peptidolysis
  misc_feature: Pfam annotation: Pfam_ID=Serpin; Match level="Score=20.5, E-value =1.2e-11, Copies=1"; Pfam description=Serpin (serine protease inhibitor)
  misc_feature (271)..(271): Xaa can be any naturally occurring amino acid
MKITLVIALLVAALFKESLQQCFPPFTGNQPSQKAAPDLYSGQQDFSLALLNAVNKVIPNENLFFSPYSTYHALLMAYFLSGRQTESYLKKVLRLNQAQEKADIYAAYKVDKFVTQLLAKSAPYEFTSANKIYVENEVPVRECVLNDFPSELEMKDFKSSPEAARQQINHWVENVTHNMIKDLIPPGTIDSSTNLVLVNAAYFKGLWENKFPPEYTKQEVFYVSPTKQIMVDMMHVEGTFKHDVSESLRAHILEMPYKGDNISMYILLPPXSTTENSIEATLKN

SEQ ID NO: 37709 - protein, 285 aa, Diabrotica virgifera
  misc_feature: Coding regions on vcDNA: vcDNA=SeqID_17406; Strand=-; Position=1-855
  misc_feature (1)..(263): Xaa can be any naturally occurring amino acid
  misc_feature (265)..(285): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXX

SEQ ID NO: 37710 - protein, 302 aa, Diabrotica virgifera
  misc_feature: Coding regions on vcDNA: vcDNA=SeqID_17407; Strand=-; Position=2-907
  misc_feature (3)..(3): Xaa can be any naturally occurring amino acid
  misc_feature (6)..(302): Xaa can be any naturally occurring amino acid
LNXFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37711 - protein, 22 aa, Diabrotica virgifera
  misc_feature: Coding regions on vcDNA: vcDNA=SeqID_17408; Strand=-; Position=29-97
ILNYNHLNFKHCLKLQKCMNFN

SEQ ID NO: 37712 - protein, 142 aa, Diabrotica virgifera
  misc_feature: Coding regions on vcDNA: vcDNA=SeqID_17409; Strand=+; Position=88-516
GFKKMVEKPLNIRDTSVQGSLHLRSSSKYQWWPSVLHGGRDSKPNNSEEHSRELTSIRSPMVNRANPFLTNNMRLLSISNRHLIIGFQNNFQLSVGPAAITKRLGRRILIQKINQHIFLGQKNQGGHSGVKNSFSRHNFHSR

SEQ ID NO: 37713 - protein, 305 aa, Diabrotica virgifera
  misc_feature: Coding regions on vcDNA: vcDNA=SeqID_17410; Strand=+; Position=6-922
  misc_feature: Homolog annotation: Hit_ID=XP_314216.1; Match level="QueryCoverage =98%, HitCoverage=29%, E-value=1e-118, Identity=66%"; Hit description= ENSANGP00000014378 [Anopheles gambiae]
  misc_feature: Gene Ontology Annotation: Molecular function=glycine dehydrogenase (decarboxylating) activity; Cellular component=mitochondrion; Biological process=one-carbon compound metabolism
  misc_feature: Pfam annotation: Pfam_ID=GDC-P; Match level="Score=-168.1, E-value =2.4e-09, Copies=1"; Pfam description=Glycine cleavage system P -protein
  misc_feature (46)..(46): Xaa can be any naturally occurring amino acid
  misc_feature (289)..(289): Xaa can be any naturally occurring amino acid
LEIAAGRDGYRLALQTREQHIRRDKATSNICTAQALLANMSAMFAXYHGPQGLKDIATKIHNLTLVLHHGLHQDGNTLSNKLFFDTLKIYPKLDVEEVKTRAQEKKINYRYYDDGAVGVALDETVTFNDVNDIFYTFGCPQKVENIVNSPMIRERAIYRSEYKRTSPFLTHPVFNSHHSETRIVRYMKILENKDISLVHSMIPLGSCTMKLNSTTEMMPCSFKHFTDIHPFAPTEQCQGYHQLFEELEQDLCTITGYDKISFQPNSGAQGEYAGLRAIQCYHEAKGEAXRDVCLISISAHGTNPA

SEQ ID NO: 37714 - protein, 189 aa, Diabrotica virgifera
  misc_feature: Coding regions on vcDNA: vcDNA=SeqID_17411; Strand=-; Position=336-905
  misc_feature (1)..(32): Xaa can be any naturally occurring amino acid
  misc_feature (35)..(54): Xaa can be any naturally occurring amino acid
  misc_feature (59)..(68): Xaa can be any naturally occurring amino acid
  misc_feature (70)..(105): Xaa can be any naturally occurring amino acid
  misc_feature (108)..(137): Xaa can be any naturally occurring amino acid
  misc_feature (142)..(167): Xaa can be any naturally occurring amino acid
XXXXXXXXXXXXXXXXXXXXXXXXXXXXXXXXIPXXXXXXXXXXXXXXXXXXXXFQINXXXXXXXXXXPXXXXXXXXXXXXXXXXXXXXXXXXXXXXXXXXXXXXSLXXXXXXXXXXXXXXXXXXXXXXXXXXXXXXLFLKXXXXXXXXXXXXXXXXXXXXXXXXXXASIPMRKCILNYLEKDEKIILI

SEQ ID NO: 37715 - protein, 283 aa, Diabrotica virgifera
  misc_feature: Coding regions on vcDNA: vcDNA=SeqID_17412; Strand=-; Position=1-849
  misc_feature (4)..(283): Xaa can be any naturally occurring amino acid
LNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37716 - protein, 81 aa, Diabrotica virgifera
  misc_feature: Coding regions on vcDNA: vcDNA=SeqID_17413; Strand=+; Position=291-536
SLHILNMNFVYSSKHHITHDAVLSRLLYKISYLLRITILEMVTEPSSILKLIIRNQDTNNCLGSIYTSVTMCFMYSLAATS

SEQ ID NO: 37717 - protein, 259 aa, Diabrotica virgifera
  misc_feature: Coding regions on vcDNA: vcDNA=SeqID_17414; Strand=-; Position=1-777
  misc_feature (2)..(60): Xaa can be any naturally occurring amino acid
  misc_feature (63)..(200): Xaa can be any naturally occurring amino acid
  misc_feature (203)..(214): Xaa can be any naturally occurring amino acid
  misc_feature (216)..(228): Xaa can be any naturally occurring amino acid
  misc_feature (232)..(241): Xaa can be any naturally occurring amino acid
  misc_feature (244)..(252): Xaa can be any naturally occurring amino acid
  misc_feature (254)..(259): Xaa can be any naturally occurring amino acid
LXXXXXXXXXXXXXXXXXXXXXXXXXXXXXXXXXXXXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFXXXXXXXXXXXXRXXXXXXXXXXXXXRNVXXXXXXXXXXEVXXXXXXXXXKXXXXXX

SEQ ID NO: 37718 - protein, 249 aa, Diabrotica virgifera
  misc_feature: Coding regions on vcDNA: vcDNA=SeqID_17415; Strand=-; Position=1-826
  misc_feature: Homolog annotation: Hit_ID=XP_307274.1; Match level="QueryCoverage =95%, HitCoverage=53%, E-value=9e-32, Identity=33%"; Hit description =ENSANGP00000023005 [Anopheles gambiae]
  misc_feature (49)..(49): Xaa can be any naturally occurring amino acid
  misc_feature (225)..(225): Xaa can be any naturally occurring amino acid
DKETVCRRQTTLFNIALEGVISDTGLKKTIIQSSTQIIGYADDLGLVAXEIKRLEEALLTLVREAKTRGLIINQNKTKYLISKRDNVNRITEIKIGENTFQRIDCFKYLGVMVDGKNGRSIEINERIKAAIRSVIAYGAEVMCLTKKDEEKLRIIERKIMKRIHGPVKTETGEYRKLMNHEVININKGEDIVKLIKAQRLRWFGHTQRRGVEELIRKIMNWKPVXKSRRGRPKKTWGETIRQDMLVKGI

SEQ ID NO: 37719 - protein, 108 aa, Diabrotica virgifera; identical to SEQ ID NO: 27732
  misc_feature: Coding regions on vcDNA: vcDNA=SeqID_17416; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37720 - protein, 288 aa, Diabrotica virgifera
  misc_feature: Coding regions on vcDNA: vcDNA=SeqID_17417; Strand=-; Position=1-864
  misc_feature (2)..(9): Xaa can be any naturally occurring amino acid
  misc_feature (11)..(224): Xaa can be any naturally occurring amino acid
  misc_feature (227)..(265): Xaa can be any naturally occurring amino acid
  misc_feature (268)..(275): Xaa can be any naturally occurring amino acid
  misc_feature (277)..(288): Xaa can be any naturally occurring amino acid
SXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXRYXXXXXXXXKXXXXXXXXXXXX

SEQ ID NO: 37721 - protein, 93 aa, Diabrotica virgifera
  misc_feature: Coding regions on vcDNA: vcDNA=SeqID_17418; Strand=-; Position=31-312
PRIHIFEFRHCDLRTASAFNIHHCCQQLDVDVVKYRFKSLSTESSFRENVLAVVKFILLHVDINSKSTYFIFNHQLIITLFLFIQMTVGFFTY

SEQ ID NO: 37722 - protein, 300 aa, Diabrotica virgifera
  misc_feature: Coding regions on vcDNA: vcDNA=SeqID_17419; Strand=+; Position=1-900
  misc_feature: Homolog annotation: Hit_ID=XP_308743.1; Match level="QueryCoverage =94%, HitCoverage=53%, E-value=3e-47, Identity=37%"; Hit description =ENSANGP00000015016 [Anopheles gambiae]
  misc_feature (215)..(223): Xaa can be any naturally occurring amino acid
  misc_feature (275)..(275): Xaa can be any naturally occurring amino acid
  misc_feature (284)..(284): Xaa can be any naturally occurring amino acid
  misc_feature (293)..(293): Xaa can be any naturally occurring amino acid
KAHLLLIFALKIICNVGGYEVLVVFPSPVPSHYILGNALARGLANAGHSVTMVSPYEEKDPPKNGSYKDVVLTGIFDMMRELNPPQWMEFGAMNPVEIIYRTHAPGHATTNFTLRHPNFQKLLNSGQNFDVIILEQFVNDALKALGCHFNAPVIPLSTCTPSMWVNLPAGNPEVPSYMPDLYQDFPTKMNIWQRGMNSLFIVARRILNDFVFLPXXXXXXXXXFPHCAKGREFYYNVSLTLVNHHETINGARPFVPSMVAIAGFHLNPPKKLPNXMQTFLDEAXEGVIYFSLXTNVNPSS

SEQ ID NO: 37723 - protein, 138 aa, Diabrotica virgifera
  misc_feature: Coding regions on vcDNA: vcDNA=SeqID_17420; Strand=+; Position=484-897
  misc_feature (4)..(30): Xaa can be any naturally occurring amino acid
  misc_feature (39)..(62): Xaa can be any naturally occurring amino acid
  misc_feature (66)..(110): Xaa can be any naturally occurring amino acid
  misc_feature (114)..(136): Xaa can be any naturally occurring amino acid
GWRXXXXXXXXXXXXXXXXXXXXXXXXXXXGINLNLLIXXXXXXXXXXXXXXXXXXXXXXXXVMDXXXXXXXXXXXXXXXXXXXXXXXXXXXXXXXXXXXXXXXXXXXXXPLDXXXXXXXXXXXXXXXXXXXXXXXGM

SEQ ID NO: 37724 - protein, 65 aa, Diabrotica virgifera
  misc_feature: Coding regions on vcDNA: vcDNA=SeqID_17421; Strand=-; Position=249-446
EIPLTMKKDNTHTLKWGHSILSNNFPFPTIIFFDYIRHTYAIDVKKDISFQRLKFVLDFYRRKNF

SEQ ID NO: 37725 - protein, 170 aa, Diabrotica virgifera
  misc_feature: Coding regions on vcDNA: vcDNA=SeqID_17422; Strand=+; Position=127-639
  misc_feature: Homolog annotation: Hit_ID=XP_319323.1; Match level="QueryCoverage =97%, HitCoverage=14%, E-value=6e-46, Identity=60%"; Hit description =ENSANGP00000012364 [Anopheles gambiae]
  misc_feature: Gene Ontology Annotation: Molecular function=ATP citrate synthase activity; Cellular component=citrate lyase complex; Biological process=ATP catabolism
  misc_feature (9)..(9): Xaa can be any naturally occurring amino acid
  misc_feature (21)..(21): Xaa can be any naturally occurring amino acid
  misc_feature (118)..(118): Xaa can be any naturally occurring amino acid
  misc_feature (123)..(123): Xaa can be any naturally occurring amino acid
  misc_feature (140)..(140): Xaa can be any naturally occurring amino acid
KMSAKAIRXATGKHLINKYLXSGTHAAVQCRFASVEADTKFSELVSNNPCLITEKLVVKPDQLIKSRGKLRLISVNKDLNTVVDCVNERMNQNHQVDNATGKLRYFIIEPFVPHKQEXEAYVXIYSHRLADTILFYLEGXVDIDDDDCNALILHVLCCRDLRTLELFLNI

SEQ ID NO: 37726 - protein, 118 aa, Diabrotica virgifera
  misc_feature: Coding regions on vcDNA: vcDNA=SeqID_17423; Strand=-; Position=330-686
  misc_feature (53)..(61): Xaa can be any naturally occurring amino acid
  misc_feature (66)..(83): Xaa can be any naturally occurring amino acid
  misc_feature (97)..(107): Xaa can be any naturally occurring amino acid
LCSLTPVKIPRLFKLSMAGRTFIFIPKNLFLLPVKKMFRIPFINLLLFFTNYXXXXXXXXXIFTRXXXXXXXXXXXXXXXXXXEIRLDFLKVRLLTXXXXXXXXXXXIPMNFFILEEI

SEQ ID NO: 37727 - protein, 90 aa, Diabrotica virgifera
  misc_feature: Coding regions on vcDNA: vcDNA=SeqID_17424; Strand=+; Position=27-299
  misc_feature (69)..(76): Xaa can be any naturally occurring amino acid
FSKIYRKIPNTTPHGSGVGGYFKILNGSPHFLLQIWILCIKIGNFYSKHFFELWIDGAIIGKNDCWKRXXXXXXXXSPPKWKILLFRFRT

SEQ ID NO: 37728 - protein, 215 aa, Diabrotica virgifera
  misc_feature: Coding regions on vcDNA: vcDNA=SeqID_17425; Strand=+; Position=132-779
  misc_feature: Homolog annotation: Hit_ID=AAR87046.1; Match level="QueryCoverage =96%, HitCoverage=96%, E-value=2e-68, Identity=59%"; Hit description =cytochrome b [Paleoacanthoscelides gilvus]
  misc_feature: Pfam annotation: Pfam_ID=Cytochrom_B_N; Match level="Score=145.1, E -value=1.6e-40, Copies=1"; Pfam description=Cytochrome b(N -terminal)/b6/petB
  misc_feature (33)..(33): Xaa can be any naturally occurring amino acid
  misc_feature (40)..(40): Xaa can be any naturally occurring amino acid
  misc_feature (80)..(85): Xaa can be any naturally occurring amino acid
  misc_feature (118)..(118): Xaa can be any naturally occurring amino acid
  misc_feature (128)..(128): Xaa can be any naturally occurring amino acid
  misc_feature (136)..(136): Xaa can be any naturally occurring amino acid
DSRLGIQILTGLFFAIHYRPNVELAFNRVAHNXRDVNYRXLLRTLHANGASFFFLRLYIHIGRGIYYRSYNIIETRIIGXXXXXXTIATAFLGYVLPRGQISFRGATVITNLISAIPXLGNILVQWNXGGLAVDNXATLTRFFQTGSRNPLIKFHFILILLLKISLVFTLTLKDPYLLGDPDNFTPANPLVTPVHIQPYAILRSNSNKLGGVIAL

SEQ ID NO: 37729 - protein, 178 aa, Diabrotica virgifera
  misc_feature: Coding regions on vcDNA: vcDNA=SeqID_17426; Strand=+; Position=204-737
  misc_feature (12)..(19): Xaa can be any naturally occurring amino acid
  misc_feature (22)..(30): Xaa can be any naturally occurring amino acid
  misc_feature (46)..(176): Xaa can be any naturally occurring amino acid
SHHNLTNPRILXXXXXXXXPIXXXXXXXXXPRNETLFVFQISSNFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPL

SEQ ID NO: 37730 - protein, 285 aa, Diabrotica virgifera
  misc_feature: Coding regions on vcDNA: vcDNA=SeqID_17427; Strand=+; Position=1-856
  misc_feature: Homolog annotation: Hit_ID=XP_312532.1; Match level="QueryCoverage =92%, HitCoverage=52%, E-value=2e-58, Identity=43%"; Hit description =ENSANGP00000014254 [Anopheles gambiae]
  misc_feature: Gene Ontology Annotation: Molecular function=monooxygenase activity; Cellular component=extracellular space; Biological process =leukotriene metabolism
  misc_feature: Pfam annotation: Pfam_ID=p450; Match level="Score=-100.4, E-value =1.2e-06, Copies=1"; Pfam description=Cytochrome P450
  misc_feature (41)..(41): Xaa can be any naturally occurring amino acid
  misc_feature (65)..(72): Xaa can be any naturally occurring amino acid
  misc_feature (274)..(274): Xaa can be any naturally occurring amino acid
VGPTIDAVIRADVKFAEFILTSSKAMKKSSVYGFLHGWLGXGLLTSTGTKWKQHRRMLTPTFHFXXXXXXXXIFDRVGDIFIRTLKQQVNTASLNVFPLVTLCTLDIISEAAMGIQINAQESQTSEYVKSVNTMCNIFIGRVTSPIPHFLYRLTPTYYRERKAIRILHDQTDKIIDIKMEERSKNANNQQDQSNQQDQSTRKRLAFLDLLLESSIDSKPLSRLDIREEVDTFMFAGHDTTATAISFALYCLAMNPNAQEQAFIEQTEMFGKNLXTAKPTIHQLQE

SEQ ID NO: 37731 - protein, 101 aa, Diabrotica virgifera
  misc_feature: Coding regions on vcDNA: vcDNA=SeqID_17428; Strand=+; Position=357-657
  misc_feature: Homolog annotation: Hit_ID=P53466; Match level="QueryCoverage=100%, HitCoverage=26%, E-value=2e-15, Identity=45%"; Hit description =Actin, cytoskeletal 2 (LPC2) gb|AAA53364.1| cytoskeletal actin
  misc_feature: Gene Ontology Annotation: Cellular component=actin filament; Biological process=embryogenesis and morphogenesis
  misc_feature (20)..(20): Xaa can be any naturally occurring amino acid
  misc_feature (57)..(57): Xaa can be any naturally occurring amino acid
  misc_feature (67)..(67): Xaa can be any naturally occurring amino acid
QRPELITEIPLSPKDIKEIXAQSMADTSRSPSWYVVSQVVTTLDASDRATSIEFCPXSRGAHIVPNXYGSDLPHVIRNLDTPGHDLPEYLKNMRNERGYTF

SEQ ID NO: 37732 - protein, 61 aa, Diabrotica virgifera
  misc_feature: Coding regions on vcDNA: vcDNA=SeqID_17429; Strand=+; Position=122-307
  misc_feature (9)..(15): Xaa can be any naturally occurring amino acid
LYSSIKVLXXXXXXXSRKCFIVCFFVMKCYWGFYVCQYLKDKLYIFINTIFLIGDLYMITI

SEQ ID NO: 37733 - protein, 173 aa, Diabrotica virgifera
  misc_feature: Coding regions on vcDNA: vcDNA=SeqID_17430; Strand=+; Position=190-711
  misc_feature (1)..(19): Xaa can be any naturally occurring amino acid
  misc_feature (21)..(32): Xaa can be any naturally occurring amino acid
  misc_feature (34)..(58): Xaa can be any naturally occurring amino acid
  misc_feature (71)..(103): Xaa can be any naturally occurring amino acid
  misc_feature (115)..(126): Xaa can be any naturally occurring amino acid
  misc_feature (129)..(139): Xaa can be any naturally occurring amino acid
  misc_feature (153)..(166): Xaa can be any naturally occurring amino acid
XXXXXXXXXXXXXXXXXXXAXXXXXXXXXXXXTXXXXXXXXXXXXXXXXXXXXXXXXXLNNKILLTFTFYXXXXXXXXXXXXXXXXXXXXXXXXXXXXXXXXXKCNLFNFSNDDXXXXXXXXXXXXHIXXXXXXXXXXXACSLDTCLFLSHMXXXXXXXXXXXXXXFDRAKPP

SEQ ID NO: 37734 - protein, 93 aa, Diabrotica virgifera
  misc_feature: Coding regions on vcDNA: vcDNA=SeqID_17431; Strand=+; Position=1-282
  misc_feature (73)..(73): Xaa can be any naturally occurring amino acid
FLLGWNKYEQNSVVSGSPGRTRNQSQNSVGKQPFVAGNGNITTNSQGMEWEHLSGIRGNSSVVKEFSSPNTNXPKPIFIRYSGWDGEPVRVEE

SEQ ID NO: 37735 - protein, 107 aa, Diabrotica virgifera
  misc_feature: Coding regions on vcDNA: vcDNA=SeqID_17432; Strand=-; Position=571-894
  misc_feature (4)..(24): Xaa can be any naturally occurring amino acid
  misc_feature (27)..(34): Xaa can be any naturally occurring amino acid
  misc_feature (38)..(45): Xaa can be any naturally occurring amino acid
  misc_feature (52)..(75): Xaa can be any naturally occurring amino acid
  misc_feature (82)..(88): Xaa can be any naturally occurring amino acid
  misc_feature (91)..(97): Xaa can be any naturally occurring amino acid
AFNXXXXXXXXXXXXXXXXXXXXXFHXXXXXXXXCYLXXXXXXXXFKLIQWXXXXXXXXXXXXXXXXXXXXXXXXFPLFKPXXXXXXXYTXXXXXXXLSIHYLNFEN

SEQ ID NO: 37736 - protein, 101 aa, Diabrotica virgifera
  misc_feature: Coding regions on vcDNA: vcDNA=SeqID_17433; Strand=-; Position=108-413
  misc_feature (1)..(14): Xaa can be any naturally occurring amino acid
  misc_feature (32)..(61): Xaa can be any naturally occurring amino acid
  misc_feature (76)..(86): Xaa can be any naturally occurring amino acid
  misc_feature (89)..(98): Xaa can be any naturally occurring amino acid
XXXXXXXXXXXXXXEKLRELVNYVERVKLDYXXXXXXXXXXXXXXXXXXXXXXXXXXXXXXPPSHRNYFRYLIRLXXXXXXXXXXXCSXXXXXXXXXXRKI

SEQ ID NO: 37737 - protein, 60 aa, Diabrotica virgifera
  misc_feature: Coding regions on vcDNA: vcDNA=SeqID_17434; Strand=-; Position=0-179
  misc_feature (49)..(59): Xaa can be any naturally occurring amino acid
YVRSRRDILANIYLHMYIIVSFRRIHAMEESAYLLILKVKDYVHCEYIXXXXXXXXXXXG

SEQ ID NO: 37738 - protein, 60 aa, Diabrotica virgifera
  misc_feature: Coding regions on vcDNA: vcDNA=SeqID_17435; Strand=+; Position=83-265
WILYSTTLCRNTIFCMYEYCRITLLLNVIDVILFQYILFDLCALVHILLWVYHSHSCCTT

SEQ ID NO: 37739 - protein, 271 aa, Diabrotica virgifera
  misc_feature: Coding regions on vcDNA: vcDNA=SeqID_17436; Strand=+; Position=80-891
  misc_feature: Homolog annotation: Hit_ID=AAH61203.1; Match level="QueryCoverage =90%, HitCoverage=91%, E-value=2e-54, Identity=47%"; Hit description =Unknown (protein for MGC:74346) [Mus musculus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=145.2, E-value =1.5e-40, Copies=5"; Pfam description=Zinc finger, C2H2 type
  misc_feature (181)..(188): Xaa can be any naturally occurring amino acid
  misc_feature (240)..(240): Xaa can be any naturally occurring amino acid
  misc_feature (253)..(253): Xaa can be any naturally occurring amino acid
MEVKQETCKIEIDNKEFDGDGTLDDFKIEIKEEPKREPAYNAFNYLDFPENAKLEQDEHKFNVCEETQTTKEERLRQNEIKANSERALLTHTGKKHYKCEICFKQFGGAGHLKEHLRIHAGERPYNCEVCFKQFTKAGTLKNHFRLHTGEKPYKCEICAKQFSQDGNLKKHLRIHTGEKSXXXXXXXXLFSLDKNLKRHIRIHTREKPYKCDICFKQFGGAGNLKRHLKIHTGEKPYKCXICSKHFSQDGHLXTHLRVHNGEKPYKCEFCS

SEQ ID NO: 37740 - protein, 57 aa, Diabrotica virgifera
  misc_feature: Coding regions on vcDNA: vcDNA=SeqID_17437; Strand=+; Position=3-176
  misc_feature (48)..(56): Xaa can be any naturally occurring amino acid
IIVCLYTYLISSKCELLHKNLYIVNLEITIMSMNFHILIICHYLPLYXXXXXXXXXL

SEQ ID NO: 37741 - protein, 138 aa, Diabrotica virgifera
  misc_feature: Coding regions on vcDNA: vcDNA=SeqID_17438; Strand=+; Position=185-601
NFGKTSRKLIPRQMFLGDFFVRNFWWGFFRPGIFSSRDYLSGPTLVVLLARYVIVTVTKCNRYEIRFFTTTTKAQYSRIATVIIFMIVGDVQRVDHFIFDPERGFAKFNIISNFKYSRNREENLKLNFYYRFLILNKS

SEQ ID NO: 37742 - protein, 119 aa, Diabrotica virgifera
  misc_feature: Coding regions on vcDNA: vcDNA=SeqID_17439; Strand=-; Position=202-561
  misc_feature: Homolog annotation: Hit_ID=NP_726818.1; Match level="QueryCoverage =91%, HitCoverage=23%, E-value=1e-13, Identity=38%"; Hit description =CG9659-PB, isoform B [Drosophila melanogaster] ref|NP_525052.1| CG9659-PC, isoform C [Drosophila
FFRRSYSFQYYSVLTSPFSIVYYLLSALYPIPMNPIVNLLNAFILAACCYSNIFGAIKSFSIERFGTFKVILLTTISYILLPVLGVLQSCVTLQSLFGKKNQFYIVDKNFKEKAMLQTV

SEQ ID NO: 37743 - protein, 92 aa, Diabrotica virgifera
  misc_feature: Coding regions on vcDNA: vcDNA=SeqID_17440; Strand=+; Position=51-329
  misc_feature (6)..(12): Xaa can be any naturally occurring amino acid
  misc_feature (66)..(80): Xaa can be any naturally occurring amino acid
DIVTNXXXXXXXANLHYRQLLDFKVILIKIIFKMIGKTLICIPVNLFTMLTITNLGNIMRTNVLCXXXXXXXXXXXXXXXTYTLFQEINTPP

SEQ ID NO: 37744 - protein, 43 aa, Diabrotica virgifera
  misc_feature: Coding regions on vcDNA: vcDNA=SeqID_17441; Strand=-; Position=2-130
  misc_feature (3)..(33): Xaa can be any naturally occurring amino acid
EVXXXXXXXXXXXXXXXXXXXXXXXXXXXXXXXKRYFDYFKMK

SEQ ID NO: 37745 - protein, 38 aa, Diabrotica virgifera
  misc_feature: Coding regions on vcDNA: vcDNA=SeqID_17442; Strand=-; Position=2-115
  misc_feature (5)..(16): Xaa can be any naturally occurring amino acid
  misc_feature (19)..(34): Xaa can be any naturally occurring amino acid
KLRCXXXXXXXXXXXXLGXXXXXXXXXXXXXXXXVLIT

SEQ ID NO: 37746 - protein, 74 aa, Diabrotica virgifera
  misc_feature: Coding regions on vcDNA: vcDNA=SeqID_17443; Strand=-; Position=278-502
  misc_feature (46)..(51): Xaa can be any naturally occurring amino acid
SSSVSDYIVSCILEQVVHRIFPTHASCLSCTSSNAIDLLWSMMSIXXXXXXKNMHKKIRCCILDVIVSLQLASS

SEQ ID NO: 37747 - protein, 88 aa, Diabrotica virgifera
  misc_feature: Coding regions on vcDNA: vcDNA=SeqID_17444; Strand=-; Position=1-264
  misc_feature (1)..(21): Xaa can be any naturally occurring amino acid
  misc_feature (25)..(35): Xaa can be any naturally occurring amino acid
  misc_feature (45)..(52): Xaa can be any naturally occurring amino acid
  misc_feature (55)..(67): Xaa can be any naturally occurring amino acid
  misc_feature (74)..(86): Xaa can be any naturally occurring amino acid
XXXXXXXXXXXXXXXXXXXXXGPFXXXXXXXXXXXPTWLTPVKTXXXXXXXXRTXXXXXXXXXXXXXIQHRGRXXXXXXXXXXXXXLL

SEQ ID NO: 37748 - protein, 278 aa, Diabrotica virgifera
  misc_feature: Coding regions on vcDNA: vcDNA=SeqID_17445; Strand=-; Position=2-837
  misc_feature: Homolog annotation: Hit_ID=NP_503166.1; Match level="QueryCoverage =98%, HitCoverage=38%, E-value=1e-36, Identity=31%"; Hit description =predicted CDS, reverse transcriptase family member (5A739) [Caenorhabditis elegans]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=-4.9, E-value =0.00028, Copies=1"; Pfam description=Reverse transcriptase (RNA -dependent
  misc_feature (35)..(35): Xaa can be any naturally occurring amino acid
  misc_feature (61)..(61): Xaa can be any naturally occurring amino acid
  misc_feature (98)..(98): Xaa can be any naturally occurring amino acid
  misc_feature (184)..(184): Xaa can be any naturally occurring amino acid
  misc_feature (191)..(191): Xaa can be any naturally occurring amino acid
SIEYNRSLVLTLVDFHKAFDTVELDSIITALNNRXRIDYRFTKLIQKLYQNATMRVKLHDXTREIHIKRGVRQGDPLSPKLFITILEYDFKMLKWEHXGIKIDGEMFNHLGFADDIVLITENLGEAQQMLQENVSSTIGLKINISKTKFMANLVSSEHLTIQNQVVELTEKYIYVGHEIRISKXIRPCEFXRQITLAWAVYGSLRDIFKSNSPIAMKRKAFDQCVLPIMTHGAETLTLTKTTALKMRVAQRRMERSILGVTKKDKIRNQDLTKRTRIT

SEQ ID NO: 37749 - protein, 60 aa, Diabrotica virgifera
  misc_feature: Coding regions on vcDNA: vcDNA=SeqID_17446; Strand=-; Position=1-180
  misc_feature (1)..(60): Xaa can be any naturally occurring amino acid
XXXXXXXXXXXXXXXXXXXXXXXXXXXXXXXXXXXXXXXXXXXXXXXXXXXXXXXXXXXX

SEQ ID NO: 37750 - protein, 253 aa, Diabrotica virgifera
  misc_feature: Coding regions on vcDNA: vcDNA=SeqID_17447; Strand=-; Position=68-829
  misc_feature (1)..(227): Xaa can be any naturally occurring amino acid
  misc_feature (230)..(238): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXEMREIFSHDTRLTIR

SEQ ID NO: 37751 - protein, 29 aa, Diabrotica virgifera
  misc_feature: Coding regions on vcDNA: vcDNA=SeqID_17448; Strand=-; Position=1-87
  misc_feature (10)..(18): Xaa can be any naturally occurring amino acid
  misc_feature (21)..(29): Xaa can be any naturally occurring amino acid
QFFFIQPSIXXXXXXXXXLCXXXXXXXXX

SEQ ID NO: 37752 - protein, 262 aa, Diabrotica virgifera
  misc_feature: Coding regions on vcDNA: vcDNA=SeqID_17449; Strand=-; Position=1-786
  misc_feature (1)..(11): Xaa can be any naturally occurring amino acid
  misc_feature (14)..(245): Xaa can be any naturally occurring amino acid
  misc_feature (248)..(262): Xaa can be any naturally occurring amino acid
XXXXXXXXXXXSRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 37753 - protein, 124 aa, Diabrotica virgifera
  misc_feature: Coding regions on vcDNA: vcDNA=SeqID_17450; Strand=+; Position=1-375
  misc_feature: Homolog annotation: Hit_ID=AAA70222.2; Match level="QueryCoverage =99%, HitCoverage=10%, E-value=3e-13, Identity=33%"; Hit description =putative ORF2 [Drosophila melanogaster]
  misc_feature (77)..(83): Xaa can be any naturally occurring amino acid
  misc_feature (86)..(86): Xaa can be any naturally occurring amino acid
VKYLGIILNQKLSWKEHIHHLSKKCENAINVLRAFSHIKWGADPNISLIFYRALIRSVIDYGCILYGNANLTQLEIXXXXXXXCLXLCLGCIQSTPTHILEIEAAEPPLHLRRNFCVMFLCQNS

SEQ ID NO: 37754 - protein, 102 aa, Diabrotica virgifera
  misc_feature: Coding regions on vcDNA: vcDNA=SeqID_17451; Strand=-; Position=430-738
YHVEQKSLITPLSKFNRLAKKPKYILVCKLKSDNYVYKNLNIDNHNSKIFAALAFSIYIKPCLHPKQTNKFLFCYFQTWGGIIILQVYLSDLHFSGVNNLNH

SEQ ID NO: 37755 - protein, 67 aa, Diabrotica virgifera
  misc_feature: Coding regions on vcDNA: vcDNA=SeqID_17452; Strand=+; Position=557-760
TLYLGLFCNYRSNRNESNRIEISKSDRNLQELVLCNSSRSLLSQRWVEIDFDYTSPVEITFRHRNWS

SEQ ID NO: 37756 - protein, 66 aa, Diabrotica virgifera
  misc_feature: Coding regions on vcDNA: vcDNA=SeqID_17453; Strand=+; Position=189-389
QDIAWLSIMFVDCFLYVFAFILNAEVIFSPCSGEDMCRRIWGIYITQLKIWTSEVNYTMSTWCCFE

SEQ ID NO: 37757 - protein, 260 aa, Diabrotica virgifera
  misc_feature: Coding regions on vcDNA: vcDNA=SeqID_17454; Strand=-; Position=3-782
  misc_feature (3)..(13): Xaa can be any naturally occurring amino acid
  misc_feature (23)..(30): Xaa can be any naturally occurring amino acid
  misc_feature (33)..(47): Xaa can be any naturally occurring amino acid
  misc_feature (52)..(65): Xaa can be any naturally occurring amino acid
  misc_feature (67)..(260): Xaa can be any naturally occurring amino acid
PFXXXXXXXXXXXTNLAHTGLNXXXXXXXXSNXXXXXXXXXXXXXXXTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37758 - protein, 46 aa, Diabrotica virgifera
  misc_feature: Coding regions on vcDNA: vcDNA=SeqID_17455; Strand=+; Position=241-381
KCLPLLNKPKCLQKKVSTIICNTGEIIHSYIINIIVSEALIRTHTI

SEQ ID NO: 37759 - protein, 297 aa, Diabrotica virgifera
  misc_feature: Coding regions on vcDNA: vcDNA=SeqID_17456; Strand=+; Position=30-920
MSLDNIVKLAAADITEEDLKNEPQEEPMDIEVHHLVQAPEPVKIIKTEPQIVPERRFPTAASTKQVVKMPVTSRKVIANPTSILNKALTGPQVIRRAVTGSAEKQQRVLNHSMARPIVNPVVRQTKTFVRTKPVAPKPRFNIASDMSEKFIQPDHNTSPKNVYSFTRQVVRKIGNTTIRSSPAGVSAANNQHKVQTTKYVRTSSGLVQKVVQTQVRREPMQVRGQPERVERKIQQKPKTVINMPSLISDDDLLLTTKPAQPRPKQAPVQPVQTIAALEAHEPEEAHKMAVVSEPSIT

SEQ ID NO: 37760 - protein, 270 aa, Diabrotica virgifera
  misc_feature: Coding regions on vcDNA: vcDNA=SeqID_17457; Strand=-; Position=3-812
  misc_feature (2)..(226): Xaa can be any naturally occurring amino acid
  misc_feature (229)..(258): Xaa can be any naturally occurring amino acid
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXXXXXXXXXXXXXXXREIFYYLKDEMK

SEQ ID NO: 37761 - protein, 167 aa, Diabrotica virgifera
  misc_feature: Coding regions on vcDNA: vcDNA=SeqID_17458; Strand=+; Position=1-504
  misc_feature: Homolog annotation: Hit_ID=XP_311783.1; Match level="QueryCoverage =97%, HitCoverage=31%, E-value=6e-19, Identity=36%"; Hit description =ENSANGP00000025124 [Anopheles gambiae]
  misc_feature: Pfam annotation: Pfam_ID=Peptidase_A17; Match level="Score=-14.0, E -value=1.4e-06, Copies=1"; Pfam description=Pao retrotransposon peptidase
  misc_feature (111)..(111): Xaa can be any naturally occurring amino acid
ELSCLFEQLTFLLETHGFLLHKWNCSSSEFLSQHNLNPVSEVSLNFTGSDKVLGIFWDSERDHFSFKTPIFKLANVVTKRTILSYIATLYDPLGWLSPVLVNAKLLIQEIXSQKLNWDQPIDSPIIMKNWQNLLSTFKTIEEVKVPRCLLLQKKVVDVQLIIITDSS

SEQ ID NO: 37762 - protein, 27 aa, Diabrotica virgifera
  misc_feature: Coding regions on vcDNA: vcDNA=SeqID_17459; Strand=-; Position=1-81
  misc_feature (1)..(25): Xaa can be any naturally occurring amino acid
XXXXXXXXXXXXXXXXXXXXXXXXXIK

SEQ ID NO: 37763 - protein, 69 aa, Diabrotica virgifera
  misc_feature: Coding regions on vcDNA: vcDNA=SeqID_17460; Strand=-; Position=1-207
  misc_feature (20)..(27): Xaa can be any naturally occurring amino acid
  misc_feature (37)..(51): Xaa can be any naturally occurring amino acid
FLNYNNSLKFIIISYHHIYXXXXXXXXTFHFISHSSXXXXXXXXXXXXXXXSPSSSPLPGFSLLYSSLP

SEQ ID NO: 37764 - protein, 271 aa, Diabrotica virgifera
  misc_feature: Coding regions on vcDNA: vcDNA=SeqID_17461; Strand=+; Position=104-916
  misc_feature: Homolog annotation: Hit_ID=NP_729843.1; Match level="QueryCoverage =98%, HitCoverage=57%, E-value=1e-58, Identity=42%"; Hit description =CG10960-PC, isoform C [Drosophila melanogaster] ref|NP_729842.1| CG10960-PA, isoform A [Drosophila
  misc_feature: Pfam annotation: Pfam_ID=Sugar_tr; Match level="Score=-126.3, E-value= 0.0052, Copies=1"; Pfam description=Sugar (and other) transporter
  misc_feature (64)..(69): Xaa can be any naturally occurring amino acid
  misc_feature (256)..(265): Xaa can be any naturally occurring amino acid
MADSGQAKTFPQYIAALSVCLGAVAAGAVLGWTSNISKDLQKGGLNDLVISDDQLGWIGSFVTXXXXXXCFPIGYICDLIGRKWGCLLTLIPFTVGWLLVIFSSSVSVIYVGRFLTGLAGGSFCVAAPIYTAEIAQASIRGALGSYFQLLLTVGILIVYVGGAWMHPKDLAILSAVIPIVFAVVFFFQPETPIYLMKKNRPEEAKKALQRLRGNAYDCDAELKEIQLSFEQGSSEKSFMTVLKTKAAIKACLITFXXXXXXXXXXINAGIF

SEQ ID NO: 37765 - protein, 80 aa, Diabrotica virgifera
  misc_feature: Coding regions on vcDNA: vcDNA=SeqID_17462; Strand=-; Position=335-577
KYFHILKILCLCFHGFMLAYGYMLCNYSCPSGAVPVSTNHESFFRPIRFLPSTFSSIIRRSRWYLGALVIWLKYSGFLLL

SEQ ID NO: 37766 - protein, 51 aa, Diabrotica virgifera
  misc_feature: Coding regions on vcDNA: vcDNA=SeqID_17463; Strand=-; Position=84-239
  misc_feature (3)..(11): Xaa can be any naturally occurring amino acid
  misc_feature (15)..(21): Xaa can be any naturally occurring amino acid
  misc_feature (43)..(49): Xaa can be any naturally occurring amino acid
KFXXXXXXXXXVINXXXXXXXHELIHYKKNKHQKKICHVENIXXXXXXXQL

SEQ ID NO: 37767 - protein, 133 aa, Diabrotica virgifera
  misc_feature: Coding regions on vcDNA: vcDNA=SeqID_17464; Strand=+; Position=2-403
  misc_feature (9)..(15): Xaa can be any naturally occurring amino acid
  misc_feature (22)..(88): Xaa can be any naturally occurring amino acid
  misc_feature (90)..(119): Xaa can be any naturally occurring amino acid
FDPILHSSXXXXXXXLCYLSTXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXLRHNSVILLKRSHR

SEQ ID NO: 37768 - protein, 50 aa, Diabrotica virgifera
  misc_feature: Coding regions on vcDNA: vcDNA=SeqID_17465; Strand=-; Position=431-583
MNQSVVNVWVHISCFSDSNGGFIQKKVSCGVYSYISSSIIIFESCGCYIM

SEQ ID NO: 37769 - protein, 165 aa, Diabrotica virgifera
  misc_feature: Coding regions on vcDNA: vcDNA=SeqID_17466; Strand=+; Position=82-585
  misc_feature: Homolog annotation: Hit_ID=AAL67872.1; Match level="QueryCoverage =100%, HitCoverage=43%, E-value=6e-24, Identity=42%"; Hit description= cytochrome b [Crioceris duodecimpunctata] ref|NP_569071.1| cytochrome b [Crioceris duodecimpunctata]
  misc_feature: Pfam annotation: Pfam_ID=Cytochrom_B_N; Match level="Score=-61.5, E -value=0.0082, Copies=1"; Pfam description=Cytochrome b(N -terminal)/b6/petB
  misc_feature (11)..(11): Xaa can be any naturally occurring amino acid
  misc_feature (46)..(46): Xaa can be any naturally occurring amino acid
  misc_feature (55)..(55): Xaa can be any naturally occurring amino acid
  misc_feature (82)..(82): Xaa can be any naturally occurring amino acid
  misc_feature (85)..(85): Xaa can be any naturally occurring amino acid
  misc_feature (99)..(99): Xaa can be any naturally occurring amino acid
  misc_feature (137)..(137): Xaa can be any naturally occurring amino acid
NCVSLLGICLXIQMITGLFLRIHYCPCGKLVLLIQVLIVAWMKIRXLLQTLACKXNRFVFIGLYIHIDLGIYYTSYNMIDTXMNXETIFFLTIKSKFLXCVLRMSDTYPFDKEQQLLPYHSLSIYLVKYINTLNYRXFAVYNASLAPFFTLHFILPFIIFAYIII

SEQ ID NO: 37770 - protein, 267 aa, Diabrotica virgifera
  misc_feature: Coding regions on vcDNA: vcDNA=SeqID_17467; Strand=-; Position=7-810
  misc_feature (1)..(226): Xaa can be any naturally occurring amino acid
  misc_feature (228)..(236): Xaa can be any naturally occurring amino acid
  misc_feature (238)..(249): Xaa can be any naturally occurring amino acid
  misc_feature (252)..(259): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXKXXXXXXXXXXXXVRXXXXXXXXVEKDILLF

SEQ ID NO: 37771 - protein, 68 aa, Diabrotica virgifera
  misc_feature: Coding regions on vcDNA: vcDNA=SeqID_17468; Strand=-; Position=225-431
  misc_feature (17)..(36): Xaa can be any naturally occurring amino acid
FMILVIFVIFGHGNTHXXXXXXXXXXXXXXXXXXXXHISFYNTIIYTSFILDVQRIDFSMNLTSISCD

SEQ ID NO: 37772 - protein, 122 aa, Diabrotica virgifera
  misc_feature: Coding regions on vcDNA: vcDNA=SeqID_17469; Strand=-; Position=581-949
  misc_feature (20)..(20): Xaa can be any naturally occurring amino acid
  misc_feature (22)..(22): Xaa can be any naturally occurring amino acid
  misc_feature (37)..(37): Xaa can be any naturally occurring amino acid
KVMNGQPDFSLSVENASRCXPXHGEIGSGLNSFKITXLIGKKSILMQCLVLFISASAPIIMEPLKNSPSCQKVAYAYRLMKNRNSLNANCSLKTRCVVFKLLFSQFGYQLQMRSLNSNKEFI

SEQ ID NO: 37773 - protein, 282 aa, Diabrotica virgifera
  misc_feature: Coding regions on vcDNA: vcDNA=SeqID_17470; Strand=+; Position=166 -1011
  misc_feature (16)..(34): Xaa can be any naturally occurring amino acid
  misc_feature (39)..(277): Xaa can be any naturally occurring amino acid
SNNYVFIIFQLKRCRXXXXXXXXXXXXXXXXXXXLFGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIFFD

SEQ ID NO: 37774 - protein, 50 aa, Diabrotica virgifera
  misc_feature: Coding regions on vcDNA: vcDNA=SeqID_17471; Strand=-; Position=2-151
  misc_feature (7)..(14): Xaa can be any naturally occurring amino acid
  misc_feature (16)..(16): Xaa can be any naturally occurring amino acid
  misc_feature (36)..(49): Xaa can be any naturally occurring amino acid
AHTGLNXXXXXXXXSXRLDNIAATSIMNCNPTSRSXXXXXXXXXXXXXXV

SEQ ID NO: 37775 - protein, 117 aa, Diabrotica virgifera
  misc_feature: Coding regions on vcDNA: vcDNA=SeqID_17472; Strand=-; Position=379-732
HFLGNDFEVIQQRIDIFEYLIFKYDILRISWTEYVTNIEVIHRIAKEKEILAQLNKEILNIYSTYWDTIRTAIIHISDTTDSYFWFSTLIEKGFASLCDLSHHNTKTKACKYNRSLE

SEQ ID NO: 37776 - protein, 85 aa, Diabrotica virgifera
  misc_feature: Coding regions on vcDNA: vcDNA=SeqID_17473; Strand=+; Position=1-258
GEVLGPVLGGSLMEHYEFSNACATFAALNFFVGALTTVFLMNRKELSLKGNLLSVFIKPEIYQNGTIDIIVEKEQQKMIENIKTK

SEQ ID NO: 37777 - protein, 114 aa, Diabrotica virgifera
  misc_feature: Coding regions on vcDNA: vcDNA=SeqID_17474; Strand=-; Position=90-434
TPFNIRPSVIIFTQEITTQASKILVVTQNSNTKYCYTGSWPIDRVNIRPDSPDLKDMSGYDKCADFFLCEKKMEKTWKMEKNGKFHSAQHLVKLVALLVNSARARADNNRLTVS

SEQ ID NO: 37778 - protein, 109 aa, Diabrotica virgifera
  misc_feature: Coding regions on vcDNA: vcDNA=SeqID_17475; Strand=-; Position=166-495
  misc_feature (14)..(19): Xaa can be any naturally occurring amino acid
  misc_feature (75)..(82): Xaa can be any naturally occurring amino acid
AIRIMLSVKMVNGXXXXXXEEIGTLIGSMLNSSFIMNMVHSMSNHSGKKFWISDLSENWHIASARRKNKIFKVKXXXXXXXXKYHFMRFYSDLKWNDPYTFLIKLEFCF

SEQ ID NO: 37779 - protein, 108 aa, Diabrotica virgifera; identical to SEQ ID NO: 27732
  misc_feature: Coding regions on vcDNA: vcDNA=SeqID_17476; Strand=+; Position=198-524
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37780 - protein, 67 aa, Diabrotica virgifera
  misc_feature: Coding regions on vcDNA: vcDNA=SeqID_17477; Strand=-; Position=2-202
  misc_feature (6)..(15): Xaa can be any naturally occurring amino acid
  misc_feature (24)..(67): Xaa can be any naturally occurring amino acid
NIEVAXXXXXXXXXXKFTLLSPRXXXXXXXXXXXXXXXXXXXXXXXXXXXXXXXXXXXXXXXXXXXX

SEQ ID NO: 37781 - protein, 22 aa, Diabrotica virgifera
  misc_feature: Coding regions on vcDNA: vcDNA=SeqID_17478; Strand=-; Position=1-66
  misc_feature (2)..(22): Xaa can be any naturally occurring amino acid
KXXXXXXXXXXXXXXXXXXXXX

SEQ ID NO: 37782 - protein, 233 aa, Diabrotica virgifera
  misc_feature: Coding regions on vcDNA: vcDNA=SeqID_17479; Strand=-; Position=0-698
  misc_feature (1)..(82): Xaa can be any naturally occurring amino acid
  misc_feature (101)..(162): Xaa can be any naturally occurring amino acid
  misc_feature (172)..(179): Xaa can be any naturally occurring amino acid
  misc_feature (184)..(215): Xaa can be any naturally occurring amino acid
  misc_feature (218)..(225): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXPPPRRGGGKEKKHHHPPNXXXXXXXXXXXXXXXXXXXXXXXXXXXXXXXXXXXXXXXXXXXXXXXXXXXXXXXXXXXXXXVSLLRKKKVXXXXXXXXAQGMXXXXXXXXXXXXXXXXXXXXXXXXXXXXXXXXERXXXXXXXXFFCWWGGG

SEQ ID NO: 37783 - protein, 82 aa, Diabrotica virgifera
  misc_feature: Coding regions on vcDNA: vcDNA=SeqID_17480; Strand=+; Position=276-524
HACPNLILLMVDIYLRGRVKLLYQGFSGIIGRIKLYCVVDMLQYLSQCVFIQETFKIFYSTTFRKPQGDLHFFHVPGLDTIK

SEQ ID NO: 37784 - protein, 250 aa, Diabrotica virgifera
  misc_feature: Coding regions on vcDNA: vcDNA=SeqID_17481; Strand=-; Position=114-866
  misc_feature (4)..(14): Xaa can be any naturally occurring amino acid
  misc_feature (17)..(32): Xaa can be any naturally occurring amino acid
  misc_feature (55)..(74): Xaa can be any naturally occurring amino acid
  misc_feature (93)..(198): Xaa can be any naturally occurring amino acid
  misc_feature (200)..(234): Xaa can be any naturally occurring amino acid
INSXXXXXXXXXXXLEXXXXXXXXXXXXXXXXNLHTSFNKELKDLVHSHGQNNTXXXXXXXXXXXXXXXXXXXXVITRRKKCSRIPLSILYIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXSITPLLTDRSICFVWK

SEQ ID NO: 37785 - protein, 132 aa, Diabrotica virgifera
  misc_feature: Coding regions on vcDNA: vcDNA=SeqID_17482; Strand=+; Position=333-731
  misc_feature: Homolog annotation: Hit_ID=AAA50353.1; Match level="QueryCoverage =68%, HitCoverage=6%, E-value=5e-10, Identity=37%"; Hit description =metal resistance protein
  misc_feature: Gene Ontology Annotation: Molecular function=arsenite transporter activity; Cellular component=vacuolar membrane; Biological process =bilirubin transport
VKKNRIQKKPHPLKRTNLFSHIFFCWLPGFLSIGLRKDLDENDMYLTRHSQQSRYLADQLVVAWKNELKKSKPSFLWALFVVFRLEIFYYAFFNMLFRFYRNCTTIDDLLTSVIFPARCHNQPNRNLLQRIF

SEQ ID NO: 37786 - protein, 47 aa, Diabrotica virgifera
  misc_feature: Coding regions on vcDNA: vcDNA=SeqID_17483; Strand=+; Position=92-235
IPYYHKFTIYTSYLAHHGSVNNNHIFTNFEYVRPQKPPFTLNIEHFK

SEQ ID NO: 37787 - protein, 67 aa, Diabrotica virgifera
  misc_feature: Coding regions on vcDNA: vcDNA=SeqID_17484; Strand=-; Position=88-291
RTVKNAVFIIFCKQIKSMLVVLHSNPNLVELEYVVLNIQRRFSSLLNVFFLCKEPQAARKSKFVREC

SEQ ID NO: 37788 - protein, 141 aa, Diabrotica virgifera
  misc_feature: Coding regions on vcDNA: vcDNA=SeqID_17485; Strand=+; Position=442-867
  misc_feature (17)..(28): Xaa can be any naturally occurring amino acid
  misc_feature (30)..(41): Xaa can be any naturally occurring amino acid
  misc_feature (45)..(129): Xaa can be any naturally occurring amino acid
  misc_feature (132)..(138): Xaa can be any naturally occurring amino acid
ETDHIIENGMIYIYILXXXXXXXXXXXXEXXXXXXXXXXXXRIKXXXXXXXXXXXXXXXXXXXXXXXXXXXXXXXXXXXXXXXXXXXXXXXXXXXXXXXXXXXXXXXXXXXXXXXXXXXXXXXXXXXXXKKXXXXXXXKTP

SEQ ID NO: 37789 - protein, 273 aa, Diabrotica virgifera
  misc_feature: Coding regions on vcDNA: vcDNA=SeqID_17486; Strand=-; Position=3-821
  misc_feature (2)..(54): Xaa can be any naturally occurring amino acid
  misc_feature (58)..(258): Xaa can be any naturally occurring amino acid
  misc_feature (260)..(273): Xaa can be any naturally occurring amino acid
MXXXXXXXXXXXXXXXXXXXXXXXXXXXXXXXXXXXXXXXXXXXXXXXXXXXXXGQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXX

SEQ ID NO: 37790 - protein, 74 aa, Diabrotica virgifera
  misc_feature: Coding regions on vcDNA: vcDNA=SeqID_17487; Strand=+; Position=367-591
PLVSTRIEMVKCYGTFPSECPSIILTLTCIAPHFDKTHTEDLHISFIVPALHSIQYDHEHILSKHMDPHCEFYM

SEQ ID NO: 37791 - protein, 110 aa, Diabrotica virgifera
  misc_feature: Coding regions on vcDNA: vcDNA=SeqID_17488; Strand=+; Position=1-333
  misc_feature (70)..(74): Xaa can be any naturally occurring amino acid
RLADFTTEEHWMGEWNPDIRNSNLIENPTIKPDCFSLPRHEWCNLNRIQVGHGICNKSLNQWDINASPGXXXXXAVEHTINHIVFKLAVLCKSSRNPPTHSQVKRLASRM

SEQ ID NO: 37792 - protein, 86 aa, Diabrotica virgifera
  misc_feature: Coding regions on vcDNA: vcDNA=SeqID_17489; Strand=-; Position=1-258
  misc_feature (4)..(42): Xaa can be any naturally occurring amino acid
  misc_feature (45)..(53): Xaa can be any naturally occurring amino acid
  misc_feature (55)..(74): Xaa can be any naturally occurring amino acid
  misc_feature (76)..(84): Xaa can be any naturally occurring amino acid
TLHXXXXXXXXXXXXXXXXXXXXXXXXXXXXXXXXXXXXXXXRYXXXXXXXXXNXXXXXXXXXXXXXXXXXXXXEXXXXXXXXXDK

SEQ ID NO: 37793 - protein, 90 aa, Diabrotica virgifera
  misc_feature: Coding regions on vcDNA: vcDNA=SeqID_17490; Strand=-; Position=78-350
EQVIKTYYYVNDAVPVADNNIQTIYYNIKSISKLRNSIRKFRHENNESRLFKKSIRLVTTLDQKPYNKELYFKSYRTSKNLVCTMVQKVH

SEQ ID NO: 37794 - protein, 283 aa, Diabrotica virgifera
  misc_feature: Coding regions on vcDNA: vcDNA=SeqID_17491; Strand=+; Position=84-931
  misc_feature: Homolog annotation: Hit_ID=NP_651119.1; Match level="QueryCoverage =92%, HitCoverage=35%, E-value=2e-25, Identity=27%"; Hit description =CG17111-PA [Drosophila melanogaster] gb|AAF56092.1| CG17111-PA [Drosophila melanogaster]
  misc_feature: Pfam annotation: Pfam_ID=PAN; Match level="Score=73.1, E-value=7.6e -19, Copies=2"; Pfam description=PAN domain
  misc_feature (115)..(115): Xaa can be any naturally occurring amino acid
  misc_feature (236)..(236): Xaa can be any naturally occurring amino acid
  misc_feature (259)..(259): Xaa can be any naturally occurring amino acid
MIILIWCLCLFKFIFGATVFDCPSTDLKFEKVLGLRPSNSTQAKLLYQLEKNTPWKPITAECISLCQSNNDCASFVLYYSTSKCYWYRNNVNIVDIQNVIDENVSWFVKKCLKTXPSCDKLWIFDRIPGATLIGNDTKRLPGVKSRTECEQYCLNEKEFSCRSAKFSITQTTEKPVTTNITTGITGYRYGPNTGQTDFTGICTLSNADRHQLPSSFRVSSYVDEYFENQCAPVDIXKNEFCAYEEYENMTLAHVDIAFXKEDKEECQKMCDEFHPFNCRAFTI

SEQ ID NO: 37795 - protein, 242 aa, Diabrotica virgifera
  misc_feature: Coding regions on vcDNA: vcDNA=SeqID_17492; Strand=+; Position=3-731
  misc_feature (4)..(84): Xaa can be any naturally occurring amino acid
  misc_feature (93)..(234): Xaa can be any naturally occurring amino acid
FCVXXXXXXXXXXXXXXXXXXXXXXXXXXXXXXXXXXXXXXXXXXXXXXXXXXXXXXXXXXXXXXXXXXXXXXXXXXXXXXXXXVIEVLFVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFVRAKGL

SEQ ID NO: 37796 - protein, 254 aa, Diabrotica virgifera
  misc_feature: Coding regions on vcDNA: vcDNA=SeqID_17493; Strand=-; Position=3-764
  misc_feature (13)..(29): Xaa can be any naturally occurring amino acid
  misc_feature (35)..(238): Xaa can be any naturally occurring amino acid
  misc_feature (241)..(254): Xaa can be any naturally occurring amino acid
YRVSRLLKKYKLXXXXXXXXXXXXXXXXXSCNPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXX

SEQ ID NO: 37797 - protein, 63 aa, Diabrotica virgifera
  misc_feature: Coding regions on vcDNA: vcDNA=SeqID_17494; Strand=-; Position=386-577
  misc_feature (55)..(62): Xaa can be any naturally occurring amino acid
NTSISSMFLTRTRGMSKNMQILLKSKVALFSTILKIVISKSCLELHSNMQFHPSXXXXXXXXF

SEQ ID NO: 37798 - protein, 282 aa, Diabrotica virgifera
  misc_feature: Coding regions on vcDNA: vcDNA=SeqID_17495; Strand=-; Position=1-846
  misc_feature (1)..(248): Xaa can be any naturally occurring amino acid
  misc_feature (251)..(270): Xaa can be any naturally occurring amino acid
  misc_feature (272)..(280): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXVXXXXXXXXXRK

SEQ ID NO: 37799 - protein, 299 aa, Diabrotica virgifera
  misc_feature: Coding regions on vcDNA: vcDNA=SeqID_17496; Strand=-; Position=1-897
  misc_feature (2)..(14): Xaa can be any naturally occurring amino acid
  misc_feature (21)..(94): Xaa can be any naturally occurring amino acid
  misc_feature (96)..(124): Xaa can be any naturally occurring amino acid
  misc_feature (127)..(297): Xaa can be any naturally occurring amino acid
IXXXXXXXXXXXXXLISPQLXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNT

SEQ ID NO: 37800 - protein, 88 aa, Diabrotica virgifera
  misc_feature: Coding regions on vcDNA: vcDNA=SeqID_17497; Strand=-; Position=195-461
  misc_feature (6)..(16): Xaa can be any naturally occurring amino acid
  misc_feature (26)..(72): Xaa can be any naturally occurring amino acid
  misc_feature (79)..(88): Xaa can be any naturally occurring amino acid
KIYKGXXXXXXXXXXXMCGNMKINNXXXXXXXXXXXXXXXXXXXXXXXXXXXXXXXXXXXXXXXXXXXXXXXLDIFRRXXXXXXXXXX

SEQ ID NO: 37801 - protein, 91 aa, Diabrotica virgifera
  misc_feature: Coding regions on vcDNA: vcDNA=SeqID_17498; Strand=-; Position=3-275
  misc_feature (12)..(20): Xaa can be any naturally occurring amino acid
  misc_feature (23)..(48): Xaa can be any naturally occurring amino acid
  misc_feature (51)..(59): Xaa can be any naturally occurring amino acid
  misc_feature (73)..(91): Xaa can be any naturally occurring amino acid
DNIEKRIPFHTXXXXXXXXXTDXXXXXXXXXXXXXXXXXXXXXXXXXXRRXXXXXXXXXKRKYSLPILINYRXXXXXXXXXXXXXXXXXXX

SEQ ID NO: 37802 - protein, 263 aa, Diabrotica virgifera
  misc_feature: Coding regions on vcDNA: vcDNA=SeqID_17499; Strand=+; Position=52-843
  misc_feature: Homolog annotation: Hit_ID=XP_393687.1; Match level="QueryCoverage =82%, HitCoverage=11%, E-value=1e-67, Identity=60%"; Hit description =similar to CG30084-PB [Apis mellifera]
  misc_feature: Gene Ontology Annotation: Molecular function=structural constituent of muscle; Cellular component=actin cytoskeleton; Biological process= actin filament organization
  misc_feature: Pfam annotation: Pfam_ID=PDZ; Match level="Score=55.9, E-value=1.1e -13, Copies=1"; Pfam description=PDZ domain (Also known as DHR or GLGF
MASLITVHLNKGGSPNLGFRLQGGKDFGTPLLIQKVNVGSPAERAGLVAGDAVIKINNTDVYNLRHKDAQDVVVRAGPSFEISVQRGGSTWIPSVIPTGPLSAPSPYVNSSGPVTRTSLAANKSENIGSIGTGHNLSAKPFSPQLNGSVNGGPKLVNKQYNTPLKLYSEESIAETLSAQTEVLSTGALGVNFKKNERNYDSSNSEVLRALKEAENEPSYPDHVIRTDYYSTQSHAIGGRKSTTPNPIASEQYRSLNEHPDQLL

SEQ ID NO: 37803 - protein, 65 aa, Diabrotica virgifera
  misc_feature: Coding regions on vcDNA: vcDNA=SeqID_17500; Strand=-; Position=3-197
  misc_feature (4)..(31): Xaa can be any naturally occurring amino acid
  misc_feature (43)..(65): Xaa can be any naturally occurring amino acid
KKLXXXXXXXXXXXXXXXXXXXXXXXXXXXXDINEFDTKKLYXXXXXXXXXXXXXXXXXXXXXXX

SEQ ID NO: 37804 - protein, 275 aa, Diabrotica virgifera
  misc_feature: Coding regions on vcDNA: vcDNA=SeqID_17501; Strand=+; Position=2-826
  misc_feature (1)..(15): Xaa can be any naturally occurring amino acid
  misc_feature (17)..(54): Xaa can be any naturally occurring amino acid
  misc_feature (58)..(243): Xaa can be any naturally occurring amino acid
  misc_feature (249)..(272): Xaa can be any naturally occurring amino acid
XXXXXXXXXXXXXXXTXXXXXXXXXXXXXXXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLHFFXXXXXXXXXXXXXXXXXXXXXXXXIIY

SEQ ID NO: 37805 - protein, 93 aa, Diabrotica virgifera
  misc_feature: Coding regions on vcDNA: vcDNA=SeqID_17502; Strand=+; Position=32-313
  misc_feature (72)..(77): Xaa can be any naturally occurring amino acid
MKFLVLFALVLYCSTQVLGGPCDGVQCSPPNCGLGARPVVKPGDCCATCQGFGNPKCEGIQCGVPNCPPGSXXXXXXGACCPSCEPFGNPLSH

SEQ ID NO: 37806 - protein, 59 aa, Diabrotica virgifera
  misc_feature: Coding regions on vcDNA: vcDNA=SeqID_17503; Strand=+; Position=316-495
LPSYTCLQYHYKIFLVWHLRIIMLLKYDLDSDSTDEEPHYIKVSNHLFLYIITSIFYTL

SEQ ID NO: 37807 - protein, 48 aa, Diabrotica virgifera
  misc_feature: Coding regions on vcDNA: vcDNA=SeqID_17504; Strand=-; Position=74-220
HERCFGWIFYVSWFFISIRRMLIVSICGYTGVMVCCEEYVGCIMILYV

SEQ ID NO: 37808 - protein, 258 aa, Diabrotica virgifera
  misc_feature: Coding regions on vcDNA: vcDNA=SeqID_17505; Strand=+; Position=4-780
  misc_feature (3)..(156): Xaa can be any naturally occurring amino acid
  misc_feature (170)..(187): Xaa can be any naturally occurring amino acid
  misc_feature (189)..(189): Xaa can be any naturally occurring amino acid
  misc_feature (192)..(192): Xaa can be any naturally occurring amino acid
  misc_feature (196)..(196): Xaa can be any naturally occurring amino acid
  misc_feature (206)..(224): Xaa can be any naturally occurring amino acid
  misc_feature (226)..(256): Xaa can be any naturally occurring amino acid
NGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIIKFFIGSWNGELXXXXXXXXXXXXXXXXXXVXKLXFFLXDEKDPIVVYXXXXXXXXXXXXXXXXXXXMXXXXXXXXXXXXXXXXXXXXXXXXXXXXXXXYL

SEQ ID NO: 37809 - protein, 234 aa, Diabrotica virgifera
  misc_feature: Coding regions on vcDNA: vcDNA=SeqID_17506; Strand=+; Position=116-820
MVEPEKNHHNRPNEILLSNCSLNSSSSGSSSHSLENKNASEQWENKQWLNSSGSSLNVTLTPSESTSELSVMSIGKKGVAGRGLKPSVSTGAIPKSISFDMSADKGLDDDGRSKRGGFFGKLRMGFKNRRGKSLRNQEEFRLDNDGYVGKSTTKLGNNTEVSDDILAKYRTKPFVENETIKENCDSNKSLKGKSVYRSNSNSEEVNSFNDIKNKLRLVLSNTWEIPHYLKNNPL

SEQ ID NO: 37810 - protein, 23 aa, Diabrotica virgifera
  misc_feature: Coding regions on vcDNA: vcDNA=SeqID_17507; Strand=-; Position=1-69
YMRYESYLCVSYSAVEYTVRKDS

SEQ ID NO: 37811 - protein, 291 aa, Diabrotica virgifera
  misc_feature: Coding regions on vcDNA: vcDNA=SeqID_17508; Strand=+; Position=1-876
  misc_feature: Homolog annotation: Hit_ID=XP_308390.1; Match level="QueryCoverage =98%, HitCoverage=65%, E-value=1e-27, Identity=27%"; Hit description =ENSANGP00000009437 [Anopheles gambiae]
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=-109.8, E-value= 0.0015, Copies=1"; Pfam description=Sugar (and other) transporter
  misc_feature (172)..(177): Xaa can be any naturally occurring amino acid
  misc_feature (277)..(277): Xaa can be any naturally occurring amino acid
  misc_feature (284)..(285): Xaa can be any naturally occurring amino acid
TIDISMIAGIPGLAGLIGTLVLPKFSNILGRKLILQVMVCFTLLGSLLLTFSRSVTVIIVSRCIISIFLHGAVAIVPIYITEICEDHNRAKFGCFLGLFHQIGHFYTFVVGPLFSYKMFNFFISLPAIPFLALFIFFPESPAYLLSKGKRTSCVKALKKLRRNKTDKEIEEXXXXXXETVKSKERTKQNSSILSLFQTKESRTGLMLAMLPLMVNHLSGVAVIMSFLAPFFNSAGTGISGHKVGVMASIAKIVCFGITSSVVERVGRRRMLFLSSLXTGVPLFXXRLLFLL

SEQ ID NO: 37812 - protein, 102 aa, Diabrotica virgifera
  misc_feature: Coding regions on vcDNA: vcDNA=SeqID_17509; Strand=-; Position=392-700
KVTIIILLHCFTSFKVIYEQKIPFAFQKPHANSFLADFLTLIYSIVSKCMVLLRGFFQCDTSDGKKGTSVIHTHSGVPIYKRAMVPVEMRVHPPNKNSHCIT

SEQ ID NO: 37813 - protein, 109 aa, Diabrotica virgifera
  misc_feature: Coding regions on vcDNA: vcDNA=SeqID_17510; Strand=+; Position=86-415
KKFQKCNNKAKSIIVQCVSDAQLEILRDKQQAYHMWKSLEEKYEKKGLPGREFTGPIPFVMPATEFEWGLYAECWLHVLYHFGHGSDWVRVGFVCGILVTYPVLFRSRN

SEQ ID NO: 37814 - protein, 63 aa, Diabrotica virgifera
  misc_feature: Coding regions on vcDNA: vcDNA=SeqID_17511; Strand=-; Position=400-591
  misc_feature (40)..(44): Xaa can be any naturally occurring amino acid
GESIYPTLFNLILEIIKRRKNFANKNIIRNQLQLVAYADXXXXXVNTKMTLIKAVGKLDREED

SEQ ID NO: 37815 - protein, 71 aa, Diabrotica virgifera
  misc_feature: Coding regions on vcDNA: vcDNA=SeqID_17512; Strand=+; Position=1-216
  misc_feature (58)..(66): Xaa can be any naturally occurring amino acid
FLIEVQNRPAIWDKRTRGHIYRALKGKAWDVIFELFVPDFTEGSPIEKNKSLKQCFLXXXXXXXXXLMYLN

SEQ ID NO: 37816 - protein, 299 aa, Diabrotica virgifera
  misc_feature: Coding regions on vcDNA: vcDNA=SeqID_17513; Strand=+; Position=2-901
  misc_feature: Homolog annotation: Hit_ID=AAF87756.1; Match level="QueryCoverage =98%, HitCoverage=67%, E-value=1e-112, Identity=73%"; Hit description= cytochrome oxidase subunit I [Diabrotica lemniscata]
  misc_feature: Pfam annotation: Pfam_ID=COX1; Match level="Score=95.5, E-value=1.4e -25, Copies=1"; Pfam description=Cytochrome C and Quinol oxidase polyp
  misc_feature (13)..(13): Xaa can be any naturally occurring amino acid
  misc_feature (58)..(66): Xaa can be any naturally occurring amino acid
  misc_feature (70)..(76): Xaa can be any naturally occurring amino acid
  misc_feature (87)..(94): Xaa can be any naturally occurring amino acid
  misc_feature (115)..(115): Xaa can be any naturally occurring amino acid
  misc_feature (150)..(150): Xaa can be any naturally occurring amino acid
  misc_feature (167)..(167): Xaa can be any naturally occurring amino acid
  misc_feature (170)..(176): Xaa can be any naturally occurring amino acid
  misc_feature (203)..(209): Xaa can be any naturally occurring amino acid
  misc_feature (223)..(223): Xaa can be any naturally occurring amino acid
  misc_feature (231)..(247): Xaa can be any naturally occurring amino acid
  misc_feature (277)..(278): Xaa can be any naturally occurring amino acid
  misc_feature (297)..(297): Xaa can be any naturally occurring amino acid
  misc_feature (299)..(299): Xaa can be any naturally occurring amino acid
IGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXXIVSSIGSLISLIGVLFLIXYX

SEQ ID NO: 37817 - protein, 56 aa, Diabrotica virgifera
  misc_feature: Coding regions on vcDNA: vcDNA=SeqID_17514; Strand=-; Position=337-507
IQSALLSHKPSLQLTINNIRIFTPYHVQNGSYVSISQCTGDTLTTIFIIKMFLTNE

SEQ ID NO: 37818 - protein, 112 aa, Diabrotica virgifera
  misc_feature: Coding regions on vcDNA: vcDNA=SeqID_17515; Strand=+; Position=1-339
  misc_feature (2)..(101): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYISKRITFKKP

SEQ ID NO: 37819 - protein, 66 aa, Diabrotica virgifera; identical to SEQ ID NO: 26808
  misc_feature: Coding regions on vcDNA: vcDNA=SeqID_17516; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37820 - protein, 80 aa, Diabrotica virgifera
  misc_feature: Coding regions on vcDNA: vcDNA=SeqID_17517; Strand=-; Position=64-306
FYNDHMICRLIVLGILFHPFLQSQSPDRQLWQRPILAPSQSARADVQLLSAWLTNYLKVPRSHYLFLSPAMPSLERKVIH

SEQ ID NO: 37821 - protein, 88 aa, Diabrotica virgifera
  misc_feature: Coding regions on vcDNA: vcDNA=SeqID_17518; Strand=-; Position=2-265
  misc_feature (1)..(22): Xaa can be any naturally occurring amino acid
  misc_feature (25)..(35): Xaa can be any naturally occurring amino acid
  misc_feature (45)..(52): Xaa can be any naturally occurring amino acid
  misc_feature (55)..(68): Xaa can be any naturally occurring amino acid
  misc_feature (74)..(87): Xaa can be any naturally occurring amino acid
XXXXXXXXXXXXXXXXXXXXXXPFXXXXXXXXXXXPNLAHTGLNXXXXXXXXSNXXXXXXXXXXXXXXPTSRSXXXXXXXXXXXXXXV

SEQ ID NO: 37822 - protein, 228 aa, Diabrotica virgifera
  misc_feature: Coding regions on vcDNA: vcDNA=SeqID_17519; Strand=+; Position=9-695
  misc_feature: Homolog annotation: Hit_ID=NP_611192.1; Match level="QueryCoverage =92%, HitCoverage=53%, E-value=1e-29, Identity=31%"; Hit description =CG15918-PA [Drosophila melanogaster] gb|AAF57892.1| CG15918-PA [Drosophila melanogaster]
  misc_feature: Gene Ontology Annotation: Biological process=regulation of protein activity, epigenetic
  misc_feature (118)..(118): Xaa can be any naturally occurring amino acid
  misc_feature (123)..(123): Xaa can be any naturally occurring amino acid
MALFAIKKIISLYIGVRTPQLQLAGNTSIEAYIASELAYDSSWPSLPSRRLFPYTLDYQSTEQCLLGAECPNEAFPGYWILPINDLTSPNGTECNSLATCGIEGSVDEIAKYLDDQIXRNLKXSRTPINLMINSYWFEQTDTSFDGLRKFLENTVAREAKDTFFVSQKQVLDFIKNPVKISDFKTADAPDGASCEPYTCRLKKGTEDRNMDACVPCPDEYPWINNVNV

SEQ ID NO: 37823 - protein, 60 aa, Diabrotica virgifera
  misc_feature: Coding regions on vcDNA: vcDNA=SeqID_17520; Strand=+; Position=65-247
DRLRNNPTRHPTGTNLKDMGTHYKNACSLIIPPPASSHIQEIYRWFRFVTTVISRKCIYF

SEQ ID NO: 37824 - protein, 98 aa, Diabrotica virgifera
  misc_feature: Coding regions on vcDNA: vcDNA=SeqID_17521; Strand=+; Position=67-363
FLSDKHFNNKNVLLLQNLVNLIHSFGDVNIRTKQLNPTLLKISGCRWDPVVQFAANKIIFKIISPLPPTYAAQFVLEDTFYKSILQINQKLLVPITCE

SEQ ID NO: 37825 - protein, 290 aa, Diabrotica virgifera
  misc_feature: Coding regions on vcDNA: vcDNA=SeqID_17522; Strand=+; Position=41-913
  misc_feature: Pfam annotation: Pfam_ID=zf-C2H2; Match level="Score=46.4, E-value =8.4e-11, Copies=3"; Pfam description=Zinc finger, C2H2 type
  misc_feature (273)..(273): Xaa can be any naturally occurring amino acid
MSADNHSKCRICLNMDNELNMNPCFDVNVDQICLASVFTNITGIKIEDCEYFPKKLCQSCTTSIISFKKFLAVFHETNARLKNQICKIEDGFEISDDGNSNFGNFEIYKNDGDCEISESEIRDVKKCYNGNSDKDEKQNVASNIKEEIKSSIEVPHQKNKLLPKQHEPLSEEYKTILSFKYTCHCGDCFLYKPGFRQHMLSRHDILLDETDFDRYSEEIEVKIPIGFPEFVESKVIVKKKKMQCRICNIRFLTKADVKAHEDIHKTFVCDQCXAAFLYKNYLADHLRVHF

SEQ ID NO: 37826 - protein, 236 aa, Diabrotica virgifera
  misc_feature: Coding regions on vcDNA: vcDNA=SeqID_17523; Strand=+; Position=175-885
MYIFRFNLKRISVWILILCQLFLIIIYFYSQLRPNSKTPENGVRFLKSEDDLGDTQMTYHVLKSNIILKTVNTRQSYIDFNSDLESMKISQGVNWKCTCLPGWHGNDCGIPEVMWRAVIASKKPYKIKGPRTFERRLIYLFKVNKFSEYLADMRINDLGEVVDLFILYEDEESNFLQNKLDSNFCKEYQQDDGENLWKKVKNYLKNINDDIILSDINELPNKDALVFLKSTIIHSL

SEQ ID NO: 37827 - protein, 163 aa, Diabrotica virgifera
  misc_feature: Coding regions on vcDNA: vcDNA=SeqID_17524; Strand=-; Position=2-490
  misc_feature (19)..(159): Xaa can be any naturally occurring amino acid
IIAHVLTGSNYFVINIILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRE

SEQ ID NO: 37828 - protein, 290 aa, Diabrotica virgifera
  misc_feature: Coding regions on vcDNA: vcDNA=SeqID_17525; Strand=+; Position=1-868
  misc_feature: Homolog annotation: Hit_ID=NP_648588.1; Match level="QueryCoverage =97%, HitCoverage=51%, E-value=6e-78, Identity=55%"; Hit description =CG10627-PA [Drosophila melanogaster] gb|AAF49901.1| CG10627-PA [Drosophila melanogaster]
  misc_feature: Gene Ontology Annotation: Molecular function=phosphoacetylglucosamine mutase activity; Cellular component=cellular_component unknown; Biological process=glucosamine metabolism
  misc_feature: Pfam annotation: Pfam_ID=PGM_PMM_I; Match level="Score=-35.2, E-value= 0.028, Copies=1"; Pfam description =Phosphoglucomutase/phosphomannomutase
  misc_feature (37)..(37): Xaa can be any naturally occurring amino acid
  misc_feature (46)..(46): Xaa can be any naturally occurring amino acid
  misc_feature (212)..(212): Xaa can be any naturally occurring amino acid
  misc_feature (279)..(279): Xaa can be any naturally occurring amino acid
  misc_feature (283)..(283): Xaa can be any naturally occurring amino acid
EKNHSNPTAGFRTKATEPHHVMYRMGLLAVLRARYKXLVVGVMITXASHNPEADNGVKIIDPHGEMLEETWETWATKFANVVDEKLEDTINEVIKLFNIDNMGDRVEVVIGKDTRPSSPTLAKAVQDGVLALSGKPVDYGIVTTPQVHYFVVCKNTNRAYGQPTEEGYYRKLINAFLRIRGDKYNKDNYDNRVIYDGANGVGAKKVKYFKRXLKDSLLVEMDNDEIIGSGKLNHLCGADHVKSQQKFPHGLPKEKILRCCSVDGDADRIVYYYLDDNEXFHLXLDGDRIA

SEQ ID NO: 37829 - protein, 44 aa, Diabrotica virgifera
  misc_feature: Coding regions on vcDNA: vcDNA=SeqID_17526; Strand=+; Position=2-136
  misc_feature (6)..(15): Xaa can be any naturally occurring amino acid
  misc_feature (22)..(32): Xaa can be any naturally occurring amino acid
  misc_feature (39)..(39): Xaa can be any naturally occurring amino acid
NSVILXXXXXXXXXXADLDVGXXXXXXXXXXXIKSGRLXKFYMI

SEQ ID NO: 37830 - protein, 108 aa, Diabrotica virgifera
  misc_feature: Coding regions on vcDNA: vcDNA=SeqID_17527; Strand=-; Position=24-350
  misc_feature (24)..(42): Xaa can be any naturally occurring amino acid
QRHKDNFNSSTNKFILILSILILXXXXXXXXXXXXXXXXXXXVSCPPFYLKSDIFIASNYLTLYPKVYRVRQITGPLEISRERQQNHENWNVGVLKDDLLNENIFISL

SEQ ID NO: 37831 - protein, 66 aa, Diabrotica virgifera; identical to SEQ ID NO: 26808
  misc_feature: Coding regions on vcDNA: vcDNA=SeqID_17528; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37832 - protein, 299 aa, Diabrotica virgifera
  misc_feature: Coding regions on vcDNA: vcDNA=SeqID_17529; Strand=-; Position=1-897
  misc_feature (2)..(68): Xaa can be any naturally occurring amino acid
  misc_feature (71)..(207): Xaa can be any naturally occurring amino acid
  misc_feature (211)..(235): Xaa can be any naturally occurring amino acid
  misc_feature (238)..(249): Xaa can be any naturally occurring amino acid
  misc_feature (275)..(281): Xaa can be any naturally occurring amino acid
  misc_feature (285)..(291): Xaa can be any naturally occurring amino acid
IXXXXXXXXXXXXXXXXXXXXXXXXXXXXXXXXXXXXXXXXXXXXXXXXXXXXXXXXXXXXXXXXXXXSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXINXXXXXXXXXXXXGTKNEIFLLEKRKDSLRIRINYVREXXXXXXXRERXXXXXXXKRKTPRVL

SEQ ID NO: 37833 - protein, 272 aa, Diabrotica virgifera
  misc_feature: Coding regions on vcDNA: vcDNA=SeqID_17530; Strand=-; Position=1-816
  misc_feature (4)..(18): Xaa can be any naturally occurring amino acid
  misc_feature (23)..(255): Xaa can be any naturally occurring amino acid
  misc_feature (257)..(272): Xaa can be any naturally occurring amino acid
YNKXXXXXXXXXXXXXXXGLSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 37834 - protein, 59 aa, Diabrotica virgifera
  misc_feature: Coding regions on vcDNA: vcDNA=SeqID_17531; Strand=+; Position=319-495
RPNRVYGLSMQIDRTAQGYRILKIYRVDELNRENYPLTREYDAAIEEAENNSLQSMRTS

SEQ ID NO: 37835 - protein, 319 aa, Diabrotica virgifera
  misc_feature: Coding regions on vcDNA: vcDNA=SeqID_17532; Strand=+; Position=41-995
  misc_feature: Homolog annotation: Hit_ID=XP_314216.1; Match level="QueryCoverage =99%, HitCoverage=31%, E-value=1e-119, Identity=64%"; Hit description= ENSANGP00000014378 [Anopheles gambiae]
  misc_feature: Gene Ontology Annotation: Molecular function=glycine dehydrogenase (decarboxylating) activity; Cellular component=mitochondrion; Biological process=one-carbon compound metabolism
  misc_feature: Pfam annotation: Pfam_ID=GDC-P; Match level="Score=-233.8, E-value=3e- 06, Copies=1"; Pfam description=Glycine cleavage system P-protein
  misc_feature (8)..(8): Xaa can be any naturally occurring amino acid
PRKQHIRXRDKATSNICTAQALLANMSAMFAVYHGPQGLKDIATKIHNLTLVLHHGLHQDGNTLSNKLFFDTLKIYPKLDVEEVKTRAQEKKINYRYYDDGAVGVALDETVTFNDVNDIFYTFGCPQKVENIVNSPMIRERAIYRSEYKRTSPFLTHPVFNSHHSETRIVRYMKILENKDISLVHSMIPLGSCTMKLNSTTEMMPCSFKHFTDIHPFAPTEQCQGYHQLFEELEQDLCTITGYDKISFQPNSGAQGEYAGLRAIQCYHEAKGEAHRDVCLYSISAHGTNPASAQMAGMKVEPIQVRADGTIDVSDLKAK

SEQ ID NO: 37836 - protein, 103 aa, Diabrotica virgifera
  misc_feature: Coding regions on vcDNA: vcDNA=SeqID_17533; Strand=+; Position=293-604
  misc_feature: Homolog annotation: Hit_ID=NP_648588.1; Match level="QueryCoverage =92%, HitCoverage=17%, E-value=9e-12, Identity=45%"; Hit description =CG10627-PA [Drosophila melanogaster] gb|AAF49901.1| CG10627-PA [Drosophila melanogaster]
  misc_feature (49)..(49): Xaa can be any naturally occurring amino acid
  misc_feature (61)..(61): Xaa can be any naturally occurring amino acid
TIYVIVNDTRSCIPTLLKAGHYGELVLTIKPVDYDIDSTPPDHYFGYCXYTNIIYGHPTEXGYYRKLINAFLRIRGVIYNKDNYDNREIYDGANEVCANKVII

SEQ ID NO: 37837 - protein, 182 aa, Diabrotica virgifera
  misc_feature: Coding regions on vcDNA: vcDNA=SeqID_17534; Strand=-; Position=115-663
FIIGTSRQDVYLSKPLYKYCYSVTIFHISTIISLSIIVVVFIIIYTSYPYKSAYHSSVVTFLCGTTISYISIFSIYNIMVLSHCVNNHNVLVTPPKLLFHNVRLSAVCACCHQCRSLFLAMLSLVHVVDLQEFASSYLSVYPIFRQHLLSISRFFFDRFIHTSFHEDRVGYQPIRSLSSITL

SEQ ID NO: 37838 - protein, 96 aa, Diabrotica virgifera
  misc_feature: Coding regions on vcDNA: vcDNA=SeqID_17535; Strand=+; Position=470-760
KRISKCLEIGLHSKIVPLLNKGPHAARVSIAVRLWIVAKCYIHTLFLRNNASDLEIVPQLIPQDICNIFRICESFIVFIRMINVLFKTAYKTYFLY

SEQ ID NO: 37839 - protein, 272 aa, Diabrotica virgifera
  misc_feature: Coding regions on vcDNA: vcDNA=SeqID_17536; Strand=+; Position=96-914
  misc_feature: Homolog annotation: Hit_ID=NP_659557.1; Match level="QueryCoverage =52%, HitCoverage=43%, E-value=6e-34, Identity=55%"; Hit description =asparaginase-like sperm autoantigen [Rattus norvegicus] gb|AAL41029.1| asparaginase-like
  misc_feature: Gene Ontology Annotation: Molecular function=N4-(beta-N -acetylglucosaminyl)-L-asparaginase activity; Cellular component =lysosome; Biological process=protein deglycosylation
  misc_feature: Pfam annotation: Pfam_ID=Asparaginase_2; Match level="Score=-7.6, E -value=2.1e-11, Copies=1"; Pfam description=Asparaginase
  misc_feature (151)..(215): Xaa can be any naturally occurring amino acid
  misc_feature (263)..(263): Xaa can be any naturally occurring amino acid
MAGDIPDSRNEGKIQGLRKSMEIGFKILKEGGSALDAVEQAVRYMENDENFNAGYGSVLNLDGEVEMDASIMVGSTLSAGAVTVVKDIKHPISLARLVMEKTPHVLLAADGASKFAKDHGFPTTDPVSLISPDAKKALAEFIRKGGDLTEXXXXXXXXXXXXXXXXXXXXXXXXXXXXXXXXXXXXXXXXXXXXXXXXXXXXXXXXXXXXXXXXXDTIIKYCLAIAIIKDIENGKSAQEATEQNMKRMTKRLNNTAGAITLSXNGEPGIYFT

SEQ ID NO: 37840 - protein, 85 aa, Diabrotica virgifera
  misc_feature: Coding regions on vcDNA: vcDNA=SeqID_17537; Strand=+; Position=543-797
  misc_feature (39)..(46): Xaa can be any naturally occurring amino acid
  misc_feature (48)..(59): Xaa can be any naturally occurring amino acid
  misc_feature (63)..(71): Xaa can be any naturally occurring amino acid
  misc_feature (81)..(85): Xaa can be any naturally occurring amino acid
YEYQQILYALRIYRFTKAIRHHSFHLSTTNTSSCIQYQXXXXXXXXRXXXXXXXXXXXXVLRXXXXXXXXXWNDKKDCLYXXXXX

SEQ ID NO: 37841 - protein, 317 aa, Diabrotica virgifera
  misc_feature: Coding regions on vcDNA: vcDNA=SeqID_17538; Strand=+; Position=3-950
  misc_feature: Homolog annotation: Hit_ID=XP_311070.1; Match level="QueryCoverage =99%, HitCoverage=44%, E-value=1e-115, Identity=61%"; Hit description= ENSANGP00000008170 [Anopheles gambiae]
  misc_feature: Gene Ontology Annotation: Cellular component=integral to membrane; Biological process=skeletal development
  misc_feature (245)..(245): Xaa can be any naturally occurring amino acid
  misc_feature (248)..(248): Xaa can be any naturally occurring amino acid
  misc_feature (272)..(272): Xaa can be any naturally occurring amino acid
  misc_feature (279)..(279): Xaa can be any naturally occurring amino acid
  misc_feature (308)..(308): Xaa can be any naturally occurring amino acid
IFCLVFRGERMGQLVLLEAMAANCIPVIVADGHVMPFRNIIDWKRFSVFIMESHLSTLMDVLNNISDKRIRQMQQNLLYIYQKYFSSMKSIVLTTLDILQDRVYPHLGKTYDELNLKPDEINNNPLFFPMTSPKSHGFSAVILTYDRVESLFMLIERLSKVPSLMKIIVVWNNQRKSPPPLSEFPKIQKPVNVIRTHANKLSNRFYPYKEIETEAVLHIDDDIVMLTSDEVEFAYEVWREFPDRXIVXFPSRTHIWDNVTQMWKYESEWTNXISMVLTXAAFLHKYWSFLYTNYMPVEVKDWVDEHMXNCEDIAMNF

SEQ ID NO: 37842 - protein, 96 aa, Diabrotica virgifera
  misc_feature: Coding regions on vcDNA: vcDNA=SeqID_17539; Strand=-; Position=116-406
  misc_feature (41)..(57): Xaa can be any naturally occurring amino acid
YHMQISNRICLNMTLRQYSLSTEKLIYTNGLSLISQTKISXXXXXXXXXXXXXXXXXYLLYVIQNYSYSKPHHIAEQKHDIITLTLLHHFLPFKLF

SEQ ID NO: 37843 - protein, 66 aa, Diabrotica virgifera; identical to SEQ ID NO: 26808
  misc_feature: Coding regions on vcDNA: vcDNA=SeqID_17540; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37844 - protein, 241 aa, Diabrotica virgifera
  misc_feature: Coding regions on vcDNA: vcDNA=SeqID_17541; Strand=-; Position=1-723
  misc_feature (2)..(241): Xaa can be any naturally occurring amino acid
DXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37845 - protein, 63 aa, Diabrotica virgifera
  misc_feature: Coding regions on vcDNA: vcDNA=SeqID_17542; Strand=+; Position=425-616
TSCLMTHHNRLREQLAPLNNLQTYHRVRTTESIVDTLGRHDRRPHSRESLSNSRFDGLLKSLL

SEQ ID NO: 37846 - protein, 65 aa, Diabrotica virgifera
  misc_feature: Coding regions on vcDNA: vcDNA=SeqID_17543; Strand=+; Position=42-239
RKKFSLYNIVQFGIRSGGSLLFLNGKFSLFVPSGYSEESHSISINLNHNPNYIFFEILKMVAQKN

SEQ ID NO: 37847 - protein, 209 aa, Diabrotica virgifera
  misc_feature: Coding regions on vcDNA: vcDNA=SeqID_17544; Strand=+; Position=168-797
  misc_feature (3)..(19): Xaa can be any naturally occurring amino acid
  misc_feature (22)..(67): Xaa can be any naturally occurring amino acid
  misc_feature (86)..(126): Xaa can be any naturally occurring amino acid
  misc_feature (135)..(141): Xaa can be any naturally occurring amino acid
  misc_feature (144)..(203): Xaa can be any naturally occurring amino acid
RNXXXXXXXXXXXXXXXXXFLXXXXXXXXXXXXXXXXXXXXXXXXXXXXXXXXXXXXXXXXXXXXXXLLFIFHIFINFSFFINFFXXXXXXXXXXXXXXXXXXXXXXXXXXXXXXXXXXXXXXXXXVIKNTSFWXXXXXXXAHXXXXXXXXXXXXXXXXXXXXXXXXXXXXXXXXXXXXXXXXXXXXXXXXXXXXXXXXXXXXIEFINY

SEQ ID NO: 37848 - protein, 49 aa, Diabrotica virgifera
  misc_feature: Coding regions on vcDNA: vcDNA=SeqID_17545; Strand=+; Position=62-211
LPLLKGPRLVLIVTILLRIFRFIAIGSCVAANSHHSLTAMTEEFRGRRR

SEQ ID NO: 37849 - protein, 46 aa, Diabrotica virgifera
  misc_feature: Coding regions on vcDNA: vcDNA=SeqID_17546; Strand=+; Position=1-138
  misc_feature (6)..(43): Xaa can be any naturally occurring amino acid
NGKVIXXXXXXXXXXXXXXXXXXXXXXXXXXXXXXXXXXXXXXGEG

SEQ ID NO: 37850 - protein, 169 aa, Diabrotica virgifera
  misc_feature: Coding regions on vcDNA: vcDNA=SeqID_17547; Strand=+; Position=1-510
  misc_feature: Pfam annotation: Pfam_ID=Pacifastin_I; Match level="Score=8.2, E -value=0.0096, Copies=1"; Pfam description=Pacifastin inhibitor (LCMII)
  misc_feature (114)..(123): Xaa can be any naturally occurring amino acid
  misc_feature (162)..(168): Xaa can be any naturally occurring amino acid
VTVFVEYSLGGTDDSACPPLVKFRKGCNICICSPNGYDYTCTQNKCHPTKRNDNLERLLSDEDYYKDDMSNAIDSKSTSDSVEMDEDESDEEYEMPDEKEGRFRDNNELDSDDXXXXXXXXXXDGDPDFDPDSFYDNFDSEHDDNYVGKGRPVTRRRYKKFXXXXXXXI

SEQ ID NO: 37851 - protein, 313 aa, Diabrotica virgifera
  misc_feature: Coding regions on vcDNA: vcDNA=SeqID_17548; Strand=-; Position=1-942
  misc_feature (7)..(17): Xaa can be any naturally occurring amino acid
  misc_feature (27)..(35): Xaa can be any naturally occurring amino acid
  misc_feature (37)..(50): Xaa can be any naturally occurring amino acid
  misc_feature (57)..(69): Xaa can be any naturally occurring amino acid
  misc_feature (71)..(312): Xaa can be any naturally occurring amino acid
FIYWSFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 37852 - protein, 32 aa, Diabrotica virgifera
  misc_feature: Coding regions on vcDNA: vcDNA=SeqID_17549; Strand=-; Position=1-96
VQINIHNFNINGSFSSVLSLPSLNSRYVSRIS

SEQ ID NO: 37853 - protein, 25 aa, Diabrotica virgifera
  misc_feature: Coding regions on vcDNA: vcDNA=SeqID_17550; Strand=-; Position=0-74
  misc_feature (5)..(24): Xaa can be any naturally occurring amino acid
KKWDXXXXXXXXXXXXXXXXXXXXT

SEQ ID NO: 37854 - protein, 242 aa, Diabrotica virgifera
  misc_feature: Coding regions on vcDNA: vcDNA=SeqID_17551; Strand=+; Position=1-723
  misc_feature: Homolog annotation: Hit_ID=AAF87760.1; Match level="QueryCoverage =100%, HitCoverage=54%, E-value=3e-89, Identity=73%"; Hit description= cytochrome oxidase subunit I [Diabrotica virgifera zeae]
  misc_feature: Pfam annotation: Pfam_ID=COX1; Match level="Score=-151.0, E-value =4.1e-06, Copies=1"; Pfam description=Cytochrome C and Quinol oxidase polyp
  misc_feature (21)..(21): Xaa can be any naturally occurring amino acid
  misc_feature (47)..(47): Xaa can be any naturally occurring amino acid
  misc_feature (57)..(57): Xaa can be any naturally occurring amino acid
  misc_feature (74)..(74): Xaa can be any naturally occurring amino acid
  misc_feature (77)..(83): Xaa can be any naturally occurring amino acid
  misc_feature (110)..(116): Xaa can be any naturally occurring amino acid
  misc_feature (130)..(130): Xaa can be any naturally occurring amino acid
  misc_feature (138)..(154): Xaa can be any naturally occurring amino acid
  misc_feature (184)..(184): Xaa can be any naturally occurring amino acid
  misc_feature (200)..(207): Xaa can be any naturally occurring amino acid
  misc_feature (228)..(228): Xaa can be any naturally occurring amino acid
FGTLGIIYAIIAIGLLGFIVXSSHIFTVGMDVDTRAYFTSATIIIAXVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSEL

SEQ ID NO: 37855 - protein, 194 aa, Diabrotica virgifera
  misc_feature: Coding regions on vcDNA: vcDNA=SeqID_17552; Strand=+; Position=323-904
  misc_feature (7)..(13): Xaa can be any naturally occurring amino acid
  misc_feature (15)..(21): Xaa can be any naturally occurring amino acid
  misc_feature (31)..(50): Xaa can be any naturally occurring amino acid
  misc_feature (68)..(83): Xaa can be any naturally occurring amino acid
  misc_feature (85)..(120): Xaa can be any naturally occurring amino acid
  misc_feature (132)..(141): Xaa can be any naturally occurring amino acid
  misc_feature (148)..(155): Xaa can be any naturally occurring amino acid
  misc_feature (158)..(188): Xaa can be any naturally occurring amino acid
SKQYILXXXXXXXYXXXXXXXGSSSKNKIFXXXXXXXXXXXXXXXXXXXXVNNLNLLIILIILIFFIXXXXXXXXXXXXXXXXDXXXXXXXXXXXXXXXXXXXXXXXXXXXXXXXXXXXXGLNIKVSPGPLXXXXXXXXXXGAKVANXXXXXXXXGMXXXXXXXXXXXXXXXXXXXXXXXXXXXXXXXDPYRVL

SEQ ID NO: 37856 - protein, 167 aa, Diabrotica virgifera
  misc_feature: Coding regions on vcDNA: vcDNA=SeqID_17553; Strand=+; Position=228-731
  misc_feature (4)..(13): Xaa can be any naturally occurring amino acid
  misc_feature (20)..(27): Xaa can be any naturally occurring amino acid
  misc_feature (78)..(84): Xaa can be any naturally occurring amino acid
  misc_feature (86)..(93): Xaa can be any naturally occurring amino acid
  misc_feature (123)..(142): Xaa can be any naturally occurring amino acid
  misc_feature (150)..(157): Xaa can be any naturally occurring amino acid
NKYXXXXXXXXXXIPLLNTXXXXXXXXISISSPYIYNYLIFILLILNTFSDVLNNRTLLYVNSYIEIRTKHFHILEYXXXXXXXSXXXXXXXXLSTYKSTSSKFRNDDNITIKKFVYITKPYXXXXXXXXXXXXXXXXXXXXVLMTWSRXXXXXXXXTRYFDRAKVA

SEQ ID NO: 37857 - protein, 65 aa, Diabrotica virgifera
  misc_feature: Coding regions on vcDNA: vcDNA=SeqID_17554; Strand=+; Position=287-484
  misc_feature (42)..(48): Xaa can be any naturally occurring amino acid
CDINSQSSIKTIFMIEIILKYWCIRHLTASASDIKSSIEMYXXXXXXXSLLFSIYHECYKSIFIE

SEQ ID NO: 37858 - protein, 87 aa, Diabrotica virgifera
  misc_feature: Coding regions on vcDNA: vcDNA=SeqID_17555; Strand=+; Position=3-266
DRPYNSIKANDRCHLTARGTKMFEEHYPCAHKRTKSYSVKFYRFIRLNNIAATPIINFNPTSRTQSLLSTRSLQYDYYDIPMVIYTL

SEQ ID NO: 37859 - protein, 84 aa, Diabrotica virgifera
  misc_feature: Coding regions on vcDNA: vcDNA=SeqID_17556; Strand=-; Position=113-367
SPRRQHSLISMIYDAFHDNYFFDYMSLINRFYEEVIFESGVSYLDIGILYNMSFTISVPISGPLYTRSPFMFVYGHISTLYFFF

SEQ ID NO: 37860 - protein, 194 aa, Diabrotica virgifera
  misc_feature: Coding regions on vcDNA: vcDNA=SeqID_17557; Strand=+; Position=260-844
  misc_feature: Homolog annotation: Hit_ID=XP_394020.1; Match level="QueryCoverage =65%, HitCoverage=20%, E-value=3e-24, Identity=42%"; Hit description =similar to CG15104-PA [Apis mellifera]
  misc_feature: Pfam annotation: Pfam_ID=zf-C3HC4; Match level="Score=27.4, E-value =3e-05, Copies=1"; Pfam description=Zinc finger, C3HC4 type (RING finger)
MAESRLLIKRPSSSSPPPNCAICLGSFSNKCVSDTCLHQFCFKCLLEWSKIKAECPLCKQPFTRILHNIKNNGEYDEHVVDILANDLTAEEIHVEEIREYNTFLPNALPPTRHHFHFRTTFTVDTHGEHAIQQMLLTHPQISVSTSGYPERHSAYHRRRREIPRREMPRREIPTTTAFRRSVYTRNLWAIAPPD

SEQ ID NO: 37861 - protein, 78 aa, Diabrotica virgifera
  misc_feature: Coding regions on vcDNA: vcDNA=SeqID_17558; Strand=-; Position=3-236
  misc_feature (1)..(12): Xaa can be any naturally occurring amino acid
  misc_feature (15)..(24): Xaa can be any naturally occurring amino acid
  misc_feature (28)..(28): Xaa can be any naturally occurring amino acid
  misc_feature (40)..(41): Xaa can be any naturally occurring amino acid
  misc_feature (45)..(58): Xaa can be any naturally occurring amino acid
  misc_feature (65)..(77): Xaa can be any naturally occurring amino acid
XXXXXXXXXXXXSFXXXXXXXXXXRNHXGSHRFKLRSCKXXKVEXXXXXXXXXXXXXXSNIEVAXXXXXXXXXXXXXC

SEQ ID NO: 37862 - protein, 134 aa, Diabrotica virgifera
  misc_feature: Coding regions on vcDNA: vcDNA=SeqID_17559; Strand=+; Position=4-408
  misc_feature: Homolog annotation: Hit_ID=NP_725699.1; Match level="QueryCoverage =97%, HitCoverage=85%, E-value=1e-17, Identity=38%"; Hit description =CG30105-PA [Drosophila melanogaster] gb|AAM68481.1| CG30105-PA [Drosophila melanogaster]
  misc_feature (34)..(42): Xaa can be any naturally occurring amino acid
RFIYSGKNNLDCKNRTSNIQSVPFKVHADCDAKXXXXXXXXXKADENEQLTSSFRGYPLKGKHVNLPDGYFGLVLHESIRPETEKCDRKLYVTNMFSQLTHWNWDKQPSKNDTIVQALDWIDIAEALHSPILEE

SEQ ID NO: 37863 - protein, 318 aa, Diabrotica virgifera
  misc_feature: Coding regions on vcDNA: vcDNA=SeqID_17560; Strand=+; Position=41-994
  misc_feature (15)..(23): Xaa can be any naturally occurring amino acid
  misc_feature (42)..(81): Xaa can be any naturally occurring amino acid
  misc_feature (84)..(147): Xaa can be any naturally occurring amino acid
  misc_feature (154)..(222): Xaa can be any naturally occurring amino acid
  misc_feature (225)..(316): Xaa can be any naturally occurring amino acid
KVDSKNSSSLNRSVXXXXXXXXXLSHLSLSNRNNLIFSRTSXXXXXXXXXXXXXXXXXXXXXXXXXXXXXXXXXXXXXXXXKRXXXXXXXXXXXXXXXXXXXXXXXXXXXXXXXXXXXXXXXXXXXXXXXXXXXXXXXXXXXXXXXXVIISFFXXXXXXXXXXXXXXXXXXXXXXXXXXXXXXXXXXXXXXXXXXXXXXXXXXXXXXXXXXXXXXXXXXXXXPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHI

SEQ ID NO: 37864 - protein, 169 aa, Diabrotica virgifera
  misc_feature: Coding regions on vcDNA: vcDNA=SeqID_17561; Strand=+; Position=2-511
  misc_feature (1)..(64): Xaa can be any naturally occurring amino acid
  misc_feature (67)..(135): Xaa can be any naturally occurring amino acid
  misc_feature (137)..(151): Xaa can be any naturally occurring amino acid
XXXXXXXXXXXXXXXXXXXXXXXXXXXXXXXXXXXXXXXXXXXXXXXXXXXXXXXXXXXXXXXXFRXXXXXXXXXXXXXXXXXXXXXXXXXXXXXXXXXXXXXXXXXXXXXXXXXXXXXXXXXXXXXXXXXXXXXYXXXXXXXXXXXXXXXIVKMRILVLEYCIFSRNI

SEQ ID NO: 37865 - protein, 79 aa, Diabrotica virgifera
  misc_feature: Coding regions on vcDNA: vcDNA=SeqID_17562; Strand=+; Position=121-360
  misc_feature (58)..(64): Xaa can be any naturally occurring amino acid
  misc_feature (67)..(73): Xaa can be any naturally occurring amino acid
PRHCNLTMLNYSLLASWYSVNEPSYANKNCLYFFYQQIYFQLNNLKLYQSTITPNTLXXXXXXXFFXXXXXXXKTYLIA

SEQ ID NO: 37866 - protein, 100 aa, Diabrotica virgifera; identical to SEQ ID NO: 30473
  misc_feature: Coding regions on vcDNA: vcDNA=SeqID_17563; Strand=-; Position=0-299
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(99): Xaa can be any naturally occurring amino acid

SEQ ID NO: 37867 - protein, 267 aa, Diabrotica virgifera
  misc_feature: Coding regions on vcDNA: vcDNA=SeqID_17564; Strand=+; Position=75-875
  misc_feature (22)..(35): Xaa can be any naturally occurring amino acid
  misc_feature (37)..(48): Xaa can be any naturally occurring amino acid
  misc_feature (50)..(58): Xaa can be any naturally occurring amino acid
  misc_feature (65)..(199): Xaa can be any naturally occurring amino acid
  misc_feature (212)..(229): Xaa can be any naturally occurring amino acid
  misc_feature (232)..(264): Xaa can be any naturally occurring amino acid
LIQYPRVNTSLSKRKIYFSYLXXXXXXXXXXXXXXYXXXXXXXXXXXXTXXXXXXXXXPVTKRYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRLAHWINLEGPXXXXXXXXXXXXXXXXXXGKXXXXXXXXXXXXXXXXXXXXXXXXXXXXXXXXXYRG

SEQ ID NO: 37868 - protein, 103 aa, Diabrotica virgifera
  misc_feature: Coding regions on vcDNA: vcDNA=SeqID_17565; Strand=-; Position=22-333
  misc_feature (42)..(48): Xaa can be any naturally occurring amino acid
  misc_feature (57)..(65): Xaa can be any naturally occurring amino acid
  misc_feature (67)..(73): Xaa can be any naturally occurring amino acid
NFILPWRMRRQTVCSSLLIFKDSICISANKSLKEYISVFSKXXXXXXXVLFICLPRXXXXXXXXXVXXXXXXXYFYTSLGLLNLSVCMRNLVSCQSKGSLAPW

SEQ ID NO: 37869 - protein, 66 aa, Diabrotica virgifera
  misc_feature: Coding regions on vcDNA: vcDNA=SeqID_17566; Strand=-; Position=2-199
  misc_feature (3)..(9): Xaa can be any naturally occurring amino acid
  misc_feature (22)..(30): Xaa can be any naturally occurring amino acid
  misc_feature (45)..(45): Xaa can be any naturally occurring amino acid
  misc_feature (52)..(65): Xaa can be any naturally occurring amino acid
SFXXXXXXXIKIENNLASHGLXXXXXXXXXRPDLIYIAATPIINXNPTSRSXXXXXXXXXXXXXXV

SEQ ID NO: 37870 - protein, 28 aa, Diabrotica virgifera
  misc_feature: Coding regions on vcDNA: vcDNA=SeqID_17567; Strand=+; Position=12-95
  misc_feature (11)..(17): Xaa can be any naturally occurring amino acid
MFYSKQKLPTXXXXXXXETEYNKYHLNI

SEQ ID NO: 37871 - protein, 95 aa, Diabrotica virgifera
  misc_feature: Coding regions on vcDNA: vcDNA=SeqID_17568; Strand=-; Position=518-805
  misc_feature (2)..(34): Xaa can be any naturally occurring amino acid
  misc_feature (42)..(70): Xaa can be any naturally occurring amino acid
  misc_feature (73)..(90): Xaa can be any naturally occurring amino acid
YXXXXXXXXXXXXXXXXXXXXXXXXXXXXXXXXXLIIIHPLXXXXXXXXXXXXXXXXXXXXXXXXXXXXXINXXXXXXXXXXXXXXXXXXKFRIF

SEQ ID NO: 37872 - protein, 97 aa, Diabrotica virgifera
  misc_feature: Coding regions on vcDNA: vcDNA=SeqID_17569; Strand=+; Position=3-293
PPPPPRKRVLLGNVYPRDRSDSISQERSWPPWSVRGRFCKNLKVFSCRMCLMDHDSLMKTHLTIEFIENLKRQQIPDLCVFYSSCLPSQLRRTRHRR

SEQ ID NO: 37873 - protein, 200 aa, Diabrotica virgifera
  misc_feature: Coding regions on vcDNA: vcDNA=SeqID_17570; Strand=+; Position=82-684
  misc_feature: Homolog annotation: Hit_ID=XP_319394.1; Match level="QueryCoverage =82%, HitCoverage=79%, E-value=3e-57, Identity=67%"; Hit description =ENSANGP00000012211 [Anopheles gambiae]
  misc_feature: Gene Ontology Annotation: Cellular component=integral to membrane
  misc_feature: Pfam annotation: Pfam_ID=Tim17; Match level="Score=89.4, E-value=9.3e- 24, Copies=1"; Pfam description=Tim17/Tim22/Tim23 family
MSSLNDSNDVYSSNYSSRSGLHGKVSPFSSPYLNYDPGYLPQAQPEFIFLDGASKQRGRFELAFGQIGGSCMIGAALGGASGFYNGLKATTLAGQTGKLRRTQLINYIMKKGSATANTFGSVAVIYSAFGVILSWARGGTDDDLNTIVAATATGCLYKSTAGLRKCGLGGAIGLGVSTAYALWVNRDKLSELRQFNPAQR

SEQ ID NO: 37874 - protein, 136 aa, Diabrotica virgifera
  misc_feature: Coding regions on vcDNA: vcDNA=SeqID_17571; Strand=-; Position=217-627
  misc_feature (4)..(12): Xaa can be any naturally occurring amino acid
  misc_feature (28)..(35): Xaa can be any naturally occurring amino acid
  misc_feature (42)..(61): Xaa can be any naturally occurring amino acid
  misc_feature (72)..(99): Xaa can be any naturally occurring amino acid
  misc_feature (103)..(135): Xaa can be any naturally occurring amino acid
LHSXXXXXXXXXYLTTVKIPRPSNYPVXXXXXXXXPKDLFLXXXXXXXXXXXXXXXXXXXXIPNFLILIIIXXXXXXXXXXXXXXXXXXXXXXXXXXXXIINXXXXXXXXXXXXXXXXXXXXXXXXXXXXXXXXXI

SEQ ID NO: 37875 - protein, 298 aa, Diabrotica virgifera
  misc_feature: Coding regions on vcDNA: vcDNA=SeqID_17572; Strand=+; Position=1-894
  misc_feature (3)..(10): Xaa can be any naturally occurring amino acid
  misc_feature (49)..(58): Xaa can be any naturally occurring amino acid
  misc_feature (63)..(87): Xaa can be any naturally occurring amino acid
  misc_feature (91)..(229): Xaa can be any naturally occurring amino acid
  misc_feature (232)..(278): Xaa can be any naturally occurring amino acid
  misc_feature (280)..(286): Xaa can be any naturally occurring amino acid
  misc_feature (290)..(290): Xaa can be any naturally occurring amino acid
  misc_feature (296)..(296): Xaa can be any naturally occurring amino acid
FLXXXXXXXXFLRKCKEKFSHLSTIVNSVFVREIFLSLSKRKISFSYLXXXXXXXXXXSSFHXXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHXXXXXXXXXXXXXXXXXXXXXXXXXXXXXXXXXXXXXXXXXXXXXXXVXXXXXXXRREXLIEFIXYL

SEQ ID NO: 37876 - protein, 66 aa, Diabrotica virgifera
  misc_feature: Coding regions on vcDNA: vcDNA=SeqID_17573; Strand=-; Position=2-199
  misc_feature (2)..(13): Xaa can be any naturally occurring amino acid
  misc_feature (17)..(17): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXXXPTWXHTGLNXXXXXXXXSNXXXXXXXXXXXXXXPTSRSXXXXXXXXXXXXXXV

SEQ ID NO: 37877 - protein, 82 aa, Diabrotica virgifera
  misc_feature: Coding regions on vcDNA: vcDNA=SeqID_17574; Strand=-; Position=130-378
  misc_feature (66)..(72): Xaa can be any naturally occurring amino acid
KIYRMAPKTTTRGGGVGGYFKILNRNPHFLLQIWILYVKVSNFYSRNFFELWIDGAIIGKTIVGNXXXXXXXESPPLSSMLD

SEQ ID NO: 37878 - protein, 46 aa, Diabrotica virgifera
  misc_feature: Coding regions on vcDNA: vcDNA=SeqID_17575; Strand=-; Position=2-139
  misc_feature (4)..(11): Xaa can be any naturally occurring amino acid
  misc_feature (14)..(21): Xaa can be any naturally occurring amino acid
  misc_feature (32)..(45): Xaa can be any naturally occurring amino acid
GLNXXXXXXXXRPXXXXXXXXQYNSNPPSRSXXXXXXXXXXXXXXV

SEQ ID NO: 37879 - protein, 92 aa, Diabrotica virgifera
  misc_feature: Coding regions on vcDNA: vcDNA=SeqID_17576; Strand=+; Position=321-599
  misc_feature (18)..(19): Xaa can be any naturally occurring amino acid
  misc_feature (25)..(25): Xaa can be any naturally occurring amino acid
  misc_feature (36)..(49): Xaa can be any naturally occurring amino acid
  misc_feature (69)..(76): Xaa can be any naturally occurring amino acid
LKGLQLINFLQLYNIEMXXSIFNMXYFKMVVYFKTXXXXXXXXXXXXXXYTWRTPRLFVILGDGSILWXXXXXXXXCSLVINQFFKFEIFCG

SEQ ID NO: 37880 - protein, 101 aa, Diabrotica virgifera
  misc_feature: Coding regions on vcDNA: vcDNA=SeqID_17577; Strand=+; Position=108-413
TLPQRFPPSRLTVSEQHNDSLTAAVHGIHRGMYHRKIPISGSARTSCLTVVPKRSQSVHSGRNDPRPRSYAVIERASQICQGSLPCGKKYHFRGRIRTVHR

SEQ ID NO: 37881 - protein, 94 aa, Diabrotica virgifera
  misc_feature: Coding regions on vcDNA: vcDNA=SeqID_17578; Strand=+; Position=529-813
  misc_feature (58)..(58): Xaa can be any naturally occurring amino acid
  misc_feature (65)..(65): Xaa can be any naturally occurring amino acid
NKSVSIIKFYNIVRQSKILRLVKMLTEMLTENKSLMMIIKHKFFLFFSFISRIENRLXDFDPSLXFLWRRPWKDNTKREKFNLVCLSVYPSYRE

SEQ ID NO: 37882 - protein, 66 aa, Diabrotica virgifera
  misc_feature: Coding regions on vcDNA: vcDNA=SeqID_17579; Strand=-; Position=410-610
ISVNGYNVPLSCLLIPERLLATSGFISLYRYSVRSWVECVSSSWNLSICFGDHTTLSGDVYSYMIL

SEQ ID NO: 37883 - protein, 205 aa, Diabrotica virgifera
  misc_feature: Coding regions on vcDNA: vcDNA=SeqID_17580; Strand=-; Position=1-615
  misc_feature (1)..(9): Xaa can be any naturally occurring amino acid
  misc_feature (12)..(19): Xaa can be any naturally occurring amino acid
  misc_feature (24)..(24): Xaa can be any naturally occurring amino acid
  misc_feature (32)..(40): Xaa can be any naturally occurring amino acid
  misc_feature (42)..(55): Xaa can be any naturally occurring amino acid
  misc_feature (62)..(74): Xaa can be any naturally occurring amino acid
  misc_feature (76)..(205): Xaa can be any naturally occurring amino acid
XXXXXXXXXSFXXXXXXXXKDRNXPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37884 - protein, 61 aa, Diabrotica virgifera
  misc_feature: Coding regions on vcDNA: vcDNA=SeqID_17581; Strand=-; Position=161-346
GNFIFYLFLRRMMKYIEIPHFANFLISNLMDSSFFLRANEVFRWITDVNLLEPNPSLFNYV

SEQ ID NO: 37885 - protein, 168 aa, Diabrotica virgifera
  misc_feature: Coding regions on vcDNA: vcDNA=SeqID_17582; Strand=+; Position=2-508
  misc_feature: Homolog annotation: Hit_ID=AAA98076.1; Match level="QueryCoverage =100%, HitCoverage=72%, E-value=3e-32, Identity=46%"; Hit description= nuclear protein
  misc_feature: Gene Ontology Annotation: Molecular function=pre-mRNA splicing factor activity; Cellular component=nucleus; Biological process=mRNA splice site selection
  misc_feature (87)..(106): Xaa can be any naturally occurring amino acid
SRSRSKSRSKSRSKSRSKSRSKSRSRSKSKSQSRSRSRSKSRSRSHSRSRSRSKSRSKSRSRSKSKSKSKSRSRSKSQSKSPSRSRXXXXXXXXXXXXXXXXXXXXSGSRSRSPSKSKSRSRSRSRSGSKSASRSRSSSKASSKSGSRSRSGSRSGSGSESGSGSESD

SEQ ID NO: 37886 - protein, 288 aa, Diabrotica virgifera
  misc_feature: Coding regions on vcDNA: vcDNA=SeqID_17583; Strand=+; Position=61-924
  misc_feature: Homolog annotation: Hit_ID=XP_393114.1; Match level="QueryCoverage =93%, HitCoverage=28%, E-value=2e-73, Identity=53%"; Hit description =similar to CG7147-PA [Apis mellifera]
  misc_feature: Gene Ontology Annotation: Molecular function=metallopeptidase activity; Cellular component=integral to plasma membrane; Biological process=cell-cell signaling
  misc_feature: Pfam annotation: Pfam_ID=Pep_M12B_propep; Match level="Score=-30.0, E- value=0.06, Copies=1"; Pfam description=Reprolysin family propeptide
  misc_feature (263)..(263): Xaa can be any naturally occurring amino acid
FWVCVLIVLCIILNCACKTMFSDCVAVLLLLLVLPFIESAERLNEYIRHYETLAYDTEAVHRAHTRAKRSIASDNYVHVAFKAHGHDFRVRLKRDLHVFQDKLEVQGPTGEPLDVDTSHIYQGHILGEPDSVAFGSIIEGVFEGKLMLPSKGAFYVEKAHHYFPHTTHPNRTFHSVIYHEDHVEDPYAHKREGHSAGCGINDDVIEWMNKIQSSGEDLPITPSTVAFKKAVKHKKHLKTKKDKEEPNPLPNYEDVVNKYSKEXKMTSNSRHRRATRKRQKQNTCSLYI

SEQ ID NO: 37887 - protein, 67 aa, Diabrotica virgifera
  misc_feature: Coding regions on vcDNA: vcDNA=SeqID_17584; Strand=+; Position=122-325
  misc_feature (53)..(59): Xaa can be any naturally occurring amino acid
GLDLNIWCHILFYNKGDLIYSCFSCKTDSFNNVFPFIGFFLCKCISFLFKSLXXXXXXXLCNWIFLS

SEQ ID NO: 37888 - protein, 217 aa, Diabrotica virgifera
  misc_feature: Coding regions on vcDNA: vcDNA=SeqID_17585; Strand=+; Position=81-734
  misc_feature: Homolog annotation: Hit_ID=XP_311768.1; Match level="QueryCoverage =94%, HitCoverage=72%, E-value=2e-83, Identity=68%"; Hit description =ENSANGP00000014320 [Anopheles gambiae]
  misc_feature: Gene Ontology Annotation: Molecular function=CDP-diacylglycerol -inositol 3-phosphatidyltransferase activity; Cellular component =endoplasmic reticulum; Biological process=signal transduction
  misc_feature: Pfam annotation: Pfam_ID=CDP-OH_P_transf; Match level="Score=106.5, E- value=6.9e-29, Copies=1"; Pfam description=CDP-alcohol phosphatidyltransferase
MSDENIFIFVPNIIGYARIVLAIISFYFMPTNYIIACSCYVISALLDAFDGHAARYFNQSTKFGAMLDQLTDRCGTMGLVAVLAHFYPKYMFLFILSMCIDIACHWIYLHSSILQGKTSHKFVDMSENPIMRLYYTNKNVLFVMCAGNEAFYAALYLLHFTEGPIIAGLGLWRIIIFLSAPICFIKTGISLLHCVVASKNLAIIDINERKNATKKAF

SEQ ID NO: 37889 - protein, 82 aa, Diabrotica virgifera; identical to SEQ ID NO: 28465
  misc_feature: Coding regions on vcDNA: vcDNA=SeqID_17586; Strand=-; Position=2-247
  misc_feature (1)..(16): Xaa can be any naturally occurring amino acid
  misc_feature (19)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid

SEQ ID NO: 37890 - protein, 236 aa, Diabrotica virgifera
  misc_feature: Coding regions on vcDNA: vcDNA=SeqID_17587; Strand=-; Position=53-764
  misc_feature: Homolog annotation: Hit_ID=XP_312208.1; Match level="QueryCoverage =89%, HitCoverage=38%, E-value=1e-58, Identity=52%"; Hit description =ENSANGP00000010831 [Anopheles gambiae]
  misc_feature (80)..(80): Xaa can be any naturally occurring amino acid
APFRIFLPNQIFLEKTQNPKSKIVQGYGMTETSPILTYYSKYIPRNEANGGTIGTVVPNTLLKIVAPGDTTGTPLGPNEXGELLAKGPQIMKRYFNRAEETENAFLDGWLKTGDIAYYNQDECLFITDRIKELIKVKGFQVAPAELEEVIRGHPGVEDAAVIGIPHEQYGEVPRAYIVVKKNKNISGDEIKSYVAQQVANYKRLVGGVSVVDAIPRNPSGKILRRQLKLEFAEKGH

SEQ ID NO: 37891 - protein, 276 aa, Diabrotica virgifera
  misc_feature: Coding regions on vcDNA: vcDNA=SeqID_17588; Strand=-; Position=2-829
  misc_feature (32)..(267): Xaa can be any naturally occurring amino acid
YYSCSPIINFIQHRGRNLYYRCELSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGIHFLSFL

SEQ ID NO: 37892 - protein, 127 aa, Diabrotica virgifera
  misc_feature: Coding regions on vcDNA: vcDNA=SeqID_17589; Strand=+; Position=182-565
  misc_feature (32)..(56): Xaa can be any naturally occurring amino acid
  misc_feature (58)..(79): Xaa can be any naturally occurring amino acid
  misc_feature (85)..(91): Xaa can be any naturally occurring amino acid
  misc_feature (94)..(112): Xaa can be any naturally occurring amino acid
  misc_feature (117)..(124): Xaa can be any naturally occurring amino acid
TLIQHRGRNLYYRFELSNKITLVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 37893 - protein, 284 aa, Diabrotica virgifera
  misc_feature: Coding regions on vcDNA: vcDNA=SeqID_17590; Strand=+; Position=70-921
  misc_feature: Homolog annotation: Hit_ID=XP_312104.1; Match level="QueryCoverage =99%, HitCoverage=60%, E-value=3e-95, Identity=62%"; Hit description =ENSANGP00000016915 [Anopheles gambiae]
  misc_feature: Gene Ontology Annotation: Biological process=energy pathways
  misc_feature: Pfam annotation: Pfam_ID=ketoacyl-synt; Match level="Score=223.0, E -value=5.8e-64, Copies=1"; Pfam description=Beta-ketoacyl synthase, N- terminal do
  misc_feature (237)..(237): Xaa can be any naturally occurring amino acid
  misc_feature (244)..(254): Xaa can be any naturally occurring amino acid
  misc_feature (264)..(264): Xaa can be any naturally occurring amino acid
  misc_feature (266)..(266): Xaa can be any naturally occurring amino acid
  misc_feature (269)..(269): Xaa can be any naturally occurring amino acid
MQRRVVVTGLGVVSPVGTGVKEAWKNIISGKSGITRLEGPEYESLPCKIGGYAKDKGEKISLSNYFSKSELRTMAPATGFALISAKEALEDAKLDQMDENTKNTAGVAVGMGMVDLQDICSTYDALKKGYHHVSPYFVPRILPNMAAGQISIKYGLRGPNHSVSTACATGAHAIGDSFRFIRNGDADIMICGGTESCISPLSIAGFSRLRALSTSFNDQPEKASRPFDKLREGFVMXEGSAVLXXXXXXXXXXXNAHIYAGLLXYXLSXDASHLTAPRSDGAGA

SEQ ID NO: 37894 - protein, 276 aa, Diabrotica virgifera
  misc_feature: Coding regions on vcDNA: vcDNA=SeqID_17591; Strand=+; Position=1-828
  misc_feature (4)..(10): Xaa can be any naturally occurring amino acid
  misc_feature (61)..(67): Xaa can be any naturally occurring amino acid
  misc_feature (71)..(81): Xaa can be any naturally occurring amino acid
  misc_feature (92)..(273): Xaa can be any naturally occurring amino acid
LSLXXXXXXXLSFNIVNQYPRENLSLLSKGKISSLSVPRVSGISISINNLSSFTIFRISQXXXXXXXLFIXXXXXXXXXXXTKSLFVFQISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNF

SEQ ID NO: 37895 - protein, 54 aa, Diabrotica virgifera
  misc_feature: Coding regions on vcDNA: vcDNA=SeqID_17592; Strand=-; Position=522-686
KLISRLDETLYLLHKEHVFRNQVINMLLNSFIRIYIFILNIHCFNPNIIIVTKI

SEQ ID NO: 37896 - protein, 89 aa, Diabrotica virgifera
  misc_feature: Coding regions on vcDNA: vcDNA=SeqID_17593; Strand=+; Position=479-748
  misc_feature (80)..(86): Xaa can be any naturally occurring amino acid
NFNKIGENETTVNQFICAYKIFQAKGILERKFFNQMAVLICLVTSVSEDCLNYVISILTKQSILKLTTKSKYKSETRTFXXXXXXXCPT

SEQ ID NO: 37897 - protein, 283 aa, Diabrotica virgifera
  misc_feature: Coding regions on vcDNA: vcDNA=SeqID_17594; Strand=+; Position=1-849
  misc_feature: Homolog annotation: Hit_ID=XP_416082.1; Match level="QueryCoverage =99%, HitCoverage=29%, E-value=2e-55, Identity=39%"; Hit description =PREDICTED: similar to Nuclear pore complex protein Nup107 (Nucleoporin Nup107) (107 kDa
  misc_feature: Gene Ontology Annotation: Molecular function=nucleocytoplasmic transporter activity; Cellular component=nuclear pore; Biological process=mRNA-nucleus export
ETQLVAFYVSKLNPSNQVHLYAKYLEKIIDQQERKSALIFAEDSGLEVHAITKQVLENIRNLPHETEENGSLQHKITEVDKYKISCIDWILYYEEQRAEALFQINALIFAFLTLGKLDAAQLAFNKVPPNSVEKILNEGKVNDKINQTIKEFLCYKAYLDAQEAFSEWFKHRKSQPTPPDSLPENALFPEKVAHQHRESQYKAELGRWKLSADHMAKNAKAKLYNVLLFPDGWIVGAAEEYYLRSTCIPEVVLLLYAVLYESGQHEECVQLADILASKKYGIY

SEQ ID NO: 37898 - protein, 92 aa, Diabrotica virgifera
  misc_feature: Coding regions on vcDNA: vcDNA=SeqID_17595; Strand=+; Position=245-523
  misc_feature (15)..(23): Xaa can be any naturally occurring amino acid
TCMSLVVFRCTLKFXXXXXXXXXMESCTFLVIDYNGADLLRRVRCITPHHPNLVQKDLVFGSSETQAISYLLKSAGALNQNSFCCCERLILW

SEQ ID NO: 37899 - protein, 293 aa, Diabrotica virgifera
  misc_feature: Coding regions on vcDNA: vcDNA=SeqID_17596; Strand=+; Position=2-880
  misc_feature: Homolog annotation: Hit_ID=XP_395570.1; Match level="QueryCoverage =96%, HitCoverage=25%, E-value=9e-90, Identity=58%"; Hit description =similar to ENSANGP00000021632 [Apis mellifera]
PDSPELQIRKMGDLYFMLGQYSLAFQTYHLAKREYNTDQAWLYYAGALEMAALAAFMANQSTKKTCDYMEESITTYLNTCKMPQFATRATILGSECLKFRKMYGEAAHQLIRMISEESDLRSALLLEQASYCFLQTKMVRKYAFHMVLAGHRFAKAAQRKFSLKCYKQAYQVYENTGWDLATDHIHYTIGRQANNLQQFDEAVSSFAKLLTGESKQTAQQQATYLKEYLTILGNKLRHDKESDVIASLRLKVPIEIEEDPSQEVCPILPVPELDIESLRLLACPSRPISTPGK

SEQ ID NO: 37900 - protein, 130 aa, Diabrotica virgifera
  misc_feature: Coding regions on vcDNA: vcDNA=SeqID_17597; Strand=-; Position=1-390
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(130): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXX

SEQ ID NO: 37901 - protein, 55 aa, Diabrotica virgifera
  misc_feature: Coding regions on vcDNA: vcDNA=SeqID_17598; Strand=-; Position=2-166
  misc_feature (18)..(18): Xaa can be any naturally occurring amino acid
  misc_feature (21)..(35): Xaa can be any naturally occurring amino acid
  misc_feature (37)..(37): Xaa can be any naturally occurring amino acid
  misc_feature (41)..(54): Xaa can be any naturally occurring amino acid
IETTLAHTGLNSDHVNFXKSXXXXXXXXXXXXXXXPXSRSXXXXXXXXXXXXXXV

SEQ ID NO: 37902 - protein, 236 aa, Diabrotica virgifera
  misc_feature: Coding regions on vcDNA: vcDNA=SeqID_17599; Strand=-; Position=3-710
  misc_feature: Homolog annotation: Hit_ID=AAF87760.1; Match level="QueryCoverage =100%, HitCoverage=53%, E-value=9e-95, Identity=76%"; Hit description= cytochrome oxidase subunit I [Diabrotica virgifera zeae]
  misc_feature: Pfam annotation: Pfam_ID=COX1; Match level="Score=-99.6, E-value=7.5e- 08, Copies=1"; Pfam description=Cytochrome C and Quinol oxidase polyp
  misc_feature (16)..(16): Xaa can be any naturally occurring amino acid
  misc_feature (51)..(51): Xaa can be any naturally occurring amino acid
  misc_feature (68)..(68): Xaa can be any naturally occurring amino acid
  misc_feature (124)..(124): Xaa can be any naturally occurring amino acid
  misc_feature (131)..(147): Xaa can be any naturally occurring amino acid
  misc_feature (178)..(178): Xaa can be any naturally occurring amino acid
  misc_feature (194)..(201): Xaa can be any naturally occurring amino acid
  misc_feature (222)..(222): Xaa can be any naturally occurring amino acid
IIYAIIAIGLLDFIVXAHHIFSVRMDVDTRTYFTSATIIIAVTTGIKVFRXLATYHGTTITYSPVTLXALGFILLFTVGGLSGVVLANSSIDIVFHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSEL

SEQ ID NO: 37903 - protein, 44 aa, Diabrotica virgifera
  misc_feature: Coding regions on vcDNA: vcDNA=SeqID_17600; Strand=-; Position=2-133
  misc_feature (1)..(8): Xaa can be any naturally occurring amino acid
  misc_feature (19)..(19): Xaa can be any naturally occurring amino acid
  misc_feature (25)..(25): Xaa can be any naturally occurring amino acid
  misc_feature (30)..(43): Xaa can be any naturally occurring amino acid
XXXXXXXXSNRLNKYTATXIINFNXTSRSXXXXXXXXXXXXXXV

SEQ ID NO: 37904 - protein, 297 aa, Diabrotica virgifera
  misc_feature: Coding regions on vcDNA: vcDNA=SeqID_17601; Strand=+; Position=3-896
  misc_feature (88)..(98): Xaa can be any naturally occurring amino acid
  misc_feature (219)..(226): Xaa can be any naturally occurring amino acid
  misc_feature (271)..(271): Xaa can be any naturally occurring amino acid
TTEQHNQNIEESKNVDPPSSTVSHVDSSSDVKNSVDLKRYFDLLDRLIQRNTPLSIGHQKYVDIIRSSMNKVAASKSRRSPVREICLXXXXXXXXXXXDSNKSDSEGKLRIADTEMIEFDRMSKNVEELEIITKKLEEKDEVTVLKVEIINFAKAVLTEWRHKLKDKEENPSNIDPITSNHPISKSPEKTVNTNVSDENLKDEEPDSLNESTEVESSSXXXXXXXXQRRIHQRQGKQEQEKQKGYEDDASRENYSMWVPPSAKVETEEQIXMINMATKYCFVHNMKTLFAHICTFFK

SEQ ID NO: 37905 - protein, 147 aa, Diabrotica virgifera
  misc_feature: Coding regions on vcDNA: vcDNA=SeqID_17602; Strand=+; Position=65-508
  misc_feature: Homolog annotation: Hit_ID=CAG02637.1; Match level="QueryCoverage =97%, HitCoverage=53%, E-value=3e-21, Identity=32%"; Hit description =unnamed protein product [Tetraodon nigroviridis]
  misc_feature: Pfam annotation: Pfam_ID=MPPN; Match level="Score=61.7, E-value=2.1e -15, Copies=1"; Pfam description=MPPN (rrm-like) domain
MTSYNERSSFNAGDRIDTNWVTVFGFPPSALNLILAQLSNCGPIAEKKVPPQGNWVHVKFNHITEVSRALSLNCKLINNSIMIGVTPYHHKENKENDSSMYASPMRVRSLRHSFISPSSQNSVISPQALPQKSTGIVTKAMEYVFGW

SEQ ID NO: 37906 - protein, 59 aa, Diabrotica virgifera
  misc_feature: Coding regions on vcDNA: vcDNA=SeqID_17603; Strand=-; Position=0-176
  misc_feature (7)..(26): Xaa can be any naturally occurring amino acid
  misc_feature (28)..(28): Xaa can be any naturally occurring amino acid
  misc_feature (30)..(58): Xaa can be any naturally occurring amino acid
KIGIKKXXXXXXXXXXXXXXXXXXXXNXLXXXXXXXXXXXXXXXXXXXXXXXXXXXXXA

SEQ ID NO: 37907 - protein, 81 aa, Diabrotica virgifera
  misc_feature: Coding regions on vcDNA: vcDNA=SeqID_17604; Strand=-; Position=452-695
  misc_feature: Homolog annotation: Hit_ID=AAC46945.1; Match level="QueryCoverage =100%, HitCoverage=23%, E-value=1e-14, Identity=45%"; Hit description= mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=30.1, E -value=4.3e-07, Copies=1"; Pfam description=Transposase
  misc_feature (65)..(65): Xaa can be any naturally occurring amino acid
NETWVYHHHLELKQEAKEWCEPGSSASKRVGAHKSTKKVLASVLWDTGEILFVDYLQTGKTINSXYHCNLLDQLKETFVKK

SEQ ID NO: 37908 - protein, 165 aa, Diabrotica virgifera
  misc_feature: Coding regions on vcDNA: vcDNA=SeqID_17605; Strand=+; Position=19-516
  misc_feature (26)..(31): Xaa can be any naturally occurring amino acid
  misc_feature (33)..(40): Xaa can be any naturally occurring amino acid
  misc_feature (43)..(57): Xaa can be any naturally occurring amino acid
  misc_feature (61)..(76): Xaa can be any naturally occurring amino acid
  misc_feature (81)..(131): Xaa can be any naturally occurring amino acid
  misc_feature (144)..(165): Xaa can be any naturally occurring amino acid
LYHLYAALQLEDLYVNCQLILFERDXXXXXXKXXXXXXXXIMXXXXXXXXXXXXXXXELKXXXXXXXXXXXXXXXXMECYXXXXXXXXXXXXXXXXXXXXXXXXXXXXXXXXXXXXXXXXXXXXXXXXXXXETSSNNFHILDHXXXXXXXXXXXXXXXXXXXXXX

SEQ ID NO: 37909 - protein, 19 aa, Diabrotica virgifera
  misc_feature: Coding regions on vcDNA: vcDNA=SeqID_17606; Strand=-; Position=0-56
  misc_feature (4)..(16): Xaa can be any naturally occurring amino acid
IPPXXXXXXXXXXXXXKKT

SEQ ID NO: 37910 - protein, 108 aa, Diabrotica virgifera; identical to SEQ ID NO: 27732
  misc_feature: Coding regions on vcDNA: vcDNA=SeqID_17607; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 37911 - protein, 274 aa, Diabrotica virgifera
  misc_feature: Coding regions on vcDNA: vcDNA=SeqID_17608; Strand=-; Position=2-823
  misc_feature (2)..(228): Xaa can be any naturally occurring amino acid
  misc_feature (230)..(242): Xaa can be any naturally occurring amino acid
  misc_feature (253)..(261): Xaa can be any naturally occurring amino acid
  misc_feature (265)..(271): Xaa can be any naturally occurring amino acid
AXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXLSRILINYRLXXXXXXXXXEREXXXXXXXKIK

SEQ ID NO: 37912 - protein, 133 aa, Diabrotica virgifera
  misc_feature: Coding regions on vcDNA: vcDNA=SeqID_17609; Strand=-; Position=188-589
  misc_feature (1)..(5): Xaa can be any naturally occurring amino acid
  misc_feature (16)..(25): Xaa can be any naturally occurring amino acid
  misc_feature (34)..(41): Xaa can be any naturally occurring amino acid
  misc_feature (46)..(57): Xaa can be any naturally occurring amino acid
  misc_feature (63)..(76): Xaa can be any naturally occurring amino acid
  misc_feature (78)..(132): Xaa can be any naturally occurring amino acid
XXXXXSFSIYDPFVLXXXXXXXXXXILVHIGLNXXXXXXXXSNSLXXXXXXXXXXXXPSSRSXXXXXXXXXXXXXXVXXXXXXXXXXXXXXXXXXXXXXXXXXXXXXXXXXXXXXXXXXXXXXXXXXXXXXXH

SEQ ID NO: 37913 - protein, 66 aa, Diabrotica virgifera; identical to SEQ ID NO: 26808
  misc_feature: Coding regions on vcDNA: vcDNA=SeqID_17610; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37914 - protein, 221 aa, Diabrotica virgifera
  misc_feature: Coding regions on vcDNA: vcDNA=SeqID_17611; Strand=-; Position=1-663
  misc_feature (1)..(27): Xaa can be any naturally occurring amino acid
  misc_feature (35)..(54): Xaa can be any naturally occurring amino acid
  misc_feature (66)..(92): Xaa can be any naturally occurring amino acid
  misc_feature (94)..(221): Xaa can be any naturally occurring amino acid
XXXXXXXXXXXXXXXXXXXXXXXXXXXIYYFLLMXXXXXXXXXXXXXXXXXXXXLITLFYYISLLXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37915 - protein, 66 aa, Diabrotica virgifera; identical to SEQ ID NO: 26808
  misc_feature: Coding regions on vcDNA: vcDNA=SeqID_17612; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37916 - protein, 285 aa, Diabrotica virgifera
  misc_feature: Coding regions on vcDNA: vcDNA=SeqID_17613; Strand=-; Position=1-855
  misc_feature (4)..(88): Xaa can be any naturally occurring amino acid
  misc_feature (93)..(118): Xaa can be any naturally occurring amino acid
  misc_feature (122)..(131): Xaa can be any naturally occurring amino acid
  misc_feature (141)..(148): Xaa can be any naturally occurring amino acid
  misc_feature (153)..(160): Xaa can be any naturally occurring amino acid
  misc_feature (166)..(285): Xaa can be any naturally occurring amino acid
APPXXXXXXXXXXXXXXXXXXXXXXXXXXXXXXXXXXXXXXXXXXXXXXXXXXXXXXXXXXXXXXXXXXXXXXXXXXXXXXXXXXXXXESRPXXXXXXXXXXXXXXXXXXXXXXXXXXTTTXXXXXXXXXXEEGEEKKRGXXXXXXXXPFLTXXXXXXXXQKNTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37917 - protein, 23 aa, Diabrotica virgifera
  misc_feature: Coding regions on vcDNA: vcDNA=SeqID_17614; Strand=-; Position=1-69
  misc_feature (2)..(23): Xaa can be any naturally occurring amino acid
RXXXXXXXXXXXXXXXXXXXXXX

SEQ ID NO: 37918 - protein, 193 aa, Diabrotica virgifera
  misc_feature: Coding regions on vcDNA: vcDNA=SeqID_17615; Strand=+; Position=3-584
  misc_feature (1)..(81): Xaa can be any naturally occurring amino acid
  misc_feature (88)..(111): Xaa can be any naturally occurring amino acid
  misc_feature (114)..(141): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXMKDCMKXXXXXXXXXXXXXXXXXXXXXXXXLQXXXXXXXXXXXXXXXXXXXXXXXXXXXXLKFRFDDYNSIIKLHMYLKYISIIKEFVNVFFTCILKTRLFVFNIKCRLTAD

SEQ ID NO: 37919 - protein, 238 aa, Diabrotica virgifera
  misc_feature: Coding regions on vcDNA: vcDNA=SeqID_17616; Strand=+; Position=67-783
  misc_feature: Homolog annotation: Hit_ID=CAA76931.1; Match level="QueryCoverage =91%, HitCoverage=89%, E-value=3e-77, Identity=62%"; Hit description =endoglucanase [Phaedon cochleariae]
  misc_feature: Pfam annotation: Pfam_ID=Glyco_hydro_45; Match level="Score=353.1, E -value=3.8e-103, Copies=1"; Pfam description=Glycosyl hydrolase family 45
  misc_feature (136)..(143): Xaa can be any naturally occurring amino acid
  misc_feature (214)..(219): Xaa can be any naturally occurring amino acid
MIFNCFIFSVVLAVTLAYSPEIKKIVGGKSGYGTTTRYWDCCKPSCAWKENIKTPDMEPIATCSTDGVTVVNASVQSGCIGGTSYMCNNQQPFVVNETLGYGFAAVSFSGGVDNDLCCSCYLLTFQNQINNKKLVXXXXXXXXDLGSNQFDIALPGGGVGAFNQGCHDQWNAPWTGWGQQYGGISSREECLSLLPKELQSGCLFRFDFMQNANXXXXXXEQVECPAELVKISGCSLPL

SEQ ID NO: 37920 - protein, 277 aa, Diabrotica virgifera
  misc_feature: Coding regions on vcDNA: vcDNA=SeqID_17617; Strand=-; Position=1-831
  misc_feature (1)..(50): Xaa can be any naturally occurring amino acid
  misc_feature (52)..(91): Xaa can be any naturally occurring amino acid
  misc_feature (96)..(125): Xaa can be any naturally occurring amino acid
  misc_feature (133)..(139): Xaa can be any naturally occurring amino acid
  misc_feature (144)..(174): Xaa can be any naturally occurring amino acid
  misc_feature (176)..(248): Xaa can be any naturally occurring amino acid
  misc_feature (259)..(277): Xaa can be any naturally occurring amino acid
XXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXLSIFXXXXXXXXXXXXXXXXXXXXXXXXXXXXXXSFVGERGXXXXXXXFSPFXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXGGGLPLPSFPXXXXXXXXXXXXXXXXXXX

SEQ ID NO: 37921 - protein, 197 aa, Diabrotica virgifera
  misc_feature: Coding regions on vcDNA: vcDNA=SeqID_17618; Strand=+; Position=114-707
  misc_feature: Homolog annotation: Hit_ID=EAL30292.1; Match level="QueryCoverage =93%, HitCoverage=15%, E-value=5e-47, Identity=52%"; Hit description =GA12611-PA [Drosophila pseudoobscura]
  misc_feature: Gene Ontology Annotation: Biological process=hermaphrodite genital morphogenesis
  misc_feature (49)..(49): Xaa can be any naturally occurring amino acid
  misc_feature (101)..(101): Xaa can be any naturally occurring amino acid
  misc_feature (108)..(108): Xaa can be any naturally occurring amino acid
  misc_feature (113)..(113): Xaa can be any naturally occurring amino acid
  misc_feature (166)..(166): Xaa can be any naturally occurring amino acid
  misc_feature (175)..(175): Xaa can be any naturally occurring amino acid
  misc_feature (185)..(185): Xaa can be any naturally occurring amino acid
YRPESKVDSESIGRDTMVGAIEQLTVDEFENRYTQGRDTILSPLPELSXSRLEYHMIGEDRGYDNPSFACKEKKYEVDESDPTGGHAQNIQQSINVYEIDXGENHVAXTYSEXLVRPASFMVTDPGADDGSSGVLICAETYLTYKKLGDHHNIRLPIPPNKERLTXPEREMIFGXAATHKTISIXFSLACPEQGDHF

SEQ ID NO: 37922 - protein, 131 aa, Diabrotica virgifera
  misc_feature: Coding regions on vcDNA: vcDNA=SeqID_17619; Strand=-; Position=539-934
  misc_feature (3)..(28): Xaa can be any naturally occurring amino acid
  misc_feature (31)..(101): Xaa can be any naturally occurring amino acid
FLXXXXXXXXXXXXXXXXXXXXXXXXXXDEXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 37923 - protein, 31 aa, Diabrotica virgifera
  misc_feature: Coding regions on vcDNA: vcDNA=SeqID_17620; Strand=-; Position=0-92
  misc_feature (15)..(23): Xaa can be any naturally occurring amino acid
RVNYYCNQRSGIKKXXXXXXXXXKGDLFFNR

SEQ ID NO: 37924 - protein, 266 aa, Diabrotica virgifera
  misc_feature: Coding regions on vcDNA: vcDNA=SeqID_17621; Strand=-; Position=2-799
  misc_feature (8)..(8): Xaa can be any naturally occurring amino acid
  misc_feature (10)..(266): Xaa can be any naturally occurring amino acid
SSLKKLSXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37925 - protein, 67 aa, Diabrotica virgifera
  misc_feature: Coding regions on vcDNA: vcDNA=SeqID_17622; Strand=-; Position=497-700
  misc_feature (32)..(37): Xaa can be any naturally occurring amino acid
ARIKFLITKQRFYTLELLRQLHILPIRNIAYXXXXXXFPDNFWCFSDQTVLTNQLMIVNTRVIQKFR

SEQ ID NO: 37926 - protein, 104 aa, Diabrotica virgifera
  misc_feature: Coding regions on vcDNA: vcDNA=SeqID_17623; Strand=+; Position=2-316
  misc_feature (11)..(17): Xaa can be any naturally occurring amino acid
  misc_feature (42)..(49): Xaa can be any naturally occurring amino acid
  misc_feature (63)..(71): Xaa can be any naturally occurring amino acid
  misc_feature (92)..(103): Xaa can be any naturally occurring amino acid
NALYLENGWHXXXXXXXKPQLFFSFLPFLVTVLPFLKNMYKXXXXXXXXPRKCGFLFLKVRFXXXXXXXXXRVKYYAKIHVIYFFRENECLXXXXXXXXXXXXF

SEQ ID NO: 37927 - protein, 71 aa, Diabrotica virgifera
  misc_feature: Coding regions on vcDNA: vcDNA=SeqID_17624; Strand=-; Position=1-213
  misc_feature (47)..(53): Xaa can be any naturally occurring amino acid
ASVIIETLFLQIFLSTFVSATPTALKTGHHFMHYVNNTIKAIIKVSXXXXXXXKAQIIQTTKNNPRQGKVA

SEQ ID NO: 37928 - protein, 97 aa, Diabrotica virgifera
  misc_feature: Coding regions on vcDNA: vcDNA=SeqID_17625; Strand=+; Position=186-479
SVAIRIVTGAERRPSPVTFIQLGVVKEGPVADTSIQFQSRQGSSRNHLLRRGQCDAVYNSLLRDWPILTEQSSRCWRTRETAIPFPRRSGRALPKYI

SEQ ID NO: 37929 - protein, 319 aa, Diabrotica virgifera
  misc_feature: Coding regions on vcDNA: vcDNA=SeqID_17626; Strand=+; Position=2-958
  misc_feature: Homolog annotation: Hit_ID=BAA36690.1; Match level="QueryCoverage =97%, HitCoverage=7%, E-value=2e-30, Identity=28%"; Hit description =DNA-dependent protein kinase catalytic subunit [Xenopus laevis]
  misc_feature: Gene Ontology Annotation: Biological process=double-strand break repair
  misc_feature (267)..(267): Xaa can be any naturally occurring amino acid
KITTDKKRKEAAIEREKKVTIYRSYRKGDFPDVQISLSALLKPLQALALHDSEMSKILFLEIFKGLANKIENNQRFLSSVPDSIKNIFQSSVSFNRYLFAALLDILLKNKEKMVFDPKLISYVAQESGLASTGALLIEEYLISGVGDDMPSTSKRKFREDDWETVSWIKLAELYKELEEWDTVRAIFLEKMDCKRDLQKAITYESKHFYKDAADLYKKLISSDESHNRRDFYYDAYFKCFANLGQWETIPNAVATVVGTEDTWKSLXEDEWSQQKLLPWYINIHVKNQLFTQETDEEFLTNFDSCLSDAKVKSILIPIF

SEQ ID NO: 37930 - protein, 115 aa, Diabrotica virgifera
  misc_feature: Coding regions on vcDNA: vcDNA=SeqID_17627; Strand=-; Position=91-438
  misc_feature (29)..(51): Xaa can be any naturally occurring amino acid
  misc_feature (60)..(71): Xaa can be any naturally occurring amino acid
  misc_feature (74)..(85): Xaa can be any naturally occurring amino acid
  misc_feature (91)..(106): Xaa can be any naturally occurring amino acid
YYECPIYIQTTNANYPIINNIQIHEIMCXXXXXXXXXXXXXXXXXXXXXXXSKFSILTYXXXXXXXXXXXXVYXXXXXXXXXXXXNHKYIXXXXXXXXXXXXXXXXKNHFLKKTT

SEQ ID NO: 37931 - protein, 36 aa, Diabrotica virgifera
  misc_feature: Coding regions on vcDNA: vcDNA=SeqID_17628; Strand=-; Position=3-110
  misc_feature (3)..(10): Xaa can be any naturally occurring amino acid
  misc_feature (23)..(35): Xaa can be any naturally occurring amino acid
RTXXXXXXXXPIINFNPTSRSAXXXXXXXXXXXXXC

SEQ ID NO: 37932 - protein, 33 aa, Diabrotica virgifera
  misc_feature: Coding regions on vcDNA: vcDNA=SeqID_17629; Strand=+; Position=2-100
KLVACSPVRIPGRPSSLSPGITAEFDLSFQFNM

SEQ ID NO: 37933 - protein, 90 aa, Diabrotica virgifera
  misc_feature: Coding regions on vcDNA: vcDNA=SeqID_17630; Strand=+; Position=307-579
CFDAHTNHVYESVFNEEDTTLHTIRELHANRASRIANTCIVCSHLYYIIYRMNTSEMNSTLDSAYFYNHQHVLTIYWEFRRHLLDLFIVF

SEQ ID NO: 37934 - protein, 93 aa, Diabrotica virgifera
  misc_feature: Coding regions on vcDNA: vcDNA=SeqID_17631; Strand=-; Position=158-439
  misc_feature (5)..(21): Xaa can be any naturally occurring amino acid
  misc_feature (23)..(54): Xaa can be any naturally occurring amino acid
  misc_feature (64)..(79): Xaa can be any naturally occurring amino acid
KFMIXXXXXXXXXXXXXXXXXLXXXXXXXXXXXXXXXXXXXXXXXXXXXXXXXXTKKELHFSIXXXXXXXXXXXXXXXXSYFNFENNKSIFFS

SEQ ID NO: 37935 - protein, 164 aa, Diabrotica virgifera
  misc_feature: Coding regions on vcDNA: vcDNA=SeqID_17632; Strand=+; Position=3-497
  misc_feature: Homolog annotation: Hit_ID=NP_651415.1; Match level="QueryCoverage =90%, HitCoverage=49%, E-value=2e-36, Identity=56%"; Hit description =CG4743-PA [Drosophila melanogaster] gb|AAF56493.1| CG4743-PA [Drosophila melanogaster]
  misc_feature: Gene Ontology Annotation: Molecular function=transporter activity; Cellular component=mitochondrial inner membrane; Biological process =transport
  misc_feature: Pfam annotation: Pfam_ID=Mito_carr; Match level="Score=102.0, E-value= 1.5e-27, Copies=2"; Pfam description=Mitochondrial carrier protein
  misc_feature (55)..(61): Xaa can be any naturally occurring amino acid
QTQSGNKSSLKIALSAYKHEGLRGLYRGFCSTILREIPFSVIQFPILEYLKKSYXXXXXXXIHLDSWEVAVCGSIAGGVSAAVTTPLDVAKTRIMLADRKQVRAGEMTVANTLKQIYRTEGVKGLFSGFVPRVMWITLGGCIFFGSYDFAKGTCLQLIDKDIEY

SEQ ID NO: 37936 - protein, 132 aa, Diabrotica virgifera
  misc_feature: Coding regions on vcDNA: vcDNA=SeqID_17633; Strand=-; Position=176-574
  misc_feature (16)..(31): Xaa can be any naturally occurring amino acid
  misc_feature (34)..(54): Xaa can be any naturally occurring amino acid
  misc_feature (63)..(74): Xaa can be any naturally occurring amino acid
  misc_feature (96)..(103): Xaa can be any naturally occurring amino acid
  misc_feature (123)..(129): Xaa can be any naturally occurring amino acid
KPIYSFYICNFLLLMXXXXXXXXXXXXXXXXRIXXXXXXXXXXXXXXXXXXXXXFHPNFYLKXXXXXXXXXXXXPSKYLILIIYNYLYYRYIVNMXXXXXXXXILDIFKDELHFVAKYLFKIXXXXXXXIVF

SEQ ID NO: 37937 - protein, 247 aa, Diabrotica virgifera
  misc_feature: Coding regions on vcDNA: vcDNA=SeqID_17634; Strand=-; Position=97-840
MKINTNKNYITVYTKISNSTNNLPTIMVREDSKKRSADKEEPSKQVILRLHAELTRLAQDVLTLTESLAPKYDNGVEVEDIDVTIRSEATVDQNSAKSEDISTKNMAAKHQQDKSDNKIDSQAPIEDEAVEMEDTYAKMLSGKEAARMIAEIKRTATDLTPMLQTMKEYNHNQEFDIKSVEQQLIKCREQQRIELLEVENLLTATYSMFERLGTEFTFDSKGQDSLAFSDFLDDNMDVATSSPLPNS

SEQ ID NO: 37938 - protein, 66 aa, Diabrotica virgifera
  misc_feature: Coding regions on vcDNA: vcDNA=SeqID_17635; Strand=-; Position=2-199
LRKKITALFSIQSFLIPWAQTMQFGGIHTKFSLTMVSLSLLKNMFIRSAKRGFRLFLDKVVRPYGG

SEQ ID NO: 37939 - protein, 34 aa, Diabrotica virgifera
  misc_feature: Coding regions on vcDNA: vcDNA=SeqID_17636; Strand=-; Position=63-167
  misc_feature (13)..(19): Xaa can be any naturally occurring amino acid
NSNKMKLFTALLXXXXXXXKYNFIYKLNYPIINS

SEQ ID NO: 37940 - protein, 33 aa, Diabrotica virgifera
  misc_feature: Coding regions on vcDNA: vcDNA=SeqID_17637; Strand=-; Position=2-100
  misc_feature (3)..(3): Xaa can be any naturally occurring amino acid
  misc_feature (6)..(6): Xaa can be any naturally occurring amino acid
  misc_feature (9)..(31): Xaa can be any naturally occurring amino acid
YPXPIXINXXXXXXXXXXXXXXXXXXXXXXXSS

SEQ ID NO: 37941 - protein, 49 aa, Diabrotica virgifera
  misc_feature: Coding regions on vcDNA: vcDNA=SeqID_17638; Strand=+; Position=3-151
  misc_feature: Homolog annotation: Hit_ID=XP_319346.1; Match level="QueryCoverage =100%, HitCoverage=15%, E-value=1e-17, Identity=83%"; Hit description= ENSANGP00000022441 [Anopheles gambiae] ref|XP_319345.1| ENSANGP00000012572 [Anopheles gambiae]
  misc_feature: Gene Ontology Annotation: Molecular function=protein phosphatase type 2A, intrinsic catalyst activity; Cellular component=cytoplasm; Biological process=R7 cell fate commitment
  misc_feature (36)..(36): Xaa can be any naturally occurring amino acid
FGQDISEGVAHTNGLSLVSRAHRLVMEGYFWCHERXVVTIFSAPNYCYR

SEQ ID NO: 37942 - protein, 111 aa, Diabrotica virgifera
  misc_feature: Coding regions on vcDNA: vcDNA=SeqID_17639; Strand=+; Position=615-950
  misc_feature: Homolog annotation: Hit_ID=XP_316606.1; Match level="QueryCoverage =96%, HitCoverage=20%, E-value=5e-13, Identity=41%"; Hit description =ENSANGP00000011460 [Anopheles gambiae]
  misc_feature (37)..(37): Xaa can be any naturally occurring amino acid
  misc_feature (42)..(42): Xaa can be any naturally occurring amino acid
MFSHEDRSPFTMTTERCSSQSYSVVTKSIVHVYVFCXTCESXCSGKMRRIRVISVKEYSITVHADPHYCNDDLISKQITGTCENSPELCSNLLKNVEPTFAEFYFKCSEHT

SEQ ID NO: 37943 - protein, 97 aa, Diabrotica virgifera
  misc_feature: Coding regions on vcDNA: vcDNA=SeqID_17640; Strand=+; Position=327-620
KNDDVHDPSLCLKWLELNQMDEDEETDEEQYDDSEYRQRGGRLKDLVDLEIQFNDRERRVEVLRTRQRSDCPRGDDNRGGDAGVTDGAYDYLTKHSA

SEQ ID NO: 37944 - protein, 68 aa, Diabrotica virgifera
  misc_feature: Coding regions on vcDNA: vcDNA=SeqID_17641; Strand=+; Position=70-273
KVRYETLNGVVHSQGNFLAMTRYLRLKIYHGHQAARLGSYTTRRCIIQLCLYIVKRSIVRDEIANRCV

SEQ ID NO: 37945 - protein, 99 aa, Diabrotica virgifera
  misc_feature: Coding regions on vcDNA: vcDNA=SeqID_17642; Strand=+; Position=210-508
  misc_feature: Homolog annotation: Hit_ID=EAL27550.1; Match level="QueryCoverage =81%, HitCoverage=24%, E-value=3e-09, Identity=41%"; Hit description =GA15457-PA [Drosophila pseudoobscura]
  misc_feature (30)..(30): Xaa can be any naturally occurring amino acid
  misc_feature (41)..(41): Xaa can be any naturally occurring amino acid
LDYRHIDSNGAYRNDLVIEKGLKKSVDSAXNDKHNLFIASXLPGPGIHPDRLEKDLKKSMADLLLYYLDLYLIRLPDLHNRRGRESTEQTVSRGTNNHI

SEQ ID NO: 37946 - protein, 196 aa, Diabrotica virgifera
  misc_feature: Coding regions on vcDNA: vcDNA=SeqID_17643; Strand=+; Position=103-693
  misc_feature: Homolog annotation: Hit_ID=EAL38883.1; Match level="QueryCoverage =84%, HitCoverage=53%, E-value=6e-25, Identity=39%"; Hit description =ENSANGP00000029502 [Anopheles gambiae str. PEST] ref|XP_552521.1| ENSANGP00000029502 [Anopheles gambiae st
  misc_feature: Pfam annotation: Pfam_ID=Syntaxin; Match level="Score=10.1, E-value =0.075, Copies=1"; Pfam description=Syntaxin
  misc_feature (190)..(190): Xaa can be any naturally occurring amino acid
MNRQPPTYGAIAPSTQVVFSDQVATEFNNSSENVVTNIYTINNSIKVLGNALKVIGTKKDNQGIRSQVHVTQLSTNQIAASTSKEIVNLKQLSKGHKQRLLQVEKLEENFKEALGRYHNLQKDVANKQKLHLLVPSESVEETAQDDNDEQQMQAQKTRELAFEQDMLIERESRIMQIESDILDVNQIMRXVGVHST

SEQ ID NO: 37947 - protein, 44 aa, Diabrotica virgifera
  misc_feature: Coding regions on vcDNA: vcDNA=SeqID_17644; Strand=+; Position=2-133
  misc_feature (14)..(14): Xaa can be any naturally occurring amino acid
  misc_feature (22)..(32): Xaa can be any naturally occurring amino acid
  misc_feature (39)..(39): Xaa can be any naturally occurring amino acid
NSVILLGEFKSIIXIATSMLDXXXXXXXXXXXLSLFDFXNLHDL

SEQ ID NO: 37948 - protein, 218 aa, Diabrotica virgifera
  misc_feature: Coding regions on vcDNA: vcDNA=SeqID_17645; Strand=+; Position=76-727
  misc_feature: Homolog annotation: Hit_ID=CAA67343.1; Match level="QueryCoverage =100%, HitCoverage=60%, E-value=4e-54, Identity=56%"; Hit description= 40-kDa V-ATPase subunit [Manduca sexta] sp|Q25531|VA0D_MANSE Vacuolar ATP synthase subunit d (V-ATPase d
  misc_feature: Gene Ontology Annotation: Molecular function=hydrogen-transporting ATPase activity, rotational mechanism; Cellular component=hydrogen -transporting ATPase V0 domain; Biological process=hydrogen transport
  misc_feature: Pfam annotation: Pfam_ID=vATP-synt_AC39; Match level="Score=-78.1, E -value=1.3e-05, Copies=1"; Pfam description=ATP synthase (C/AC39) subunit
  misc_feature (19)..(19): Xaa can be any naturally occurring amino acid
  misc_feature (35)..(35): Xaa can be any naturally occurring amino acid
  misc_feature (73)..(73): Xaa can be any naturally occurring amino acid
  misc_feature (127)..(127): Xaa can be any naturally occurring amino acid
  misc_feature (134)..(134): Xaa can be any naturally occurring amino acid
  misc_feature (161)..(161): Xaa can be any naturally occurring amino acid
  misc_feature (169)..(169): Xaa can be any naturally occurring amino acid
MTGCDVFDIDNAYFGGLCXADLKCVILKPSDYLNXPQRDMLEYLTLNLSATEYATFLDTGPSPFDSIRGLKSXRPEKLGIECQDMRDPLVKSLSTCMNFITYRYMIHNIILLITATLHQRPVTELIXPKCHPLXVFEKVKDIHVTATPDDIDYAGLANTPXLAPFFVDXASYEQYMNATNDDIIINNIYKAYLKEFYTFCKRIVGTTADSMCEMLTFE

SEQ ID NO: 37949 - protein, 81 aa, Diabrotica virgifera
  misc_feature: Coding regions on vcDNA: vcDNA=SeqID_17646; Strand=-; Position=2-244
  misc_feature (13)..(29): Xaa can be any naturally occurring amino acid
VDLVISIIDVSTXXXXXXXXXXXXXXXXXYTGSDIIVDQTGAQTASFVKCTSHKYVVTLAMYRGFQRGLDILGLKFAGPKG

SEQ ID NO: 37950 - protein, 184 aa, Diabrotica virgifera
  misc_feature: Coding regions on vcDNA: vcDNA=SeqID_17647; Strand=-; Position=1-552
  misc_feature (6)..(15): Xaa can be any naturally occurring amino acid
  misc_feature (17)..(70): Xaa can be any naturally occurring amino acid
  misc_feature (83)..(168): Xaa can be any naturally occurring amino acid
  misc_feature (170)..(183): Xaa can be any naturally occurring amino acid
SHYYIXXXXXXXXXXKXXXXXXXXXXXXXXXXXXXXXXXXXXXXXXXXXXXXXXXXXXXXXXXXXXXXXXTTIARSKYRGHSXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXK

SEQ ID NO: 37951 - protein, 25 aa, Diabrotica virgifera
  misc_feature: Coding regions on vcDNA: vcDNA=SeqID_17648; Strand=-; Position=1-75
  misc_feature (1)..(16): Xaa can be any naturally occurring amino acid
  misc_feature (18)..(25): Xaa can be any naturally occurring amino acid
XXXXXXXXXXXXXXXXGXXXXXXXX

SEQ ID NO: 37952 - protein, 18 aa, Diabrotica virgifera
  misc_feature: Coding regions on vcDNA: vcDNA=SeqID_17649; Strand=+; Position=1-54
  misc_feature (3)..(15): Xaa can be any naturally occurring amino acid
IIXXXXXXXXXXXXXIYL

SEQ ID NO: 37953 - protein, 247 aa, Diabrotica virgifera
  misc_feature: Coding regions on vcDNA: vcDNA=SeqID_17650; Strand=-; Position=1-741
  misc_feature (2)..(19): Xaa can be any naturally occurring amino acid
  misc_feature (22)..(247): Xaa can be any naturally occurring amino acid
IXXXXXXXXXXXXXXXXXXFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 37954 - protein, 30 aa, Diabrotica virgifera
  misc_feature: Coding regions on vcDNA: vcDNA=SeqID_17651; Strand=-; Position=0-89
  misc_feature (1)..(27): Xaa can be any naturally occurring amino acid
XXXXXXXXXXXXXXXXXXXXXXXXXXXLLT

SEQ ID NO: 37955 - protein, 289 aa, Diabrotica virgifera
  misc_feature: Coding regions on vcDNA: vcDNA=SeqID_17652; Strand=+; Position=2-868
  misc_feature: Homolog annotation: Hit_ID=NP_579857.1; Match level="QueryCoverage =99%, HitCoverage=84%, E-value=7e-61, Identity=41%"; Hit description =zinc finger protein 111 [Rattus norvegicus] gb|AAB60512.1| Cys2/His2 zinc finger protein
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=181.4, E-value =1.9e-51, Copies=7"; Pfam description=Zinc finger, C2H2 type
  misc_feature (76)..(80): Xaa can be any naturally occurring amino acid
  misc_feature (185)..(193): Xaa can be any naturally occurring amino acid
  misc_feature (268)..(268): Xaa can be any naturally occurring amino acid
  misc_feature (278)..(278): Xaa can be any naturally occurring amino acid
EPKKERTSATFDSADLKKSIKTEEEEDGVSCEGIQNDECNAILKYPGNNFNQNLTATTDVNREEKYFECEICSKQXXXXXSLTIHMTVHTGEKPFECEICKKQFSLKVYLKSHIMSVHTGEKPFNSEICTKTFSRKQILKSHMRVHTVEKPFKCEICTKQFARNTHLTRHMIVHTGEKLFECEIXXXXXXXXXSLTIHMAVHTGEKPFECEICKKQFALKVYLKSHIMSVHTGEKPFNCEICTKRFSRKHGLKFHMRRHTGEKPFACXICTKQFSRKXNFKSHMRVHTI

SEQ ID NO: 37956 - protein, 273 aa, Diabrotica virgifera
  misc_feature: Coding regions on vcDNA: vcDNA=SeqID_17653; Strand=+; Position=56-877
  misc_feature: Homolog annotation: Hit_ID=XP_395642.1; Match level="QueryCoverage =96%, HitCoverage=15%, E-value=3e-30, Identity=28%"; Hit description =similar to CCAAT/enhancer binding protein zeta; CCAAT-box-binding transcription factor [Apis
  misc_feature (105)..(110): Xaa can be any naturally occurring amino acid
KFNRTVFDHFEHLISANEKNRIKGSLNILKHFNTVQEKDIEVNHALTRIIRGLGSSTNIPRTGFYTILVALLNFRNDISLSQIFDLMEKHLHKAGSNAKSENADXXXXXXLACGAIVRSNLWSKTTHEEKLKIVECILTASKERTYQGLLAFEFITNIFEKVEDKDFYALCPLLKDEVSKPLENYTLDSLYLLNNMKKKYPQLPKKLKSVIVYPEVLSEENIGKLCRILMIIPKLSSLQHPVYDIISIEAATSSNLNHFLEELDWYLDIPNRE

SEQ ID NO: 37957 - protein, 66 aa, Diabrotica virgifera; identical to SEQ ID NO: 26808
  misc_feature: Coding regions on vcDNA: vcDNA=SeqID_17654; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 37958 - protein, 83 aa, Diabrotica virgifera
  misc_feature: Coding regions on vcDNA: vcDNA=SeqID_17655; Strand=-; Position=296-547
HIYNLHIINTSNLSRMRLVLSSNSCHTKYTAGIIYSRDHLCHPIFVCHLFLNTKIYSTLLRTINHNTFILKIIYMHFILICTH

SEQ ID NO: 37959 - protein, 61 aa, Diabrotica virgifera
  misc_feature: Coding regions on vcDNA: vcDNA=SeqID_17656; Strand=+; Position=504-689
IFDSHIHSTYYSCTNDDNIRIQKMNIYTADVVANRGNRQHLFHLIIINMSLCVKYKDAPVH

SEQ ID NO: 37960 - protein, 185 aa, Diabrotica virgifera
  misc_feature: Coding regions on vcDNA: vcDNA=SeqID_17657; Strand=+; Position=102-659
  misc_feature: Homolog annotation: Hit_ID=NP_033198.1; Match level="QueryCoverage =45%, HitCoverage=30%, E-value=4e-15, Identity=40%"; Hit description =seven in absentia 1A [Mus musculus] gb|AAH46317.1| Seven in absentia 1A [Mus musculus]
  misc_feature: Gene Ontology Annotation: Molecular function=transcription co -repressor activity; Cellular component=cytoplasm; Biological process= small GTPase mediated signal transduction
  misc_feature: Pfam annotation: Pfam_ID=zf-C3HC4; Match level="Score=5.4, E-value =0.012, Copies=1"; Pfam description=Zinc finger, C3HC4 type (RING finger)
MKYSATLQIQSDNEITTRSMKNQEVKTFNDAIHKVTFLQSEFLRLNSFDFMTTKFLKIPRTEKLNLTYSIKIVDNNFLIEPEPTKGDSDIQRAAGIGKHFECPICQEYMSPPIYNCATGHTICKNCKDKLVFCPYCKALVGISRNYVMEDMLDTLLLHCHNEYKGCTFTGKVQEIKLHEVMCHYN

SEQ ID NO: 37961 - protein, 98 aa, Diabrotica virgifera
  misc_feature: Coding regions on vcDNA: vcDNA=SeqID_17658; Strand=-; Position=1-294
  misc_feature (14)..(23): Xaa can be any naturally occurring amino acid
  misc_feature (26)..(34): Xaa can be any naturally occurring amino acid
  misc_feature (38)..(98): Xaa can be any naturally occurring amino acid
STIDNSIRHIPDPXXXXXXXXXXINXXXXXXXXXVLMXXXXXXXXXXXXXXXXXXXXXXXXXXXXXXXXXXXXXXXXXXXXXXXXXXXXXXXXXXXXX

SEQ ID NO: 37962 - protein, 259 aa, Diabrotica virgifera
  misc_feature: Coding regions on vcDNA: vcDNA=SeqID_17659; Strand=+; Position=82-860
  misc_feature: Homolog annotation: Hit_ID=XP_307207.1; Match level="QueryCoverage =79%, HitCoverage=43%, E-value=6e-44, Identity=38%"; Hit description =ENSANGP00000014556 [Anopheles gambiae]
  misc_feature (200)..(200): Xaa can be any naturally occurring amino acid
  misc_feature (210)..(210): Xaa can be any naturally occurring amino acid
  misc_feature (215)..(215): Xaa can be any naturally occurring amino acid
MSSKHRHKNSKSRSRSKSSIITEILYPRDDIKCVEDKKFSIKVSKIMGRYMVANKEIEPGEVILSELPIVIGPCTDCKVQCLGCYKNLEEQPFIKCKSCNWPLCSQKCSGLNKRLGHTEVECAILRETQSSNFLDYNDFSKIRSRLCALAPFRCLLLKKTDPKSYDLLLDMEHHNDLRRNIPEIWDTNQRKVVDTIIKDXGLNCFTEEEXHTMCXILEVNSFEIGHQDRNIRGLYPTAFLMSHDCVPNTNHCDEEAIID

SEQ ID NO: 37963 - protein, 94 aa, Diabrotica virgifera
  misc_feature: Coding regions on vcDNA: vcDNA=SeqID_17660; Strand=+; Position=1-285
  misc_feature: Homolog annotation: Hit_ID=XP_313621.1; Match level="QueryCoverage =98%, HitCoverage=20%, E-value=2e-20, Identity=47%"; Hit description =ENSANGP00000024261 [Anopheles gambiae]
GIFGGICENGIWRRRYNYEVYHRYKHIFGGKDVVSLIRIGRLRWAGHLARSQHNNPPRRILMSQPVGSRNRGRPKLRWKDGVNEDGMKIGAANW

SEQ ID NO: 37964 - protein, 110 aa, Diabrotica virgifera
  misc_feature: Coding regions on vcDNA: vcDNA=SeqID_17661; Strand=+; Position=1-333
  misc_feature (34)..(42): Xaa can be any naturally occurring amino acid
ILEKNHGKHFLLRRDKLSKKKLVRSEKIIFVKLXXXXXXXXXRSRYRPAPRGFVVRTSFLGEFVQKSQIGVVSLDGGDNTAPSNPVTSSITYIFLKCSTSSPLSLKQCWK

SEQ ID NO: 37965 - protein, 72 aa, Diabrotica virgifera
  misc_feature: Coding regions on vcDNA: vcDNA=SeqID_17662; Strand=-; Position=547-765
NDFFSDVASSWSISATTRTPLTRKSFNCGNQLCSSKLVQVHLVHFGIQAFLDGVNPILAVFIGITRQTIGMI

SEQ ID NO: 37966 - protein, 222 aa, Diabrotica virgifera
  misc_feature: Coding regions on vcDNA: vcDNA=SeqID_17663; Strand=+; Position=134-802
  misc_feature: Homolog annotation: Hit_ID=XP_395554.1; Match level="QueryCoverage =86%, HitCoverage=9%, E-value=4e-40, Identity=49%"; Hit description =similar to ENSANGP00000014981 [Apis mellifera]
MATNNIGIDWLGTMGSLGVGVDFDNSSEHPGTSNMNQYEQMDRTNATLKRNPKMELSKNDLIKLVTFFEGEIQARDIVIAALKSERLKQVVNVGRYRPVVLSDPYTALLRDSIADGPKAKSPVSEKEMAQAAEQQLHAFGQLILQQRWAHQHMMNILKEAENKHKKVIQELEEEKCKHEHDTAQGDDITYGLEMERTRLKQELEMERNRQESADDEKARQNK

SEQ ID NO: 37967 - protein, 250 aa, Diabrotica virgifera
  misc_feature: Coding regions on vcDNA: vcDNA=SeqID_17664; Strand=+; Position=1-750
  misc_feature (1)..(220): Xaa can be any naturally occurring amino acid
  misc_feature (223)..(239): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWNXXXXXXXXXXXXXXXXXIFNVISLHFST

SEQ ID NO: 37968 - protein, 237 aa, Diabrotica virgifera
  misc_feature: Coding regions on vcDNA: vcDNA=SeqID_17665; Strand=-; Position=220-933
  misc_feature (2)..(222): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRYGEIDLKIFILR

SEQ ID NO: 37969 - protein, 51 aa, Diabrotica virgifera
  misc_feature: Coding regions on vcDNA: vcDNA=SeqID_17666; Strand=+; Position=2-157
  misc_feature (9)..(21): Xaa can be any naturally occurring amino acid
  misc_feature (25)..(32): Xaa can be any naturally occurring amino acid
GPSWGPILXXXXXXXXXXXXXPPLXXXXXXXXDLYYHYALIFRIITGPTCS

SEQ ID NO: 37970 - protein, 66 aa, Diabrotica virgifera
  misc_feature: Coding regions on vcDNA: vcDNA=SeqID_17667; Strand=-; Position=1-198
  misc_feature (3)..(13): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
LLXXXXXXXXXXXNNLAHTGLNXXXXXXXXRTXXXXXXXXXXXXXIQHRGRXXXXXXXXXXXXXLL

SEQ ID NO: 37971 - protein, 69 aa, Diabrotica virgifera
  misc_feature: Coding regions on vcDNA: vcDNA=SeqID_17668; Strand=-; Position=13-222
FCSNSFNSLALVYENVENTIDYRTFCLSCTSSVRVNCSRRGRRTLSGDSNYLSFIRHSSLPLLKHVLLR

SEQ ID NO: 37972 - protein, 24 aa, Diabrotica virgifera
  misc_feature: Coding regions on vcDNA: vcDNA=SeqID_17669; Strand=-; Position=0-71
  misc_feature (7)..(22): Xaa can be any naturally occurring amino acid
KKWIKKXXXXXXXXXXXXXXXXIT

SEQ ID NO: 37973 - protein, 53 aa, Diabrotica virgifera
  misc_feature: Coding regions on vcDNA: vcDNA=SeqID_17670; Strand=-; Position=21-182
HYIKCLNFKMTHFCFGPHFYGKSNIDTYLTRHNDSHGVTRKRGRCHGYKYVRL

SEQ ID NO: 37974 - protein, 58 aa, Diabrotica virgifera
  misc_feature: Coding regions on vcDNA: vcDNA=SeqID_17671; Strand=-; Position=1-174
  misc_feature (3)..(41): Xaa can be any naturally occurring amino acid
  misc_feature (43)..(58): Xaa can be any naturally occurring amino acid
RFXXXXXXXXXXXXXXXXXXXXXXXXXXXXXXXXXXXXXXXGXXXXXXXXXXXXXXXX

SEQ ID NO: 37975 - protein, 56 aa, Diabrotica virgifera
  misc_feature: Coding regions on vcDNA: vcDNA=SeqID_17672; Strand=+; Position=470-640
KYLVLPNSVDINACITTVLETIFIFCSFVTYPLPLCRYKMQCKGQNGRFRIPENYR

SEQ ID NO: 37976 - protein, 157 aa, Diabrotica virgifera
  misc_feature: Coding regions on vcDNA: vcDNA=SeqID_17673; Strand=+; Position=3-476
  misc_feature (1)..(38): Xaa can be any naturally occurring amino acid
  misc_feature (49)..(61): Xaa can be any naturally occurring amino acid
  misc_feature (63)..(72): Xaa can be any naturally occurring amino acid
  misc_feature (78)..(87): Xaa can be any naturally occurring amino acid
  misc_feature (89)..(139): Xaa can be any naturally occurring amino acid
XXXXXXXXXXXXXXXXXXXXXXXXXXXXXXXXXXXXXXLINNSSSFISXXXXXXXXXXXXXIXXXXXXXXXXFVTETXXXXXXXXXXQXXXXXXXXXXXXXXXXXXXXXXXXXXXXXXXXXXXXXXXXXXXXXXXXXXXIFSNNLSLTFHHQSFSFF

SEQ ID NO: 37977 - protein, 279 aa, Diabrotica virgifera
  misc_feature: Coding regions on vcDNA: vcDNA=SeqID_17674; Strand=+; Position=2-841
  misc_feature (1)..(255): Xaa can be any naturally occurring amino acid
  misc_feature (277)..(277): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILLGEFKSIIKIATSMLDXSL

SEQ ID NO: 37978 - protein, 268 aa, Diabrotica virgifera
  misc_feature: Coding regions on vcDNA: vcDNA=SeqID_17675; Strand=+; Position=55-858
  misc_feature: Homolog annotation: Hit_ID=EAK90389.1; Match level="QueryCoverage =89%, HitCoverage=18%, E-value=3e-19, Identity=27%"; Hit description =cryptopsoridial mucin, large thr stretch, signal peptide sequence, transcripts identified by EST [Cryptosp
  misc_feature: Gene Ontology Annotation: Molecular function=signal transducer activity; Cellular component=plasma membrane; Biological process =invasive growth
MLILISILLWALRNRGSGSESLLSTTPVPTNDTGEHSAHLNGFITGEKSKNVSTTTHRNTHKPEEKDPNNQESAKTPVFVPGTTTLASKTSDKVVTTGTGTSTVATTQSKLTTFSPTTQKITVDTVSTPVQTIVKLKTVETTTLPTTTESNPQEKNITGGSPDTTTEAVTTNKNNLPSSSSQPNSALASQTQSSTIFTTPVSSTIVSSATTALYGVSISTKLAETSLKPTRETPTAVTTTVETTTLPTQQKVILKKQILVMVHQIQLQ

SEQ ID NO: 37979 - protein, 204 aa, Diabrotica virgifera
  misc_feature: Coding regions on vcDNA: vcDNA=SeqID_17676; Strand=+; Position=304-916
  misc_feature: Homolog annotation: Hit_ID=CAH64510.1; Match level="QueryCoverage =97%, HitCoverage=37%, E-value=3e-59, Identity=56%"; Hit description =putative esterase [Tribolium castaneum]
  misc_feature: Gene Ontology Annotation: Molecular function=carboxylesterase activity; Cellular component=synaptic junction
  misc_feature: Pfam annotation: Pfam_ID=COesterase; Match level="Score=-178.3, E -value=0.00084, Copies=1"; Pfam description=Carboxylesterase
  misc_feature (178)..(178): Xaa can be any naturally occurring amino acid
  misc_feature (197)..(197): Xaa can be any naturally occurring amino acid
MVATVKVEEGLVEGTTRTSTNGIPFHSFTCIPYGKAPKGDLRFKAPQPVEPWQGVLHVNHEENCCVQLDMLTYKLCGSEDCLSLHVFTRKIPSEENKLKPVMVYIHGGGFMMGNHSTSVYGPEHLMMEDIVLVSVTYRVGILGFLSLSDPSLDVPGNAGLKDQALALRCVQRNIKYFXGDPNNVTLFGESAGVASVXYQLLSPT

SEQ ID NO: 37980 - protein, 101 aa, Diabrotica virgifera
  misc_feature: Coding regions on vcDNA: vcDNA=SeqID_17677; Strand=+; Position=2-307
NIVFVFPHNMTCRKFYCWDHFEKFKDNSDVLEPTQRQQTGTVNHRQEVKGGNDISRSCEDGKAQNNVILLGNRSSLRPPKATIRGIMPERFYYHIILPSER

SEQ ID NO: 37981 - protein, 223 aa, Diabrotica virgifera
  misc_feature: Coding regions on vcDNA: vcDNA=SeqID_17678; Strand=-; Position=1-669
  misc_feature (1)..(206): Xaa can be any naturally occurring amino acid
  misc_feature (208)..(223): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 37982 - protein, 104 aa, Diabrotica virgifera
  misc_feature: Coding regions on vcDNA: vcDNA=SeqID_17679; Strand=+; Position=17-331
  misc_feature (3)..(10): Xaa can be any naturally occurring amino acid
  misc_feature (27)..(33): Xaa can be any naturally occurring amino acid
  misc_feature (96)..(103): Xaa can be any naturally occurring amino acid
QAXXXXXXXXSRFKSFEIHKIKCNQMXXXXXXXEETCKLEIEYNDLDDAFLDGIKCEVKEESNGQSTHDTYDYLDLKERPIKTEIEQDANKLNLFXXXXXXXXG

SEQ ID NO: 37983 - protein, 51 aa, Diabrotica virgifera
  misc_feature: Coding regions on vcDNA: vcDNA=SeqID_17680; Strand=+; Position=2-157
NCISKYIYLHYHILRKSCKPEYDCLNYSQYLQKPYKYIYMKIHNSVISRSC

SEQ ID NO: 37984 - protein, 65 aa, Diabrotica virgifera
  misc_feature: Coding regions on vcDNA: vcDNA=SeqID_17681; Strand=-; Position=0-194
  misc_feature (22)..(59): Xaa can be any naturally occurring amino acid
YNLLYIHYLTIPNTQPTDNKIXXXXXXXXXXXXXXXXXXXXXXXXXXXXXXXXXXXXXXGLQKAT

SEQ ID NO: 37985 - protein, 76 aa, Diabrotica virgifera
  misc_feature: Coding regions on vcDNA: vcDNA=SeqID_17682; Strand=-; Position=71-301
IASSLPRNHIFSHSQTLLSLHPHYIIFTLRGILLPFGLQVYRKSHIDIFITRYFDSLRSGYQRCQHFVEQYLRSRW

SEQ ID NO: 37986 - protein, 168 aa, Diabrotica virgifera
  misc_feature: Coding regions on vcDNA: vcDNA=SeqID_17683; Strand=+; Position=3-506
  misc_feature (2)..(163): Xaa can be any naturally occurring amino acid
  misc_feature (165)..(166): Xaa can be any naturally occurring amino acid
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXEG

SEQ ID NO: 37987 - protein, 278 aa, Diabrotica virgifera
  misc_feature: Coding regions on vcDNA: vcDNA=SeqID_17684; Strand=+; Position=59-895
ILHISQLSLKNRSSTFKVSHITMSGDFNSLWDSIDLTKDEEDSNDSVITSEVYNSPNHCFERAPPPLVPIPTKVSVPITARNKKLPKLTRIVYKDDPYEHVEPETFMVNKTSSSIVSPQSTKLVQLVNGSRIYKINIPHNVIMAQGKGPVFMNIPGVGSMQLKLDPAFKNPGLDSPVTHVQPPSLQPISAIISTQGEKQENVFINETLYKNCLVPLTARAQPKNSRRLSPKKSKEENQLFIGFPKNDCNTSDKYLRRLNNIVDQYKTKLQKEMAYFSN

SEQ ID NO: 37988 - protein, 58 aa, Diabrotica virgifera
  misc_feature: Coding regions on vcDNA: vcDNA=SeqID_17685; Strand=-; Position=358-534
  misc_feature (41)..(48): Xaa can be any naturally occurring amino acid
EHHLTQPWYGSVIPKSLIQSIISYFNIIKKEIIFITETLNXXXXXXXXSYLIIFISLV

SEQ ID NO: 37989 - protein, 238 aa, Diabrotica virgifera
  misc_feature: Coding regions on vcDNA: vcDNA=SeqID_17686; Strand=+; Position=86-802
  misc_feature: Homolog annotation: Hit_ID=XP_311717.1; Match level="QueryCoverage =72%, HitCoverage=51%, E-value=3e-27, Identity=44%"; Hit description =ENSANGP00000014281 [Anopheles gambiae]
  misc_feature: Pfam annotation: Pfam_ID=Renin_r; Match level="Score=161.8, E-value =1.5e-45, Copies=1"; Pfam description=Renin receptor-like protein
PGPLQKGHHFPLKTDIGESKVYRSIERRIEEHYPNEDTNLVRVRLANGLEDIHKYKIFEDIASGDSKQLNHKSLKLDVDEDRKFAQRIEEGEIKRDNIPDLYWFEVSSLHAVSDLYGENSTQVLEAKQLLNECILRLNSAFNKLYNGYVLVTVVTSDASHTRRGRSILAADEPTDDKTKYNLASYYSKDYPVIFNLILWFGVVMLFSLIAICMAIGTMDPGRDSIIYRMTSTRMKKDN

SEQ ID NO: 37990 - protein, 32 aa, Diabrotica virgifera
  misc_feature: Coding regions on vcDNA: vcDNA=SeqID_17687; Strand=-; Position=1-96
  misc_feature (23)..(23): Xaa can be any naturally occurring amino acid
INIAATPIITLIQHRGRNLYYRXELSNKITLL

SEQ ID NO: 37991 - protein, 313 aa, Diabrotica virgifera
  misc_feature: Coding regions on vcDNA: vcDNA=SeqID_17688; Strand=+; Position=3-941
  misc_feature: Homolog annotation: Hit_ID=XP_309214.1; Match level="QueryCoverage =94%, HitCoverage=28%, E-value=1e-109, Identity=64%"; Hit description= ENSANGP00000016011 [Anopheles gambiae]
  misc_feature: Gene Ontology Annotation: Molecular function=dihydropyrimidine dehydrogenase activity; Cellular component=cytoplasm; Biological process=uracil catabolism
  misc_feature: Pfam annotation: Pfam_ID=DHO_dh; Match level="Score=-11.9, E-value =1.4e-11, Copies=1"; Pfam description=Dihydroorotate dehydrogenase
  misc_feature (148)..(154): Xaa can be any naturally occurring amino acid
SGNNYGPQQGSFLNIEVISEKCLDYWLQGIRELKKDHPTKIIIASAMCEYIEKDWREITKRVEEAGADMLELNLSCPHGVKESGMGLACGQNAEMVKNISSWVRSTVKIPFFIKLTPNITDITVLAQAAKDGGAWGVSAINTISGLMXXXXXXXAWPAVGVDKRTTYGGVSGNATRPVGLRAVSAIAEKIPDLAILGVGGVESAETTLQYLQCGASAVQICSAVQNQDFTLIDDYCTGLKALLYLDGKLNGWQGQSPPTYKHQKGKNVVPVYDANGKKLPHFGNYQKKREEILSTLYKESKYNDDQLLNHEGR

SEQ ID NO: 37992 - protein, 73 aa, Diabrotica virgifera
  misc_feature: Coding regions on vcDNA: vcDNA=SeqID_17689; Strand=+; Position=330-551
SKTPITSILQYPKYSRTRVNTYKIIYIIKLCAEMLTLRCSLRTLNPRYCYPYYCGLLEDSITYHFHPNLTNQL

SEQ ID NO: 37993 - protein, 84 aa, Diabrotica virgifera
  misc_feature: Coding regions on vcDNA: vcDNA=SeqID_17690; Strand=-; Position=2-253
  misc_feature (29)..(35): Xaa can be any naturally occurring amino acid
  misc_feature (42)..(84): Xaa can be any naturally occurring amino acid
IIVGTYTDLFYSQYRTYMMSYRYICIMLXXXXXXXLHNVNIXXXXXXXXXXXXXXXXXXXXXXXXXXXXXXXXXXXXXXXXXXX

SEQ ID NO: 37994 - protein, 248 aa, Diabrotica virgifera
  misc_feature: Coding regions on vcDNA: vcDNA=SeqID_17691; Strand=+; Position=1-744
  misc_feature: Homolog annotation: Hit_ID=AAF87760.1; Match level="QueryCoverage =100%, HitCoverage=56%, E-value=1e-95, Identity=74%"; Hit description= cytochrome oxidase subunit I [Diabrotica virgifera zeae]
  misc_feature: Pfam annotation: Pfam_ID=COX1; Match level="Score=-121.6, E-value =4.2e-07, Copies=1"; Pfam description=Cytochrome C and Quinol oxidase polyp
  misc_feature (24)..(24): Xaa can be any naturally occurring amino acid
  misc_feature (59)..(59): Xaa can be any naturally occurring amino acid
  misc_feature (76)..(76): Xaa can be any naturally occurring amino acid
  misc_feature (79)..(85): Xaa can be any naturally occurring amino acid
  misc_feature (112)..(118): Xaa can be any naturally occurring amino acid
  misc_feature (132)..(132): Xaa can be any naturally occurring amino acid
  misc_feature (140)..(156): Xaa can be any naturally occurring amino acid
  misc_feature (186)..(186): Xaa can be any naturally occurring amino acid
  misc_feature (202)..(209): Xaa can be any naturally occurring amino acid
  misc_feature (230)..(230): Xaa can be any naturally occurring amino acid
KEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 37995 - protein, 46 aa, Diabrotica virgifera
  misc_feature: Coding regions on vcDNA: vcDNA=SeqID_17692; Strand=+; Position=1-138
  misc_feature (34)..(40): Xaa can be any naturally occurring amino acid
FVCVLLPVADVLPLYAVAPLWRFVILKLFWSCRXXXXXXXDGNYIL

SEQ ID NO: 37996 - protein, 73 aa, Diabrotica virgifera
  misc_feature: Coding regions on vcDNA: vcDNA=SeqID_17693; Strand=+; Position=150-372
  misc_feature: Homolog annotation: Hit_ID=AAD00524.1; Match level="QueryCoverage =84%, HitCoverage=14%, E-value=8e-14, Identity=58%"; Hit description =aspartic protease [Onchocerca volvulus]
  misc_feature: Gene Ontology Annotation: Molecular function=aspartic-type endopeptidase activity; Cellular component=lysosome; Biological process=induction of non-apoptotic programmed cell death
  misc_feature (55)..(55): Xaa can be any naturally occurring amino acid
GLLATDNITVIDQSSVVLANYLHDLYYGKISIGSPAQTFNVIFDTESSNLWIPHXDRPFLHDACLLHHKYYCL

SEQ ID NO: 37997 - protein, 58 aa, Diabrotica virgifera
  misc_feature: Coding regions on vcDNA: vcDNA=SeqID_17694; Strand=-; Position=189-365
SFLEVDDTPTYQTTSPKLNLPILSRADLLRAIAEPRPVSGPKLSTSWKFSTWPASSIY

SEQ ID NO: 37998 - protein, 263 aa, Diabrotica virgifera
  misc_feature: Coding regions on vcDNA: vcDNA=SeqID_17695; Strand=+; Position=2-790
  misc_feature (1)..(54): Xaa can be any naturally occurring amino acid
  misc_feature (57)..(64): Xaa can be any naturally occurring amino acid
  misc_feature (67)..(183): Xaa can be any naturally occurring amino acid
  misc_feature (185)..(198): Xaa can be any naturally occurring amino acid
  misc_feature (204)..(217): Xaa can be any naturally occurring amino acid
  misc_feature (237)..(248): Xaa can be any naturally occurring amino acid
  misc_feature (250)..(261): Xaa can be any naturally occurring amino acid
XXXXXXXXXXXXXXXXXXXXXXXXXXXXXXXXXXXXXXXXXXXXXXXXXXXXXXSFXXXXXXXXAHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWXXXXXXXXXXXXXXVRLLKFYMDLSLNRCEPGWXXXXXXXXXXXXKXXXXXXXXXXXXIS

SEQ ID NO: 37999 - protein, 31 aa, Diabrotica virgifera
  misc_feature: Coding regions on vcDNA: vcDNA=SeqID_17696; Strand=-; Position=1-93
  misc_feature (6)..(31): Xaa can be any naturally occurring amino acid
RYLFYXXXXXXXXXXXXXXXXXXXXXXXXXX

SEQ ID NO: 38000 - protein, 295 aa, Diabrotica virgifera
  misc_feature: Coding regions on vcDNA: vcDNA=SeqID_17697; Strand=+; Position=3-890
  misc_feature (23)..(280): Xaa can be any naturally occurring amino acid
RLTDVWVVRFYIQKISNSCSSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDFKTPTPTKQMDHS

SEQ ID NO: 38001 - protein, 74 aa, Diabrotica virgifera
  misc_feature: Coding regions on vcDNA: vcDNA=SeqID_17698; Strand=-; Position=376-600
  misc_feature (21)..(29): Xaa can be any naturally occurring amino acid
  misc_feature (32)..(49): Xaa can be any naturally occurring amino acid
  misc_feature (56)..(68): Xaa can be any naturally occurring amino acid
NSVNIHIYNYYIYIILILIIXXXXXXXXXDIXXXXXXXXXXXXXXXXXXLHNLKYXXXXXXXXXXXXXLITNYI

SEQ ID NO: 38002 - protein, 273 aa, Diabrotica virgifera
  misc_feature: Coding regions on vcDNA: vcDNA=SeqID_17699; Strand=+; Position=2-820
  misc_feature (1)..(6): Xaa can be any naturally occurring amino acid
  misc_feature (14)..(22): Xaa can be any naturally occurring amino acid
  misc_feature (25)..(35): Xaa can be any naturally occurring amino acid
  misc_feature (39)..(62): Xaa can be any naturally occurring amino acid
  misc_feature (67)..(205): Xaa can be any naturally occurring amino acid
  misc_feature (208)..(253): Xaa can be any naturally occurring amino acid
  misc_feature (255)..(261): Xaa can be any naturally occurring amino acid
  misc_feature (266)..(266): Xaa can be any naturally occurring amino acid
  misc_feature (271)..(271): Xaa can be any naturally occurring amino acid
XXXXXXVREYLSFXXXXXXXXXYLXXXXXXXXXXXHLFXXXXXXXXXXXXXXXXXXXXXXXXGNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTXXXXXXXXXXXXXXXXXXXXXXXXXXXXXXXXXXXXXXXXXXXXXXVXXXXXXXKTRNXYRVYXLL

SEQ ID NO: 38003 - protein, 76 aa, Diabrotica virgifera
  misc_feature: Coding regions on vcDNA: vcDNA=SeqID_17700; Strand=-; Position=70-300
  misc_feature (25)..(33): Xaa can be any naturally occurring amino acid
LTLISLSKRSIYHKPSSIHVSQTFXXXXXXXXXIISQRPSLVSSFVYLYLFVKLFTYCLYREKCYLEILAFLAQRS

SEQ ID NO: 38004 - protein, 64 aa, Diabrotica virgifera
  misc_feature: Coding regions on vcDNA: vcDNA=SeqID_17701; Strand=-; Position=111-305
SYISCYSNDTSLSSAHSYSRFNGSSTINYYLSSTLLINRFCRWLIILFIINNRVTSHCKYIRCA

SEQ ID NO: 38005 - protein, 25 aa, Diabrotica virgifera
  misc_feature: Coding regions on vcDNA: vcDNA=SeqID_17702; Strand=-; Position=1-75
  misc_feature (5)..(25): Xaa can be any naturally occurring amino acid
KKLGXXXXXXXXXXXXXXXXXXXXX

SEQ ID NO: 38006 - protein, 246 aa, Diabrotica virgifera
  misc_feature: Coding regions on vcDNA: vcDNA=SeqID_17703; Strand=+; Position=157-896
  misc_feature: Homolog annotation: Hit_ID=XP_320245.1; Match level="QueryCoverage =98%, HitCoverage=45%, E-value=9e-40, Identity=33%"; Hit description =ENSANGP00000016471 [Anopheles gambiae]
  misc_feature: Gene Ontology Annotation: Cellular component=membrane; Biological process=electron transport
  misc_feature (145)..(151): Xaa can be any naturally occurring amino acid
  misc_feature (173)..(173): Xaa can be any naturally occurring amino acid
  misc_feature (212)..(212): Xaa can be any naturally occurring amino acid
  misc_feature (229)..(229): Xaa can be any naturally occurring amino acid
FVNELGMLQLVLIAVVIVLFYYYAIRPMKYWKERGVIQGRPIWLFGDNWRAFFRLETFGQPYHTAYKLDPDARYVGFYQFTVPTLMIRDPELLKQITVKDSDYFTNHRAIVPDEGDPLWTNNLLGLKDQKWKDMRHILTPSFTSXXXXXXXTLMVECAENFVTHFLKKNQDGXDVSIKDVTTRFANDVVASTAFGIRTDSLEEQNNEFYLMXRDMTDFTSLRKGIKFFXFFIMPKILRFFNVHFFD

SEQ ID NO: 38007 - protein, 67 aa, Diabrotica virgifera
  misc_feature: Coding regions on vcDNA: vcDNA=SeqID_17704; Strand=-; Position=155-358
  misc_feature (41)..(46): Xaa can be any naturally occurring amino acid
SYLLLFQMMSYMQMPLHTQLSYSVLRSVSVSISQMTIITPXXXXXXGQTYRRWTSFFHSQTTHSLST

SEQ ID NO: 38008 - protein, 114 aa, Diabrotica virgifera
  misc_feature: Coding regions on vcDNA: vcDNA=SeqID_17705; Strand=-; Position=327-671
SDSGIMGFHSFVSSLQLIFSHAQLTEYLVLDRIDFIKSGPALYKLLLEGYHSLCHRTGIAFRVREWYYVGPLFVVRFIAICSVAVSQQLFRASHVFLWQLDTTRDESACQYYQH

SEQ ID NO: 38009 - protein, 44 aa, Diabrotica virgifera
  misc_feature: Coding regions on vcDNA: vcDNA=SeqID_17706; Strand=+; Position=79-213
SFNSSTDQNIYLKISFPLLILNIFSYELQNHFSPQFTPKMYNSY

SEQ ID NO: 38010 - protein, 79 aa, Diabrotica virgifera
  misc_feature: Coding regions on vcDNA: vcDNA=SeqID_17707; Strand=+; Position=664-900
  misc_feature (41)..(41): Xaa can be any naturally occurring amino acid
  misc_feature (50)..(58): Xaa can be any naturally occurring amino acid
  misc_feature (72)..(72): Xaa can be any naturally occurring amino acid
QNTCCSIKAIVFFSHVESFGKCSLPLLPFYSQKSTGWATAXVQLKLNDPXXXXXXXXXVIKKSKEILSILTXLMWHIHF

SEQ ID NO: 38011 - protein, 92 aa, Diabrotica virgifera
  misc_feature: Coding regions on vcDNA: vcDNA=SeqID_17708; Strand=+; Position=244-522
RRLAHITVKDSKVLSGAAFREIHAEFIASTEKNATQLLYRLLHNNPSFLAYSMSLIAVENSPLQITFNNAHRDAKTIGIIDDADIPVHGHSF

SEQ ID NO: 38012 - protein, 29 aa, Diabrotica virgifera
  misc_feature: Coding regions on vcDNA: vcDNA=SeqID_17709; Strand=+; Position=1-90
SIVGIETEHRSSIAAPRSKSVIAMLERLD

SEQ ID NO: 38013 - protein, 125 aa, Diabrotica virgifera
  misc_feature: Coding regions on vcDNA: vcDNA=SeqID_17710; Strand=+; Position=334-711
  misc_feature (23)..(29): Xaa can be any naturally occurring amino acid
  misc_feature (88)..(93): Xaa can be any naturally occurring amino acid
FHIIPVFHLYLLVQKLPRVFFCXXXXXXXCIFTLFINFLVKYCCTNKYFLDIFPKIAKQYVDYLQVIPDSIREVIKNTVKSIGEEINXXXXXXIKDAVKAAIPQALNIPKIQLFPNNTLPKLFGF

SEQ ID NO: 38014 - protein, 61 aa, Diabrotica virgifera
  misc_feature: Coding regions on vcDNA: vcDNA=SeqID_17711; Strand=+; Position=2-187
GPGFPGLPPARPPRTRGFLSLFLFDRVRFSTDDYISIKIFSVDLYYICLIKKFELSVYDGL

SEQ ID NO: 38015 - protein, 52 aa, Diabrotica virgifera
  misc_feature: Coding regions on vcDNA: vcDNA=SeqID_17712; Strand=-; Position=1-156
  misc_feature (3)..(48): Xaa can be any naturally occurring amino acid
KNXXXXXXXXXXXXXXXXXXXXXXXXXXXXXXXXXXXXXXXXXXXXXXVSRL

SEQ ID NO: 38016 - protein, 78 aa, Diabrotica virgifera
  misc_feature: Coding regions on vcDNA: vcDNA=SeqID_17713; Strand=-; Position=3-236
  misc_feature (2)..(12): Xaa can be any naturally occurring amino acid
  misc_feature (15)..(25): Xaa can be any naturally occurring amino acid
  misc_feature (41)..(41): Xaa can be any naturally occurring amino acid
  misc_feature (45)..(58): Xaa can be any naturally occurring amino acid
  misc_feature (65)..(77): Xaa can be any naturally occurring amino acid
IXXXXXXXXXXXSFXXXXXXXXXXXNQPGLHRFKLRSCKIXKVEXXXXXXXXXXXXXXSNIEVAXXXXXXXXXXXXXC

SEQ ID NO: 38017 - protein, 137 aa, Diabrotica virgifera
  misc_feature: Coding regions on vcDNA: vcDNA=SeqID_17714; Strand=+; Position=337-750
  misc_feature (29)..(44): Xaa can be any naturally occurring amino acid
  misc_feature (49)..(58): Xaa can be any naturally occurring amino acid
  misc_feature (68)..(126): Xaa can be any naturally occurring amino acid
  misc_feature (128)..(135): Xaa can be any naturally occurring amino acid
QYILSIKYLFSLSHIKYLFGMSSQNKIFXXXXXXXXXXXXXXXXLLKYXXXXXXXXXXGIIYLFSSLXXXXXXXXXXXXXXXXXXXXXXXXXXXXXXXXXXXXXXXXXXXXXXXXXXXXXXXXXXXWXXXXXXXXHD

SEQ ID NO: 38018 - protein, 89 aa, Diabrotica virgifera
  misc_feature: Coding regions on vcDNA: vcDNA=SeqID_17715; Strand=-; Position=204-473
RTTLICLTIHSMCRTDDNFLNNGYGNSSAFDSVIHIFSYEFTQNSSGENFRDFHRDLGQDLLHNFVKNNMRLEGYPHLLIVTHKNDILT

SEQ ID NO: 38019 - protein, 107 aa, Diabrotica virgifera
  misc_feature: Coding regions on vcDNA: vcDNA=SeqID_17716; Strand=-; Position=454-777
SIIDRRAIKLHIVSLLSAARKRDAEDLLHDSLTCLIHDVLIRAGTLRQLACPRISRCEYDLSLWVSQNRDTMYKGSIENSSVASPISCHTAREKARRALSRHRYYVG

SEQ ID NO: 38020 - protein, 301 aa, Diabrotica virgifera
  misc_feature: Coding regions on vcDNA: vcDNA=SeqID_17717; Strand=+; Position=1-903
  misc_feature: Homolog annotation: Hit_ID=XP_308087.1; Match level="QueryCoverage =99%, HitCoverage=40%, E-value=3e-26, Identity=24%"; Hit description =ENSANGP00000019758 [Anopheles gambiae]
  misc_feature: Gene Ontology Annotation: Molecular function=motor activity; Cellular component=membrane fraction; Biological process=muscle development
EQEMLDDFERKLRDVQQNCKKKIDEKEEILQMSLTHSQNKDKETEELTKKMESLTLLEKELNELREKTSDQNTLMKSMYDEHEKMQQNEENLKNEVKKLRNMIDLEKENLQHMQRLHHQDILDKERKLQQTLNEKKVEIAIYWEEKLLNEISRLKDELEQVYIEEKITAIENIKRNKDECFQKAQAQWEKKYAQYLNEVHTLQNALEEKDKFYKDEIVKQQSITDQDIFELRRLMDKLDMSHHDKYEKLTQKHEAELERMKEEYETMVEDREQYWKSEIDTLNSTIANMRLQVEDLIQSHQ

SEQ ID NO: 38021 - protein, 47 aa, Diabrotica virgifera
  misc_feature: Coding regions on vcDNA: vcDNA=SeqID_17718; Strand=+; Position=3-143
FSLLFQIIKISFSEKVRKISLTSKFDPGIFFSQENSFSTSGTGLLIN

SEQ ID NO: 38022 - protein, 228 aa, Diabrotica virgifera
  misc_feature: Coding regions on vcDNA: vcDNA=SeqID_17719; Strand=-; Position=1-684
  misc_feature (1)..(165): Xaa can be any naturally occurring amino acid
  misc_feature (168)..(206): Xaa can be any naturally occurring amino acid
  misc_feature (208)..(228): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXXGXXXXXXXXXXXXXXXXXXXXX

SEQ ID NO: 38023 - protein, 84 aa, Diabrotica virgifera
  misc_feature: Coding regions on vcDNA: vcDNA=SeqID_17720; Strand=-; Position=152-406
WLCSFLHYLLYFIIGSFLLEIRKRMRDSIYMIVIWLVSQSKVNLWFRDNLKITPKYAFQFHNCYPSGYTHKGNPLQPLVKNSVS

SEQ ID NO: 38024 - protein, 56 aa, Diabrotica virgifera
  misc_feature: Coding regions on vcDNA: vcDNA=SeqID_17721; Strand=-; Position=316-486
DCISLLRRCLHRYRGNSNDLQITLSRSRDATRLSMLHKHDLYLRSEHSRCIADPNI

SEQ ID NO: 38025 - protein, 67 aa, Diabrotica virgifera
  misc_feature: Coding regions on vcDNA: vcDNA=SeqID_17722; Strand=+; Position=2-205
VVSNTDTVVLNSLDLKLNEVTLKGDKSLKPGQVELCAEEEIATLKFPSLVTPGSYILDIAFTDEIND

SEQ ID NO: 38026 - protein, 160 aa, Diabrotica virgifera
  misc_feature: Coding regions on vcDNA: vcDNA=SeqID_17723; Strand=-; Position=160-642
  misc_feature (15)..(84): Xaa can be any naturally occurring amino acid
  misc_feature (86)..(93): Xaa can be any naturally occurring amino acid
  misc_feature (96)..(102): Xaa can be any naturally occurring amino acid
  misc_feature (104)..(128): Xaa can be any naturally occurring amino acid
  misc_feature (132)..(149): Xaa can be any naturally occurring amino acid
HYAVIPKVISSYNHXXXXXXXXXXXXXXXXXXXXXXXXXXXXXXXXXXXXXXXXXXXXXXXXXXXXXXXXXXXXXXXXXXXXXXIXXXXXXXXPSXXXXXXXLXXXXXXXXXXXXXXXXXXXXXXXXXLIHXXXXXXXXXXXXXXXXXXHLYILTKHPIF

SEQ ID NO: 38027 - protein, 95 aa, Diabrotica virgifera
  misc_feature: Coding regions on vcDNA: vcDNA=SeqID_17724; Strand=+; Position=293-581
  misc_feature: Homolog annotation: Hit_ID=XP_311406.1; Match level="QueryCoverage =89%, HitCoverage=54%, E-value=4e-12, Identity=45%"; Hit description =ENSANGP00000025336 [Anopheles gambiae]
  misc_feature: Gene Ontology Annotation: Cellular component=vacuolar membrane; Biological process=hydrogen transport
  misc_feature: Pfam annotation: Pfam_ID=ATP-synt_C; Match level="Score=5.3, E-value =0.0036, Copies=1"; Pfam description=ATP synthase subunit C
  misc_feature (29)..(29): Xaa can be any naturally occurring amino acid
  misc_feature (34)..(34): Xaa can be any naturally occurring amino acid
LVLVVSDSIQLRSTYSLDSGFVNLRAGLXMSFTXLTLVVSIAMAADAGVRVTGQLPRFFVQMILILIFGNALHIYVSFDNIYLYTIAELHSSPML

SEQ ID NO: 38028 - protein, 45 aa, Diabrotica virgifera; identical to SEQ ID NO: 28932
  misc_feature: Coding regions on vcDNA: vcDNA=SeqID_17725; Strand=-; Position=1-135
  misc_feature (1)..(45): Xaa can be any naturally occurring amino acid

SEQ ID NO: 38029 - protein, 69 aa, Diabrotica virgifera
  misc_feature: Coding regions on vcDNA: vcDNA=SeqID_17726; Strand=-; Position=294-503
KCGCDHSFAVSHSWYISLRKDIQDAGSMNFVCMGKDELHLFFHLYHACHDLDGTTSHMISGSYFNRCSG

SEQ ID NO: 38030 - protein, 133 aa, Diabrotica virgifera
  misc_feature: Coding regions on vcDNA: vcDNA=SeqID_17727; Strand=+; Position=363-764
MACNLLKSIKSLLLCKSLSSLCMIADGDYSDPRHSRSYRPPVLTFVFYPSHSFVAVPGNWVSTLSSSVDLVTSSRICRSGCLLHCIYINHTTNMNTRANATIPNISGIDKYLRLVYKYLLLLLVLVISHNYFF

SEQ ID NO: 38031 - protein, 38 aa, Diabrotica virgifera
  misc_feature: Coding regions on vcDNA: vcDNA=SeqID_17728; Strand=+; Position=1-114
  misc_feature (3)..(18): Xaa can be any naturally occurring amino acid
DFXXXXXXXXXXXXXXXXQIVNYVSWEEIFIFSKKNFF

SEQ ID NO: 38032 - protein, 219 aa, Diabrotica virgifera
  misc_feature: Coding regions on vcDNA: vcDNA=SeqID_17729; Strand=+; Position=28-692
  misc_feature: Homolog annotation: Hit_ID=CAE47497.1; Match level="QueryCoverage =98%, HitCoverage=67%, E-value=3e-55, Identity=57%"; Hit description =cathepsin L-like proteinase [Diabrotica virgifera virgifera]
  misc_feature (38)..(51): Xaa can be any naturally occurring amino acid
  misc_feature (79)..(79): Xaa can be any naturally occurring amino acid
  misc_feature (118)..(118): Xaa can be any naturally occurring amino acid
  misc_feature (132)..(132): Xaa can be any naturally occurring amino acid
  misc_feature (137)..(137): Xaa can be any naturally occurring amino acid
  misc_feature (170)..(170): Xaa can be any naturally occurring amino acid
  misc_feature (212)..(212): Xaa can be any naturally occurring amino acid
CRSFILAAVLIGGTRANLGGFEKRTRFRATHNESYNGXXXXXXXXXXXXXXKKNRGTPSAKYESEENAYYLSGNKFADXPEREFQAMVGRLMDSKAKQSFIAEHVDDPYVQAGEEDDXEMETYLIVKDEGTXEMMLXFSTTASLEGQLAIHKNQRAPLTGQELPDCDTSXTDVCSGRVDDKMPYNYARRHELSSESRYAYTGRDDRLKNEEXRPLSSIS

SEQ ID NO: 38033 - protein, 59 aa, Diabrotica virgifera
  misc_feature: Coding regions on vcDNA: vcDNA=SeqID_17730; Strand=+; Position=1-177
  misc_feature (1)..(16): Xaa can be any naturally occurring amino acid
  misc_feature (19)..(56): Xaa can be any naturally occurring amino acid
XXXXXXXXXXXXXXXXYLXXXXXXXXXXXXXXXXXXXXXXXXXXXXXXXXXXXXXXEIV

SEQ ID NO: 38034 - protein, 89 aa, Diabrotica virgifera
  misc_feature: Coding regions on vcDNA: vcDNA=SeqID_17731; Strand=+; Position=636-902
  misc_feature (35)..(35): Xaa can be any naturally occurring amino acid
ICLCLTRNKFTERVYYFVFFFMYISGLVEAILSKXVWLCSTSFYKKQYLKSNIALFNTSKTSGKKHLNCHGNVVGMSVIVSVVPLRIYL

SEQ ID NO: 38035 - protein, 286 aa, Diabrotica virgifera
  misc_feature: Coding regions on vcDNA: vcDNA=SeqID_17732; Strand=+; Position=2-859
  misc_feature: Homolog annotation: Hit_ID=EAL30700.1; Match level="QueryCoverage =38%, HitCoverage=5%, E-value=4e-30, Identity=57%"; Hit description =GA21777-PA [Drosophila pseudoobscura]
  misc_feature: Pfam annotation: Pfam_ID=PAM2; Match level="Score=25.0, E-value =0.00023, Copies=1"; Pfam description=Ataxin-2 C-terminal region
LNTAITRAQSLVAVVGDPIALCSLGRCSKVWERFIQICNDSNSLFGITWTQLKLQLDGIELKKIYTLNPLAPEFIPRKYKELGMVPSVAKVEASLPKEVVPPPPPPTTLVSQIPPAVISPFPIQDLRFFPQLLYPPQQPRPFLFNLIPPTLTNGFTQPIPIVNPSLVVPPRQQVVTSLPKAVPVPQGAQSIPVQSPSKPHGNSSQAGSNKLIQFMNNVHFPEANVLNDCINLLPQNMSLADMLLQPPSLQERWYTYLRETTGPEAAEKFKYLLHTTNQKRSKVLDK

SEQ ID NO: 38036 - protein, 332 aa, Diabrotica virgifera
  misc_feature: Coding regions on vcDNA: vcDNA=SeqID_17733; Strand=+; Position=2-997
  misc_feature: Homolog annotation: Hit_ID=AAL90009.1; Match level="QueryCoverage =84%, HitCoverage=61%, E-value=3e-33, Identity=31%"; Hit description =AT07338p [Drosophila melanogaster]
  misc_feature: Pfam annotation: Pfam_ID=rve; Match level="Score=78.8, E-value=1.4e -20, Copies=1"; Pfam description=Integrase core domain
  misc_feature (251)..(258): Xaa can be any naturally occurring amino acid
LSRPGKIGKYRDINFPFQFLSADLLGPYPRSKNGNRYLLVVVDWFTKFVFVHPMSSATSKGIVKFIENQVFLIFGVPQIFAVDNGPQFISKDFKDLMSKYNVQKIWYNARYFPEINPTERVNKTIVTAIRSFIHDDHKEWDKEIFKIAQAIRLAKHEVTKFSPSFLTFARNIPTDGSFFGIIEERADNTLKINNELFTPRPADELSPLFSEVQKRLRQAHVENSKRYNLRKRDVQFHVGDRVWKKNFVQSXXXXXXXXKLAPKFVPCIINKVISPLVYNLKDVNVVDLGNFHVRNIKLDGTNSDDDSSVTYFFGGIKFLAINSWVFLIFINL

SEQ ID NO: 38037 - protein, 185 aa, Diabrotica virgifera
  misc_feature: Coding regions on vcDNA: vcDNA=SeqID_17734; Strand=+; Position=184-741
  misc_feature: Homolog annotation: Hit_ID=EAA10944.3; Match level="QueryCoverage =90%, HitCoverage=84%, E-value=8e-27, Identity=34%"; Hit description =ENSANGP00000010694 [Anopheles gambiae str. PEST] ref|XP_556657.1| ENSANGP00000010694 [Anopheles gambiae st
  misc_feature: Gene Ontology Annotation: Molecular function=transcriptional repressor activity; Cellular component=nucleus; Biological process =negative regulation of transcription from Pol II promoter
  misc_feature: Pfam annotation: Pfam_ID=zf-C2H2; Match level="Score=106.2, E-value =8.4e-29, Copies=5"; Pfam description=Zinc finger, C2H2 type
MCPKCDLGFWTKSAYEAHQPVHILKKAKQPVKKFRCDVCAKEFSKLCDVERHTRVHTGEKPCICNICNKRFQQAHNLSKHLLTHLHIKPFYCEICNKQFGRNDVLRRHLLTHSVDKPVKCSVCHRGFIRHSQLLQHMRRKHKRRPVEDVGESNADPNESESSETKDDGFDNQPSTSKSENESHDK

SEQ ID NO: 38038 - protein, 273 aa, Diabrotica virgifera
  misc_feature: Coding regions on vcDNA: vcDNA=SeqID_17735; Strand=+; Position=69-887
  misc_feature (12)..(18): Xaa can be any naturally occurring amino acid
  misc_feature (38)..(50): Xaa can be any naturally occurring amino acid
  misc_feature (52)..(63): Xaa can be any naturally occurring amino acid
  misc_feature (66)..(94): Xaa can be any naturally occurring amino acid
  misc_feature (96)..(131): Xaa can be any naturally occurring amino acid
  misc_feature (138)..(206): Xaa can be any naturally occurring amino acid
  misc_feature (209)..(272): Xaa can be any naturally occurring amino acid
LISIVREYLYFXXXXXXXIFRTSCIRDYLINNSSSFHXXXXXXXXXXXXXHXXXXXXXXXXXXKRXXXXXXXXXXXXXXXXXXXXXXXXXXXXXIXXXXXXXXXXXXXXXXXXXXXXXXXXXXXXXXXXXXYYFIFHXXXXXXXXXXXXXXXXXXXXXXXXXXXXXXXXXXXXXXXXXXXXXXXXXXXXXXXXXXXXXXXXXXXXXPLXXXXXXXXXXXXXXXXXXXXXXXXXXXXXXXXXXXXXXXXXXXXXXXXXXXXXXXXXXXXXXXXI

SEQ ID NO: 38039 - protein, 78 aa, Diabrotica virgifera
  misc_feature: Coding regions on vcDNA: vcDNA=SeqID_17736; Strand=+; Position=679-914
  misc_feature: Homolog annotation: Hit_ID=NP_066358.2; Match level="QueryCoverage =93%, HitCoverage=63%, E-value=2e-12, Identity=46%"; Hit description =zinc finger protein 14 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=34.2, E-value =3.8e-07, Copies=2"; Pfam description=Zinc finger, C2H2 type
  misc_feature (45)..(45): Xaa can be any naturally occurring amino acid
  misc_feature (60)..(60): Xaa can be any naturally occurring amino acid
  misc_feature (74)..(74): Xaa can be any naturally occurring amino acid
MDKEQLKYLVQKRFFEKPYGLGVKPYQGEICSKSFSTNRSLKRHXRTHTGEKPYHGEFCXKSFSFSNNLKEHKXTHGY

SEQ ID NO: 38040 - protein, 31 aa, Diabrotica virgifera
  misc_feature: Coding regions on vcDNA: vcDNA=SeqID_17737; Strand=-; Position=62-157
  misc_feature (1)..(11): Xaa can be any naturally occurring amino acid
  misc_feature (14)..(21): Xaa can be any naturally occurring amino acid
XXXXXXXXXXXGTXXXXXXXXKMKIFSHDTN

SEQ ID NO: 38041 - protein, 273 aa, Diabrotica virgifera
  misc_feature: Coding regions on vcDNA: vcDNA=SeqID_17738; Strand=-; Position=61-881
  misc_feature: Homolog annotation: Hit_ID=XP_396912.1; Match level="QueryCoverage =96%, HitCoverage=50%, E-value=1e-122, Identity=78%"; Hit description= similar to ENSANGP00000018236 [Apis mellifera]
  misc_feature: Gene Ontology Annotation: Molecular function=zinc ion binding; Cellular component=ubiquitin ligase complex; Biological process =ubiquitin-dependent protein catabolism
  misc_feature (28)..(28): Xaa can be any naturally occurring amino acid
  misc_feature (49)..(49): Xaa can be any naturally occurring amino acid
  misc_feature (79)..(80): Xaa can be any naturally occurring amino acid
  misc_feature (162)..(162): Xaa can be any naturally occurring amino acid
  misc_feature (186)..(186): Xaa can be any naturally occurring amino acid
  misc_feature (211)..(211): Xaa can be any naturally occurring amino acid
  misc_feature (243)..(243): Xaa can be any naturally occurring amino acid
  misc_feature (264)..(264): Xaa can be any naturally occurring amino acid
RRFKNQLGCRCGNVFCFACGESWHDPVXKCLLLRKWKKKCDDDSETPNXVAANTKECPKCNATIEKDGGCNHMICKNQXXCKADFCWVCLGPWEPHGSSWYNCNRYDEDEARSARDAQEKSRAALQRYLFYCNRYMNHMQSLKFEHKLYASVKEKMEDMQQXPMSWIEVQYLKKAESTILCRCRRXTLCIRYVFAYYLKKNNQSVIFEDNXKDLERATELLSEYLERDITNENLIEKKTRGSXDRYRYCDCRRIALLDHVHEGXEKDWWLYSD

SEQ ID NO: 38042 - protein, 59 aa, Diabrotica virgifera
  misc_feature: Coding regions on vcDNA: vcDNA=SeqID_17739; Strand=-; Position=494-673
SEGRREYISNSIKTSLYYAGEKNVTEFVVCKSYIFVLNTQSANTNMVISPKLTSLKLIS

SEQ ID NO: 38043 - protein, 83 aa, Diabrotica virgifera
  misc_feature: Coding regions on vcDNA: vcDNA=SeqID_17740; Strand=-; Position=446-697
  misc_feature (49)..(56): Xaa can be any naturally occurring amino acid
  misc_feature (60)..(70): Xaa can be any naturally occurring amino acid
  misc_feature (73)..(78): Xaa can be any naturally occurring amino acid
HGQYIASIQFNRWSGETLYLILNDMMLIIRCQKCFRIPLLNLNVVTDSXXXXXXXXLHSXXXXXXXXXXXKTXXXXXXASLYQ

SEQ ID NO: 38044 - protein, 242 aa, Diabrotica virgifera
  misc_feature: Coding regions on vcDNA: vcDNA=SeqID_17741; Strand=+; Position=1-726
  misc_feature (3)..(234): Xaa can be any naturally occurring amino acid
QVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDRMHESH

SEQ ID NO: 38045 - protein, 28 aa, Diabrotica virgifera
  misc_feature: Coding regions on vcDNA: vcDNA=SeqID_17742; Strand=-; Position=2-85
EKKIICKRQSITLLSNLSFILGKNRFYI

SEQ ID NO: 38046 - protein, 61 aa, Diabrotica virgifera
  misc_feature: Coding regions on vcDNA: vcDNA=SeqID_17743; Strand=+; Position=1-186
GKSMGTPGRVPGSGKFPEVGPHGRSGSYTNGRANPPTGTNSKSTSMAQNGNKFSGNQPVRR

SEQ ID NO: 38047 - protein, 57 aa, Diabrotica virgifera
  misc_feature: Coding regions on vcDNA: vcDNA=SeqID_17744; Strand=+; Position=61-231
  misc_feature (1)..(28): Xaa can be any naturally occurring amino acid
XXXXXXXXXXXXXXXXXXXXXXXXXXXXVKRSNVFILSIDVTIHYIKTYLSNRTQSL

SEQ ID NO: 38048 - protein, 277 aa, Diabrotica virgifera
  misc_feature: Coding regions on vcDNA: vcDNA=SeqID_17745; Strand=-; Position=1-831
  misc_feature (3)..(195): Xaa can be any naturally occurring amino acid
  misc_feature (199)..(222): Xaa can be any naturally occurring amino acid
  misc_feature (226)..(236): Xaa can be any naturally occurring amino acid
  misc_feature (241)..(247): Xaa can be any naturally occurring amino acid
  misc_feature (260)..(266): Xaa can be any naturally occurring amino acid
LLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFIXXXXXXXXXXXXXXXXXXXXXXXXLLSXXXXXXXXXXXEVRKXXXXXXXVRIFSRGTINFVXXXXXXXVKMFDVLKKKN

SEQ ID NO: 38049 - protein, 43 aa, Diabrotica virgifera
  misc_feature: Coding regions on vcDNA: vcDNA=SeqID_17746; Strand=-; Position=0-128
  misc_feature (4)..(41): Xaa can be any naturally occurring amino acid
VSIXXXXXXXXXXXXXXXXXXXXXXXXXXXXXXXXXXXXXXGT

SEQ ID NO: 38050 - protein, 238 aa, Diabrotica virgifera
  misc_feature: Coding regions on vcDNA: vcDNA=SeqID_17747; Strand=+; Position=198-911
  misc_feature: Homolog annotation: Hit_ID=EAA01411.2; Match level="QueryCoverage =83%, HitCoverage=64%, E-value=2e-42, Identity=44%"; Hit description =ENSANGP00000011281 [Anopheles gambiae str. PEST] ref|XP_550784.1| ENSANGP00000011281 [Anopheles gambiae st
  misc_feature: Pfam annotation: Pfam_ID=PA; Match level="Score=66.9, E-value=5.7e -17, Copies=1"; Pfam description=PA domain
MIYNCLLGLVFTALFDKGLAEIYAIKYESQFYHEEFADKPALFGPSLKDIALTGMLIEANRSDGCVPIVPPPNIDNDVGKWIALVRRSSTEYKNCTFEMKVRNAQAAGYNAVIVYNVGSDELIPMGANNSTGIYIPAVFVAEKSGLALLDKYANNPEYFIVVNGDSPFDLPTHLLVPFSIAIGICFIVMVVFMIWKCIKDRRRLRRTRLPKSVSRQIPATQLQKGDLFDTCAHLFGRL

SEQ ID NO: 38051 - protein, 143 aa, Diabrotica virgifera
  misc_feature: Coding regions on vcDNA: vcDNA=SeqID_17748; Strand=+; Position=439-867
  misc_feature (11)..(18): Xaa can be any naturally occurring amino acid
  misc_feature (56)..(133): Xaa can be any naturally occurring amino acid
ITKIIFQGRSXXXXXXXXNFNFSNKNSGLKNFSYFQNNVIHSFSILIIFIFHKFFXXXXXXXXXXXXXXXXXXXXXXXXXXXXXXXXXXXXXXXXXXXXXXXXXXXXXXXXXXXXXXXXXXXXXXXXXXXXXXLIESWNEGVD

SEQ ID NO: 38052 - protein, 268 aa, Diabrotica virgifera
  misc_feature: Coding regions on vcDNA: vcDNA=SeqID_17749; Strand=+; Position=28-831
  misc_feature (5)..(11): Xaa can be any naturally occurring amino acid
  misc_feature (30)..(37): Xaa can be any naturally occurring amino acid
  misc_feature (40)..(49): Xaa can be any naturally occurring amino acid
  misc_feature (52)..(79): Xaa can be any naturally occurring amino acid
  misc_feature (82)..(267): Xaa can be any naturally occurring amino acid
NLSPXXXXXXXLSLTIVNLVSVERNLSLSXXXXXXXXYLXXXXXXXXXXHHXXXXXXXXXXXXXXXXXXXXXXXXXXXXEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXK

SEQ ID NO: 38053 - protein, 151 aa, Diabrotica virgifera
  misc_feature: Coding regions on vcDNA: vcDNA=SeqID_17750; Strand=-; Position=3-455
  misc_feature (4)..(10): Xaa can be any naturally occurring amino acid
  misc_feature (21)..(27): Xaa can be any naturally occurring amino acid
  misc_feature (29)..(40): Xaa can be any naturally occurring amino acid
  misc_feature (53)..(70): Xaa can be any naturally occurring amino acid
  misc_feature (77)..(83): Xaa can be any naturally occurring amino acid
  misc_feature (116)..(124): Xaa can be any naturally occurring amino acid
  misc_feature (130)..(138): Xaa can be any naturally occurring amino acid
ISVXXXXXXXFIEAKNNNRSXXXXXXXKXXXXXXXXXXXXMRLYITLESEAHXXXXXXXXXXXXXXXXXXVNKMELXXXXXXXRDPYIRVSFLYKTKYLKDILYNKNSNIFLVLNXXXXXXXXXSNDIFXXXXXXXXXISFIKMKYCLTII

SEQ ID NO: 38054 - protein, 95 aa, Diabrotica virgifera
  misc_feature: Coding regions on vcDNA: vcDNA=SeqID_17751; Strand=+; Position=42-329
AEGYRYDSERTSSRRAAPPLPRPLQSRIGRANTSWTGIAPRRALRRNGSWSLRRGKFSWKYRKTGVFSVLSLDKIELPSSNGRIHQLINPVIASP

SEQ ID NO: 38055 - protein, 90 aa, Diabrotica virgifera
  misc_feature: Coding regions on vcDNA: vcDNA=SeqID_17752; Strand=+; Position=46-318
  misc_feature (23)..(29): Xaa can be any naturally occurring amino acid
SDDNASLSRRIRQSGAGVDSVQXXXXXXXYIKDVPFLHLFFSLIFVIVHILLAFNLSFYRRCGYKTKYLNLIVIFVKKTLYYNELICTYL

SEQ ID NO: 38056 - protein, 72 aa, Diabrotica virgifera
  misc_feature: Coding regions on vcDNA: vcDNA=SeqID_17753; Strand=-; Position=342-560
  misc_feature (40)..(52): Xaa can be any naturally occurring amino acid
GNQIFACKLFFVRDLLASMSVKSVFAIYEVLGESRPNYKXXXXXXXXXXXXXRWKLKFSIEEFPVFLSIIKT

SEQ ID NO: 38057 - protein, 272 aa, Diabrotica virgifera
  misc_feature: Coding regions on vcDNA: vcDNA=SeqID_17754; Strand=-; Position=1-816
  misc_feature (4)..(271): Xaa can be any naturally occurring amino acid
NQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 38058 - protein, 60 aa, Diabrotica virgifera
  misc_feature: Coding regions on vcDNA: vcDNA=SeqID_17755; Strand=-; Position=521-703
QNGAAIAADQWAGEHLYLIRKAHASNKQEKRMFKKCIYSSYIVFINIHKVDIKIIIVGKQ

SEQ ID NO: 38059 - protein, 45 aa, Diabrotica virgifera
  misc_feature: Coding regions on vcDNA: vcDNA=SeqID_17756; Strand=+; Position=3-137
  misc_feature (4)..(44): Xaa can be any naturally occurring amino acid
MKGXXXXXXXXXXXXXXXXXXXXXXXXXXXXXXXXXXXXXXXXXF

SEQ ID NO: 38060 - protein, 287 aa, Diabrotica virgifera
  misc_feature: Coding regions on vcDNA: vcDNA=SeqID_17757; Strand=+; Position=74-934
  misc_feature (47)..(65): Xaa can be any naturally occurring amino acid
  misc_feature (77)..(287): Xaa can be any naturally occurring amino acid
LISYRRENHLSHPSTKEKSLTSRTSVVSGIYSINQLIIIYLLSNLSXXXXXXXXXXXXXXXXXXXRNRNVIRFSNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38061 - protein, 66 aa, Diabrotica virgifera; identical to SEQ ID NO: 26808
  misc_feature: Coding regions on vcDNA: vcDNA=SeqID_17758; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38062 - protein, 286 aa, Diabrotica virgifera
  misc_feature: Coding regions on vcDNA: vcDNA=SeqID_17759; Strand=+; Position=69-926
  misc_feature (44)..(50): Xaa can be any naturally occurring amino acid
  misc_feature (54)..(64): Xaa can be any naturally occurring amino acid
  misc_feature (68)..(253): Xaa can be any naturally occurring amino acid
  misc_feature (256)..(284): Xaa can be any naturally occurring amino acid
SRTAREILSLSKRKIFTLRTSRIQGSHSISIINHHLNYFRISQXXXXXXXLFIXXXXXXXXXXXSKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLXXXXXXXXXXXXXXXXXXXXXXXXXXXXXII

SEQ ID NO: 38063 - protein, 246 aa, Diabrotica virgifera
  misc_feature: Coding regions on vcDNA: vcDNA=SeqID_17760; Strand=+; Position=18-758
  misc_feature: Homolog annotation: Hit_ID=CAA76931.1; Match level="QueryCoverage =97%, HitCoverage=97%, E-value=2e-66, Identity=50%"; Hit description =endoglucanase [Phaedon cochleariae]
  misc_feature: Pfam annotation: Pfam_ID=Glyco_hydro_45; Match level="Score=273.6, E -value=3.4e-79, Copies=1"; Pfam description=Glycosyl hydrolase family 45
  misc_feature (61)..(66): Xaa can be any naturally occurring amino acid
MKLLVAIAFLGYVAAGSFGRCPGPDIVPIPGGLSGDGITTTYWDCCAQTCAHRQNVKTDNXXXXXXCAIDGTTNITIDQNGIVSGCRVGGQAFACSNQQPYVVSDTLALGWSAASFTGGIDNSKCCSCFLLSFKDQLAGKQMLVQLVNSGTDLASNHFDLQIPGGGVGIWNHGCDAQWGAGENGWGRRYDGVSSLEECCLLPEVLQPGCRFRFQFMEGVYRPNVTFQEVQCPAELIAVTACGNLNY

SEQ ID NO: 38064 - protein, 81 aa, Diabrotica virgifera
  misc_feature: Coding regions on vcDNA: vcDNA=SeqID_17761; Strand=+; Position=291-536
KSKYKFTGFLNIFFLFDQCSFKYFKLIQTTKKYILELKKTMSEARHKYQDNYFAPKFVLEHDCKYDFLLINFYSKADYYDI

SEQ ID NO: 38065 - protein, 51 aa, Diabrotica virgifera
  misc_feature: Coding regions on vcDNA: vcDNA=SeqID_17762; Strand=-; Position=104-259
DIIVFQIDTSSRFKKSFHQQTRWIVSVYHNNLYVYSIYIISTIILLMTFLG

SEQ ID NO: 38066 - protein, 83 aa, Diabrotica virgifera; identical to SEQ ID NO: 28726
  misc_feature: Coding regions on vcDNA: vcDNA=SeqID_17763; Strand=-; Position=2-250
  misc_feature (1)..(17): Xaa can be any naturally occurring amino acid
  misc_feature (20)..(30): Xaa can be any naturally occurring amino acid
  misc_feature (40)..(47): Xaa can be any naturally occurring amino acid
  misc_feature (50)..(63): Xaa can be any naturally occurring amino acid
  misc_feature (69)..(82): Xaa can be any naturally occurring amino acid

SEQ ID NO: 38067 - protein, 44 aa, Diabrotica virgifera
  misc_feature: Coding regions on vcDNA: vcDNA=SeqID_17764; Strand=-; Position=1-132
  misc_feature (3)..(15): Xaa can be any naturally occurring amino acid
  misc_feature (19)..(33): Xaa can be any naturally occurring amino acid
  misc_feature (36)..(42): Xaa can be any naturally occurring amino acid
EVXXXXXXXXXXXXXSLTXXXXXXXXXXXXXXXEKXXXXXXXIN

SEQ ID NO: 38068 - protein, 161 aa, Diabrotica virgifera
  misc_feature: Coding regions on vcDNA: vcDNA=SeqID_17765; Strand=-; Position=123-608
  misc_feature (64)..(70): Xaa can be any naturally occurring amino acid
  misc_feature (98)..(110): Xaa can be any naturally occurring amino acid
  misc_feature (115)..(115): Xaa can be any naturally occurring amino acid
KYEREETESLNLEQETITSCNEYIYLEINLTSTGRNEENIKETIVKGKQVIGAINSVLCQENIXXXXXXXIYNTILKLVLTYGAEVWQLTNKYKDKLXXXXXXXXXXXXXRSRLXHIRNDNIRQQMEIERKIRDDIERQQQGWYGHVRRMDERRITKKVLE

SEQ ID NO: 38069 - protein, 54 aa, Diabrotica virgifera
  misc_feature: Coding regions on vcDNA: vcDNA=SeqID_17766; Strand=-; Position=2-163
  misc_feature (3)..(18): Xaa can be any naturally occurring amino acid
  misc_feature (21)..(35): Xaa can be any naturally occurring amino acid
  misc_feature (41)..(51): Xaa can be any naturally occurring amino acid
NHXXXXXXXXXXXXXXXXLHXXXXXXXXXXXXXXXNLSFLXXXXXXXXXXXKTV

SEQ ID NO: 38070 - protein, 92 aa, Diabrotica virgifera
  misc_feature: Coding regions on vcDNA: vcDNA=SeqID_17767; Strand=-; Position=309-587
RQDLGCPLGYTIDTHIIIECHVARSDDTIFFFVAQCCFTLMHSKAATVVLPFRAYTPTQFHVSFSIQCARKRYRKPVQEILSPGSAEGRLSL

SEQ ID NO: 38071 - protein, 171 aa, Diabrotica virgifera; identical to SEQ ID NO: 27583
  misc_feature: Coding regions on vcDNA: vcDNA=SeqID_17768; Strand=-; Position=4-519
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 38072 - protein, 66 aa, Diabrotica virgifera; identical to SEQ ID NO: 26808
  misc_feature: Coding regions on vcDNA: vcDNA=SeqID_17769; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38073 - protein, 95 aa, Diabrotica virgifera
  misc_feature: Coding regions on vcDNA: vcDNA=SeqID_17770; Strand=-; Position=671-958
  misc_feature: Homolog annotation: Hit_ID=AAF64226.1; Match level="QueryCoverage =98%, HitCoverage=18%, E-value=7e-10, Identity=32%"; Hit description =cystathionine beta-synthase [Oryctolagus cuniculus]
  misc_feature: Pfam annotation: Pfam_ID=CBS; Match level="Score=19.0, E-value=0.015, Copies=1"; Pfam description=CBS domain
IDQTPVGDSAGNMVGMLTLQNLMQGLLRGTIKSNETVERCVVRIYPKVQKTASIGLISRILEKESYVVVLDSKGAVEKPLGIVTAMDLLQYIQQK

SEQ ID NO: 38074 - protein, 248 aa, Diabrotica virgifera
  misc_feature: Coding regions on vcDNA: vcDNA=SeqID_17771; Strand=-; Position=62-808
  misc_feature: Homolog annotation: Hit_ID=AAG36958.1; Match level="QueryCoverage =77%, HitCoverage=38%, E-value=4e-35, Identity=37%"; Hit description =cytochrome P450 [Aedes aegypti]
  misc_feature: Gene Ontology Annotation: Molecular function=cytochrome P450 activity; Cellular component=microsome; Biological process=steroid metabolism
  misc_feature: Pfam annotation: Pfam_ID=p450; Match level="Score=-175.5, E-value =0.0036, Copies=1"; Pfam description=Cytochrome P450
  misc_feature (206)..(212): Xaa can be any naturally occurring amino acid
  misc_feature (240)..(240): Xaa can be any naturally occurring amino acid
MSSRCSLVGKSSFHISGRLSSMAFSNFLISTFLTMSQEGFPSPLDTVLRFLYSPLAFLLYDFALNPDVQTKLREQLTDIYKKNNDQFTYESVNELQYLDACLSESLRVNSVVYMLSKVCTEDYTYTPTNSDYKPLTVNMKVGDVVMVPLLAVQMDPKYFEDPDKYKPERFLDNQVKRYTYFPFGDGPRACLGQRFAQTQIKLGIAXXXXXXXVTLNSKTQLPLKYDPFYILKHPIGGLWXQFYQIIVN

SEQ ID NO: 38075 - protein, 74 aa, Diabrotica virgifera
  misc_feature: Coding regions on vcDNA: vcDNA=SeqID_17772; Strand=-; Position=464-688
  misc_feature (61)..(67): Xaa can be any naturally occurring amino acid
MSRSIVDENVVRDDPSDVMFSDILRSCVRCSCKVSKILIVTLYFHLCYYRGFVFHILVSYXXXXXXXLINYKSK

SEQ ID NO: 38076 - protein, 133 aa, Diabrotica virgifera
  misc_feature: Coding regions on vcDNA: vcDNA=SeqID_17773; Strand=-; Position=2-400
  misc_feature (1)..(10): Xaa can be any naturally occurring amino acid
  misc_feature (26)..(26): Xaa can be any naturally occurring amino acid
  misc_feature (30)..(42): Xaa can be any naturally occurring amino acid
  misc_feature (49)..(61): Xaa can be any naturally occurring amino acid
  misc_feature (64)..(133): Xaa can be any naturally occurring amino acid
XXXXXXXXXXNHLGSHRFNSDHVKFXSRTXXXXXXXXXXXXXIHHRGRXXXXXXXXXXXXXLLXXXXXXXXXXXXXXXXXXXXXXXXXXXXXXXXXXXXXXXXXXXXXXXXXXXXXXXXXXXXXXXXXXXXXX

SEQ ID NO: 38077 - protein, 104 aa, Diabrotica virgifera
  misc_feature: Coding regions on vcDNA: vcDNA=SeqID_17774; Strand=-; Position=3-314
  misc_feature (17)..(46): Xaa can be any naturally occurring amino acid
  misc_feature (56)..(70): Xaa can be any naturally occurring amino acid
  misc_feature (82)..(82): Xaa can be any naturally occurring amino acid
  misc_feature (90)..(96): Xaa can be any naturally occurring amino acid
QLNSTKLLLLTSSLKLXXXXXXXXXXXXXXXXXXXXXXXXXXXXXXKLITFHPNKXXXXXXXXXXXXXXXLNKNPKQQNKKXTQQHTTHXXXXXXXQGKTKTTH

SEQ ID NO: 38078 - protein, 292 aa, Diabrotica virgifera
  misc_feature: Coding regions on vcDNA: vcDNA=SeqID_17775; Strand=+; Position=28-901
  misc_feature: Homolog annotation: Hit_ID=XP_394292.1; Match level="QueryCoverage =71%, HitCoverage=20%, E-value=7e-45, Identity=48%"; Hit description =similar to ENSANGP00000015819 [Apis mellifera]
  misc_feature (134)..(140): Xaa can be any naturally occurring amino acid
  misc_feature (183)..(189): Xaa can be any naturally occurring amino acid
  misc_feature (230)..(240): Xaa can be any naturally occurring amino acid
  misc_feature (267)..(267): Xaa can be any naturally occurring amino acid
  misc_feature (270)..(270): Xaa can be any naturally occurring amino acid
  misc_feature (288)..(288): Xaa can be any naturally occurring amino acid
MLSRNCVILSRHVLNQTVNLYEKNCFHQNAKHRIYLHKLDGKNGWRSISWTKVFFNDQSSDDLKSKNKNLQNKSDKKTKPALEVISPELSAVKKETTVVLENVKEKSLQSENEENPKILSADSIKKLKDKIIGXXXXXXXKAKSPPKKRKRIDLSAQSLERNFITPVKAMSDFLLKPSDLEVXXXXXXXSPYESEPPITVYWRKDVEAKALEIWGTHENLHRELLKRDIXXXXXXXXXXXVKRRLRDFRREMGKSADIIEDDGGLMXRSXGKVVLTAVVINGTNFLFXVCAW

SEQ ID NO: 38079 - protein, 302 aa, Diabrotica virgifera
  misc_feature: Coding regions on vcDNA: vcDNA=SeqID_17776; Strand=+; Position=3-909
  misc_feature: Homolog annotation: Hit_ID=AAT41458.1; Match level="QueryCoverage =98%, HitCoverage=82%, E-value=1e-139, Identity=84%"; Hit description= cytochrome oxidase subunit I [Capsus ater]
  misc_feature: Pfam annotation: Pfam_ID=COX1; Match level="Score=250.2, E-value=3.7e- 72, Copies=1"; Pfam description=Cytochrome C and Quinol oxidase polyp
  misc_feature (16)..(16): Xaa can be any naturally occurring amino acid
  misc_feature (26)..(26): Xaa can be any naturally occurring amino acid
  misc_feature (72)..(72): Xaa can be any naturally occurring amino acid
  misc_feature (94)..(94): Xaa can be any naturally occurring amino acid
  misc_feature (117)..(117): Xaa can be any naturally occurring amino acid
  misc_feature (171)..(171): Xaa can be any naturally occurring amino acid
  misc_feature (177)..(177): Xaa can be any naturally occurring amino acid
  misc_feature (222)..(228): Xaa can be any naturally occurring amino acid
  misc_feature (279)..(279): Xaa can be any naturally occurring amino acid
  misc_feature (287)..(288): Xaa can be any naturally occurring amino acid
TNHKDIGTLYFIFGIXAGILGTSLRXIIRIELGIPGSFIGDDQTYNVVVTAHAFIIIFFIVIPIIIGGFGNXLVPLIIGAPDIAFPRINNIRFXLLPPSITLLIMSRIVENGAGTGXTVYPPLSANISHNGASVDLAIFSLHLAGVRSILGAVNFISTIINIRPIGINAEXIPLFVXSVGITALLLLLSLPVLAGAITILLTDRNFNTSFFDPAGGGDPILXXXXXXXFGHPEVYILILPGFGLISHIVRQERGKNEAFGSLGIIYAIITIGLLGFIVXAHHIFTVXXDVDTRAYFTSATIN

SEQ ID NO: 38080 - protein, 302 aa, Diabrotica virgifera
  misc_feature: Coding regions on vcDNA: vcDNA=SeqID_17777; Strand=+; Position=56-966
  misc_feature: Homolog annotation: Hit_ID=XP_315491.1; Match level="QueryCoverage =85%, HitCoverage=18%, E-value=8e-28, Identity=31%"; Hit description =ENSANGP00000021218 [Anopheles gambiae]
  misc_feature (272)..(272): Xaa can be any naturally occurring amino acid
  misc_feature (281)..(281): Xaa can be any naturally occurring amino acid
  misc_feature (291)..(291): Xaa can be any naturally occurring amino acid
MFFHKNFIVIVFLCIWSLGCGDENILERNRENTAKQHPELSKLVKNWATKLGGELWHFGDLVTRQNRVRDSFKETNLVVEDGEALLQTIHENISHMMKQKVDAVRRIMDQAEQIAQAQKETDIDFNFPFFNAKNLTNSLDNTTEETTKEPEPEELQDDSFISSRYQDQQDQPYSQPLLQQEDFDEYQRDEDTESSEEPSSKDEDLLDADLEVTDNTEKDPQAILNKAPIDKSKLPLIRNRNFYDIPVNMNVSAVHVPSNVYERAKEVIAGIXWSEELDKHXSNYEVDPTLXWQYFGSSTGFL

SEQ ID NO: 38081 - protein, 232 aa, Diabrotica virgifera
  misc_feature: Coding regions on vcDNA: vcDNA=SeqID_17778; Strand=+; Position=3-701
  misc_feature (18)..(18): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(30): Xaa can be any naturally occurring amino acid
  misc_feature (32)..(32): Xaa can be any naturally occurring amino acid
  misc_feature (36)..(36): Xaa can be any naturally occurring amino acid
  misc_feature (47)..(47): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(58): Xaa can be any naturally occurring amino acid
  misc_feature (63)..(64): Xaa can be any naturally occurring amino acid
  misc_feature (66)..(66): Xaa can be any naturally occurring amino acid
  misc_feature (68)..(69): Xaa can be any naturally occurring amino acid
  misc_feature (74)..(74): Xaa can be any naturally occurring amino acid
  misc_feature (77)..(77): Xaa can be any naturally occurring amino acid
  misc_feature (80)..(80): Xaa can be any naturally occurring amino acid
  misc_feature (82)..(83): Xaa can be any naturally occurring amino acid
  misc_feature (86)..(86): Xaa can be any naturally occurring amino acid
  misc_feature (88)..(88): Xaa can be any naturally occurring amino acid
  misc_feature (94)..(94): Xaa can be any naturally occurring amino acid
  misc_feature (97)..(99): Xaa can be any naturally occurring amino acid
  misc_feature (102)..(102): Xaa can be any naturally occurring amino acid
  misc_feature (105)..(106): Xaa can be any naturally occurring amino acid
  misc_feature (110)..(112): Xaa can be any naturally occurring amino acid
  misc_feature (114)..(114): Xaa can be any naturally occurring amino acid
  misc_feature (117)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (129)..(129): Xaa can be any naturally occurring amino acid
  misc_feature (131)..(131): Xaa can be any naturally occurring amino acid
  misc_feature (134)..(136): Xaa can be any naturally occurring amino acid
  misc_feature (138)..(138): Xaa can be any naturally occurring amino acid
  misc_feature (141)..(142): Xaa can be any naturally occurring amino acid
  misc_feature (144)..(144): Xaa can be any naturally occurring amino acid
  misc_feature (150)..(150): Xaa can be any naturally occurring amino acid
  misc_feature (152)..(153): Xaa can be any naturally occurring amino acid
  misc_feature (156)..(156): Xaa can be any naturally occurring amino acid
  misc_feature (158)..(158): Xaa can be any naturally occurring amino acid
  misc_feature (161)..(164): Xaa can be any naturally occurring amino acid
  misc_feature (167)..(167): Xaa can be any naturally occurring amino acid
  misc_feature (169)..(169): Xaa can be any naturally occurring amino acid
  misc_feature (171)..(171): Xaa can be any naturally occurring amino acid
  misc_feature (176)..(176): Xaa can be any naturally occurring amino acid
  misc_feature (178)..(178): Xaa can be any naturally occurring amino acid
  misc_feature (181)..(182): Xaa can be any naturally occurring amino acid
  misc_feature (184)..(184): Xaa can be any naturally occurring amino acid
  misc_feature (188)..(190): Xaa can be any naturally occurring amino acid
  misc_feature (193)..(193): Xaa can be any naturally occurring amino acid
  misc_feature (195)..(195): Xaa can be any naturally occurring amino acid
  misc_feature (198)..(199): Xaa can be any naturally occurring amino acid
  misc_feature (203)..(204): Xaa can be any naturally occurring amino acid
  misc_feature (206)..(210): Xaa can be any naturally occurring amino acid
  misc_feature (214)..(221): Xaa can be any naturally occurring amino acid
  misc_feature (225)..(225): Xaa can be any naturally occurring amino acid
  misc_feature (229)..(229): Xaa can be any naturally occurring amino acid
  misc_feature (231)..(231): Xaa can be any naturally occurring amino acid
SGRKIKKGLSRYLLKNDXGLXDKXIXRIXXIXLDRXLVKIEEGVERXKKEXEXRKXXXIIKKXXEXDXXGIFDXIKXEGXIXXSGXRXIIRNRXVIXXXNKXGGXXFGIXXXGXFIXXXKXKXGGENEXDXLIXXXRXLSXXKXKKVVEXEXXDNXVXSYXXXXVYXGXSXIGGYXEXEVXXGXGNNXXXDNXEXEIXXGYGXXGXXXXXIYSXXXXXXXXGYGXNRNXGXG

SEQ ID NO: 38082 - protein, 78 aa, Diabrotica virgifera
  misc_feature: Coding regions on vcDNA: vcDNA=SeqID_17779; Strand=+; Position=253-486
NIYMIQRHISYVYNSSVFLPIFIYPIYRCTNSILSPDSDLPIPPKSNADPPALPTAAPWRIMSISAEAFLMLNSLYFS

SEQ ID NO: 38083 - protein, 127 aa, Diabrotica virgifera
  misc_feature: Coding regions on vcDNA: vcDNA=SeqID_17780; Strand=+; Position=3-386
  misc_feature (2)..(8): Xaa can be any naturally occurring amino acid
  misc_feature (41)..(49): Xaa can be any naturally occurring amino acid
  misc_feature (100)..(122): Xaa can be any naturally occurring amino acid
NXXXXXXXLHIILMVTIKGVGEKFRLPFLLNALIFSNPEKXXXXXXXXXTQNKRYVTYMRYLQLLLSAESPFRINNKFLLNQMFMIINHTKFSLIFTHLXXXXXXXXXXXXXXXXXXXXXXXVSLKI

SEQ ID NO: 38084 - protein, 100 aa, Diabrotica virgifera
  misc_feature: Coding regions on vcDNA: vcDNA=SeqID_17781; Strand=-; Position=213-515
  misc_feature (23)..(31): Xaa can be any naturally occurring amino acid
  misc_feature (33)..(43): Xaa can be any naturally occurring amino acid
  misc_feature (52)..(60): Xaa can be any naturally occurring amino acid
  misc_feature (62)..(72): Xaa can be any naturally occurring amino acid
  misc_feature (90)..(97): Xaa can be any naturally occurring amino acid
YINLFIKNLSYKSYSNNLSLSLXXXXXXXXXHXXXXXXXXXXXYASHIYLSXXXXXXXXXHXXXXXXXXXXXFSTFYLYTNNNHISTTPXXXXXXXXITI

SEQ ID NO: 38085 - protein, 73 aa, Diabrotica virgifera
  misc_feature: Coding regions on vcDNA: vcDNA=SeqID_17782; Strand=+; Position=402-623
  misc_feature (16)..(27): Xaa can be any naturally occurring amino acid
  misc_feature (39)..(46): Xaa can be any naturally occurring amino acid
  misc_feature (53)..(57): Xaa can be any naturally occurring amino acid
NSIVASRRLKRFKFFXXXXXXXXXXXXTDFFSSNPSFQXXXXXXXXMLPYLAXXXXXIQINQCAQSNENKFTY

SEQ ID NO: 38086 - protein, 32 aa, Diabrotica virgifera
  misc_feature: Coding regions on vcDNA: vcDNA=SeqID_17783; Strand=-; Position=1-96
  misc_feature (5)..(15): Xaa can be any naturally occurring amino acid
  misc_feature (19)..(32): Xaa can be any naturally occurring amino acid
ASNKXXXXXXXXXXXQYRXXXXXXXXXXXXXX

SEQ ID NO: 38087 - protein, 31 aa, Diabrotica virgifera
  misc_feature: Coding regions on vcDNA: vcDNA=SeqID_17784; Strand=-; Position=17-112
  misc_feature (11)..(25): Xaa can be any naturally occurring amino acid
NIQYNVIILLXXXXXXXXXXXXXXXYHQIKI

SEQ ID NO: 38088 - protein, 306 aa, Diabrotica virgifera
  misc_feature: Coding regions on vcDNA: vcDNA=SeqID_17785; Strand=-; Position=0-917
  misc_feature (1)..(292): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 38089 - protein, 53 aa, Diabrotica virgifera
  misc_feature: Coding regions on vcDNA: vcDNA=SeqID_17786; Strand=-; Position=3-161
FITRGVVIRSIPYERPISRVCVIFVSFASSATYGISVYKVSLKRGLLPFFPSF

SEQ ID NO: 38090 - protein, 265 aa, Diabrotica virgifera
  misc_feature: Coding regions on vcDNA: vcDNA=SeqID_17787; Strand=-; Position=2-796
  misc_feature (1)..(12): Xaa can be any naturally occurring amino acid
  misc_feature (16)..(264): Xaa can be any naturally occurring amino acid
XXXXXXXXXXXXSRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 38091 - protein, 48 aa, Diabrotica virgifera
  misc_feature: Coding regions on vcDNA: vcDNA=SeqID_17788; Strand=-; Position=1-144
  misc_feature (1)..(13): Xaa can be any naturally occurring amino acid
  misc_feature (16)..(48): Xaa can be any naturally occurring amino acid
XXXXXXXXXXXXXLLXXXXXXXXXXXXXXXXXXXXXXXXXXXXXXXXX

SEQ ID NO: 38092 - protein, 252 aa, Diabrotica virgifera
  misc_feature: Coding regions on vcDNA: vcDNA=SeqID_17789; Strand=+; Position=104-863
  misc_feature: Homolog annotation: Hit_ID=XP_395179.1; Match level="QueryCoverage =97%, HitCoverage=16%, E-value=1e-109, Identity=80%"; Hit description= similar to DEAD/H (Asp-Glu-Ala-Asp/His) box polypeptide 26; RNA helicase HDB;
  misc_feature: Pfam annotation: Pfam_ID=VWA; Match level="Score=-20.3, E-value=0.07, Copies=1"; Pfam description=von Willebrand factor type A domain
  misc_feature (97)..(105): Xaa can be any naturally occurring amino acid
  misc_feature (230)..(231): Xaa can be any naturally occurring amino acid
MTIIVFLIDTSASMLQRTYIGGRTTLLDVAKSAVETFVKIRQRSMDSRNDRYMLLTFEDTPTNIKAGWKENLATFMNELKNLQAYSLTTMGLAVKQXXXXXXXXXMTSGIDTYGQGRCPFYLETAVIVLITDGGKLTTVNGVQEEFNLPMNSPIPGSEMTREPFRWDQRLFALVLRLTGTPAVERDTGLVPSDSSPIDAMCEVTGGRSYCITSHRMLNQCIDSLVQKVQXXVVINFEKIGPDPPPPQYDKED

SEQ ID NO: 38093 - protein, 27 aa, Diabrotica virgifera
  misc_feature: Coding regions on vcDNA: vcDNA=SeqID_17790; Strand=-; Position=0-80
  misc_feature (1)..(26): Xaa can be any naturally occurring amino acid
XXXXXXXXXXXXXXXXXXXXXXXXXXT

SEQ ID NO: 38094 - protein, 194 aa, Diabrotica virgifera
  misc_feature: Coding regions on vcDNA: vcDNA=SeqID_17791; Strand=+; Position=251-835
  misc_feature: Homolog annotation: Hit_ID=EAA46790.1; Match level="QueryCoverage =80%, HitCoverage=52%, E-value=2e-10, Identity=32%"; Hit description =hypothetical protein MG10484.4 [Magnaporthe grisea 70-15] ref|XP _366265.1| hypothetical protein MG10484.4
MSWMKRRGPSTPSPAPAPAVPMYNPNQHSATQETQWQNQPVQNNWYQGQQHAQYQPVPKQENTNPPQQNYWQQQQHNPLSYNQNSQYNQHQYQNQQHTGYVQNNSGYEQQHYSNVQYSQLNNQNNVYGTGTQSGQQQTGEDPWNWSWGDEDNSNVQPTPQATITPNQTGGQTDSFGNLDTWKWPAQEAEKSCQE

SEQ ID NO: 38095 - protein, 267 aa, Diabrotica virgifera
  misc_feature: Coding regions on vcDNA: vcDNA=SeqID_17792; Strand=+; Position=22-822
  misc_feature: Homolog annotation: Hit_ID=AAF87760.1; Match level="QueryCoverage =99%, HitCoverage=60%, E-value=4e-98, Identity=72%"; Hit description =cytochrome oxidase subunit I [Diabrotica virgifera zeae]
  misc_feature: Pfam annotation: Pfam_ID=COX1; Match level="Score=-99.3, E-value=7.3e- 08, Copies=1"; Pfam description=Cytochrome C and Quinol oxidase polyp
  misc_feature (1)..(1): Xaa can be any naturally occurring amino acid
  misc_feature (12)..(19): Xaa can be any naturally occurring amino acid
  misc_feature (40)..(40): Xaa can be any naturally occurring amino acid
  misc_feature (75)..(75): Xaa can be any naturally occurring amino acid
  misc_feature (92)..(92): Xaa can be any naturally occurring amino acid
  misc_feature (95)..(101): Xaa can be any naturally occurring amino acid
  misc_feature (128)..(134): Xaa can be any naturally occurring amino acid
  misc_feature (148)..(148): Xaa can be any naturally occurring amino acid
  misc_feature (156)..(172): Xaa can be any naturally occurring amino acid
  misc_feature (202)..(202): Xaa can be any naturally occurring amino acid
  misc_feature (216)..(216): Xaa can be any naturally occurring amino acid
  misc_feature (218)..(225): Xaa can be any naturally occurring amino acid
  misc_feature (246)..(246): Xaa can be any naturally occurring amino acid
  misc_feature (259)..(259): Xaa can be any naturally occurring amino acid
  misc_feature (267)..(267): Xaa can be any naturally occurring amino acid
XGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIXVXXXXXXXXEAFSFQRKRLRPLRITSSIEXLQFNPPAEHRYSXLPILSSNX

SEQ ID NO: 38096 - protein, 50 aa, Diabrotica virgifera
  misc_feature: Coding regions on vcDNA: vcDNA=SeqID_17793; Strand=-; Position=303-455
MILRILVFEMSMERNTKVYIEGDNLTEGNLTLPKDVVITLSSDEDLRPVS

SEQ ID NO: 38097 - protein, 45 aa, Diabrotica virgifera
  misc_feature: Coding regions on vcDNA: vcDNA=SeqID_17794; Strand=-; Position=1-135
  misc_feature (1)..(8): Xaa can be any naturally occurring amino acid
  misc_feature (10)..(18): Xaa can be any naturally occurring amino acid
  misc_feature (25)..(25): Xaa can be any naturally occurring amino acid
  misc_feature (29)..(29): Xaa can be any naturally occurring amino acid
  misc_feature (31)..(43): Xaa can be any naturally occurring amino acid
XXXXXXXXDXXXXXXXXXPIINFNXNIEXRXXXXXXXXXXXXXLL

SEQ ID NO: 38098 - protein, 96 aa, Diabrotica virgifera
  misc_feature: Coding regions on vcDNA: vcDNA=SeqID_17795; Strand=+; Position=71-361
  misc_feature: Homolog annotation: Hit_ID=AAR09775.1; Match level="QueryCoverage =93%, HitCoverage=47%, E-value=2e-43, Identity=91%"; Hit description =similar to Drosophila melanogaster Ef1gamma [Drosophila yakuba]
  misc_feature: Gene Ontology Annotation: Molecular function=translation elongation factor activity; Cellular component=intracellular; Biological process=translational elongation
  misc_feature: Pfam annotation: Pfam_ID=EF1G; Match level="Score=-14.4, E-value =0.00029, Copies=1"; Pfam description=Elongation factor 1 gamma, conserved
SNTSHGQVLDKMRKQAFASVCLFGEDNNSTISGIWVWRGQELAFTLSPDWQIDYESYEWKKLDAKSEETKKLVEQYFSWTGTDKQGRKFNQGKIFK

SEQ ID NO: 38099 - protein, 68 aa, Diabrotica virgifera
  misc_feature: Coding regions on vcDNA: vcDNA=SeqID_17796; Strand=-; Position=595-801
  misc_feature (10)..(10): Xaa can be any naturally occurring amino acid
NYVPNVMLLXYTFISMISISFCFTMYCVFHLVRCFVGYWRAHHCIVPTYNSDITYIFAIQFNDCRLLQ

SEQ ID NO: 38100 - protein, 95 aa, Diabrotica virgifera
  misc_feature: Coding regions on vcDNA: vcDNA=SeqID_17797; Strand=+; Position=590-877
  misc_feature (39)..(39): Xaa can be any naturally occurring amino acid
  misc_feature (42)..(42): Xaa can be any naturally occurring amino acid
  misc_feature (83)..(83): Xaa can be any naturally occurring amino acid
  misc_feature (85)..(85): Xaa can be any naturally occurring amino acid
LFSRFFRNRNKFLEFTGIFMKRYSYVYRARQKGVAVHLXIFXFLDEAKNLSSFEPFHASAEIASPIIMQELRVQAPRSLPSAXSXVDYRSIFCLD

SEQ ID NO: 38101 - protein, 35 aa, Diabrotica virgifera
  misc_feature: Coding regions on vcDNA: vcDNA=SeqID_17798; Strand=-; Position=1-105
  misc_feature (7)..(22): Xaa can be any naturally occurring amino acid
  misc_feature (25)..(25): Xaa can be any naturally occurring amino acid
  misc_feature (31)..(35): Xaa can be any naturally occurring amino acid
MNYDIMXXXXXXXXXXXXXXXXLVXKKIKLXXXXX

SEQ ID NO: 38102 - protein, 236 aa, Diabrotica virgifera
  misc_feature: Coding regions on vcDNA: vcDNA=SeqID_17799; Strand=-; Position=17-727
  misc_feature (4)..(11): Xaa can be any naturally occurring amino acid
  misc_feature (23)..(31): Xaa can be any naturally occurring amino acid
  misc_feature (33)..(39): Xaa can be any naturally occurring amino acid
  misc_feature (52)..(65): Xaa can be any naturally occurring amino acid
  misc_feature (70)..(236): Xaa can be any naturally occurring amino acid
LSFXXXXXXXXIETNLPHTGLNXXXXXXXXXTXXXXXXXPPIITFNPPWSSXXXXXXXXXXXXXXVILKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38103 - protein, 51 aa, Diabrotica virgifera
  misc_feature: Coding regions on vcDNA: vcDNA=SeqID_17800; Strand=-; Position=1-153
  misc_feature (1)..(51): Xaa can be any naturally occurring amino acid
XXXXXXXXXXXXXXXXXXXXXXXXXXXXXXXXXXXXXXXXXXXXXXXXXXX

SEQ ID NO: 38104 - protein, 24 aa, Diabrotica virgifera
  misc_feature: Coding regions on vcDNA: vcDNA=SeqID_17801; Strand=-; Position=2-73
EYVVVFFSGNCEEDQECDNILKEL

SEQ ID NO: 38105 - protein, 92 aa, Diabrotica virgifera
  misc_feature: Coding regions on vcDNA: vcDNA=SeqID_17802; Strand=+; Position=1-279
  misc_feature (12)..(24): Xaa can be any naturally occurring amino acid
  misc_feature (38)..(44): Xaa can be any naturally occurring amino acid
  misc_feature (46)..(54): Xaa can be any naturally occurring amino acid
  misc_feature (66)..(74): Xaa can be any naturally occurring amino acid
  misc_feature (76)..(88): Xaa can be any naturally occurring amino acid
DYKNKLPYHITXXXXXXXXXXXXXCDLDVALKFIIAVXXXXXXXFXXXXXXXXXFKPPRASMYSIXXXXXXXXXKXXXXXXXXXXXXXIQKI

SEQ ID NO: 38106 - protein, 24 aa, Diabrotica virgifera
  misc_feature: Coding regions on vcDNA: vcDNA=SeqID_17803; Strand=+; Position=1-72
  misc_feature (10)..(10): Xaa can be any naturally occurring amino acid
  misc_feature (14)..(14): Xaa can be any naturally occurring amino acid
RIITLGITAXFYWXSQIDNKDCDL

SEQ ID NO: 38107 - protein, 86 aa, Diabrotica virgifera
  misc_feature: Coding regions on vcDNA: vcDNA=SeqID_17804; Strand=+; Position=3-263
YIQMEKSNKDSNAPPERTGRADAPIIIIILDPNKADDDDSEENMTNTENLTDDEVNRRGPPLDLLLSLTNKPFAFPPTINMIKSVF

SEQ ID NO: 38108 - protein, 79 aa, Diabrotica virgifera
  misc_feature: Coding regions on vcDNA: vcDNA=SeqID_17805; Strand=-; Position=2-238
  misc_feature (5)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
ILSNXXXXXXXXXPFXXXXXXXXXXXTNLAHTGLNXXXXXXXXSNXXXXXXXXXXXXXXPTSRSXXXXXXXXXXXXXXV

SEQ ID NO: 38109 - protein, 149 aa, Diabrotica virgifera
  misc_feature: Coding regions on vcDNA: vcDNA=SeqID_17806; Strand=-; Position=2-448
DQCTSKQRKNNHSITTPENVEIVRVMFEKDNFTRKKPEVRNYWWNDQLEEMKKHKQEVYHKWLNDRENENKTSEYRQARDKFKTEVINAKNQKWEDKCQDTYIGGRKSREAWRFIKKVRTSKIEETVINPITTTKWEEHYKSLLVENRP

SEQ ID NO: 38110 - protein, 39 aa, Diabrotica virgifera
  misc_feature: Coding regions on vcDNA: vcDNA=SeqID_17807; Strand=+; Position=3-122
HRNQSVDTCLKFPRICSHFRAITILIMLRYKTVKSTVSY

SEQ ID NO: 38111 - protein, 110 aa, Diabrotica virgifera
  misc_feature: Coding regions on vcDNA: vcDNA=SeqID_17808; Strand=+; Position=2-334
  misc_feature (1)..(29): Xaa can be any naturally occurring amino acid
  misc_feature (32)..(51): Xaa can be any naturally occurring amino acid
  misc_feature (57)..(62): Xaa can be any naturally occurring amino acid
  misc_feature (64)..(71): Xaa can be any naturally occurring amino acid
  misc_feature (88)..(107): Xaa can be any naturally occurring amino acid
XXXXXXXXXXXXXXXXXXXXXXXXXXXXXASXXXXXXXXXXXXXXXXXXXXHILIAXXXXXXLXXXXXXXXLLHISNFLTNKLTLFIXXXXXXXXXXXXXXXXXXXXAHY

SEQ ID NO: 38112 - protein, 91 aa, Diabrotica virgifera
  misc_feature: Coding regions on vcDNA: vcDNA=SeqID_17809; Strand=-; Position=189-464
CSNPPTFDTSSDNSMYVHNRTIFRRRGPYLSRPLSTSRTATRRSSALSQSFSSPLANRLVNAEYVIYDLLCHDMIRDTSSSACSTIVSGLL

SEQ ID NO: 38113 - protein, 66 aa, Diabrotica virgifera; identical to SEQ ID NO: 26808
  misc_feature: Coding regions on vcDNA: vcDNA=SeqID_17810; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38114 - protein, 180 aa, Diabrotica virgifera
  misc_feature: Coding regions on vcDNA: vcDNA=SeqID_17811; Strand=+; Position=2-544
ALSNNFNKLVVEFEAAIANTLPLVKEFFPDPSAYDVIVYKLSNYTDQVTAYFNQNTENLKAALDSIPKPDLPITSQASIGALIPSFVEVFNYLSQVIIQVVQKAPPVPNFFSVLLSVFFDFVKSLTNFPKLLASDVFSGAGAFGDLLEIIGKKIIPSIVPGFNISAIVSGIPDIVPSWKL

SEQ ID NO: 38115 - protein, 138 aa, Diabrotica virgifera
  misc_feature: Coding regions on vcDNA: vcDNA=SeqID_17812; Strand=+; Position=392-808
  misc_feature (6)..(13): Xaa can be any naturally occurring amino acid
  misc_feature (15)..(27): Xaa can be any naturally occurring amino acid
  misc_feature (134)..(134): Xaa can be any naturally occurring amino acid
SNNYKXXXXXXXXKXXXXXXXXXXXXXVNGLKVFFSLTHLLFISMLLYLFVFFAVNCFIFYFHCSFFLLVFYLSIIHNQLSSSVSFGDSFDHYCHLSLSTIFIFVFFAIDCFIYYLDCLFLLLQAFFDVSIIHXVIIN

SEQ ID NO: 38116 - protein, 66 aa, Diabrotica virgifera; identical to SEQ ID NO: 36529
  misc_feature: Coding regions on vcDNA: vcDNA=SeqID_17813; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38117 - protein, 112 aa, Diabrotica virgifera
  misc_feature: Coding regions on vcDNA: vcDNA=SeqID_17814; Strand=+; Position=437-774
  misc_feature: Homolog annotation: Hit_ID=YP_054488.1; Match level="QueryCoverage =100%, HitCoverage=42%, E-value=5e-21, Identity=47%"; Hit description= cytochrome c oxidase subunit III [Periplaneta fuliginosa] dbj|BAD32634.1| cytochrome c oxidase
  misc_feature: Pfam annotation: Pfam_ID=COX3; Match level="Score=-211.8, E-value =0.014, Copies=1"; Pfam description=Cytochrome c oxidase subunit III
  misc_feature (33)..(33): Xaa can be any naturally occurring amino acid
  misc_feature (73)..(73): Xaa can be any naturally occurring amino acid
  misc_feature (89)..(89): Xaa can be any naturally occurring amino acid
  misc_feature (95)..(95): Xaa can be any naturally occurring amino acid
  misc_feature (97)..(97): Xaa can be any naturally occurring amino acid
AHHNLLYNNFSQALLDINFYRNITLFILLFYTXYDYIESPFGNSDSLYESSFFIAAHSHGLHDIIVATVLLPXSIQHDLYHCSSTHHFXFSLICXYXHYVHEASLFLYISIY

SEQ ID NO: 38118 - protein, 35 aa, Diabrotica virgifera
  misc_feature: Coding regions on vcDNA: vcDNA=SeqID_17815; Strand=-; Position=3-107
  misc_feature (3)..(10): Xaa can be any naturally occurring amino acid
STXXXXXXXXPIINLIHHRGRNLYYRFDSPIKLRC

SEQ ID NO: 38119 - protein, 279 aa, Diabrotica virgifera
  misc_feature: Coding regions on vcDNA: vcDNA=SeqID_17816; Strand=-; Position=1-837
  misc_feature (3)..(3): Xaa can be any naturally occurring amino acid
  misc_feature (7)..(25): Xaa can be any naturally occurring amino acid
  misc_feature (27)..(43): Xaa can be any naturally occurring amino acid
  misc_feature (45)..(108): Xaa can be any naturally occurring amino acid
  misc_feature (110)..(277): Xaa can be any naturally occurring amino acid
HPXLHPXXXXXXXXXXXXXXXXXXXPXXXXXXXXXXXXXXXXXCXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEV

SEQ ID NO: 38120 - protein, 214 aa, Diabrotica virgifera
  misc_feature: Coding regions on vcDNA: vcDNA=SeqID_17817; Strand=+; Position=3-644
  misc_feature: Homolog annotation: Hit_ID=XP_314919.1; Match level="QueryCoverage =80%, HitCoverage=19%, E-value=2e-20, Identity=37%"; Hit description =ENSANGP00000001113 [Anopheles gambiae]
EEKKDKDKSESDIFNLVKTPSIDKLGRIPKKSNSASVDSKPKDDRDANEVKKKSFSVGIKKDATPEERPKTVKVFNSKMRSTGLEEEVKPAPSRVAVKKPTTLATLPPIPLKRSSPPRDIREPSIPPEKKIKMDKVDIPDRPGAIKLIPPKPKPILQESDLFSDALTAATSKKEPKKRRRRLSSSKETPTSPTTSPQEDPLLSPSTAAPPSAPA

SEQ ID NO: 38121 - protein, 222 aa, Diabrotica virgifera
  misc_feature: Coding regions on vcDNA: vcDNA=SeqID_17818; Strand=+; Position=3-737
  misc_feature: Homolog annotation: Hit_ID=AAL67868.1; Match level="QueryCoverage =99%, HitCoverage=42%, E-value=2e-47, Identity=48%"; Hit description =NADH dehydrogenase subunit 5 [Crioceris duodecimpunctata] ref|NP _569067.1| NADH dehydrogenase subunit 5
  misc_feature: Pfam annotation: Pfam_ID=Oxidored_q1; Match level="Score=-114.0, E -value=0.082, Copies=1"; Pfam description=NADH -Ubiquinone/plastoquinone (comple
  misc_feature (9)..(9): Xaa can be any naturally occurring amino acid
  misc_feature (30)..(30): Xaa can be any naturally occurring amino acid
  misc_feature (52)..(52): Xaa can be any naturally occurring amino acid
  misc_feature (66)..(66): Xaa can be any naturally occurring amino acid
  misc_feature (70)..(70): Xaa can be any naturally occurring amino acid
  misc_feature (113)..(113): Xaa can be any naturally occurring amino acid
  misc_feature (135)..(135): Xaa can be any naturally occurring amino acid
  misc_feature (159)..(159): Xaa can be any naturally occurring amino acid
  misc_feature (177)..(183): Xaa can be any naturally occurring amino acid
FLFVILLDXSSFIFLGCGLFIASIVSYYSXEHMRGDLFKTRFILLAGYWFFXLIIVVISPNLISIXLIGXDASALASYWLASYYQNITRFNAVILAALSNRTGAGALLIGIAXYINFLDILPAITRSARIPFSSXVPAAIAAPTAGSSLRHSSTLITAXVYLLIRLRFSLRDGIRIXXXXXXXIAIFMSVLEADSEFDVIPIIVLSTLSALGLIIRTLSLGE

SEQ ID NO: 38122 - protein, 179 aa, Diabrotica virgifera
  misc_feature: Coding regions on vcDNA: vcDNA=SeqID_17819; Strand=+; Position=307-846
  misc_feature: Homolog annotation: Hit_ID=XP_313815.1; Match level="QueryCoverage =80%, HitCoverage=77%, E-value=2e-10, Identity=29%"; Hit description =ENSANGP00000012292 [Anopheles gambiae]
  misc_feature: Pfam annotation: Pfam_ID=FHA; Match level="Score=17.5, E-value=0.042, Copies=1"; Pfam description=FHA domain
YYFHHEASVISAFPEGEHSIGRDKLNCRDKRISRNHALITITNSSITLHSTHVNPSFYKPHGGNSIRLVKKDESVTINDGDQFAFLADAYWFKTRIEQDEINLASNSNKRIHEESEIHNKKKAKVDNVIKNSEESRKLAVSDTIDKPENKDSDSEGSIDFATSLQNDDDIPMKRIQRCY

SEQ ID NO: 38123 - protein, 288 aa, Diabrotica virgifera
  misc_feature: Coding regions on vcDNA: vcDNA=SeqID_17820; Strand=-; Position=3-866
  misc_feature (4)..(4): Xaa can be any naturally occurring amino acid
  misc_feature (6)..(6): Xaa can be any naturally occurring amino acid
  misc_feature (9)..(288): Xaa can be any naturally occurring amino acid
SLNXFXNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38124 - protein, 84 aa, Diabrotica virgifera
  misc_feature: Coding regions on vcDNA: vcDNA=SeqID_17821; Strand=+; Position=146-400
QENEKTRWTVRYGNLILIQQRRKTFPINNTKKKTTHCKGKKVLNDLYGNEKVSTPSTKTAVLIKKNNIDLLNEPLIQLLGIIYI

SEQ ID NO: 38125 - protein, 258 aa, Diabrotica virgifera
  misc_feature: Coding regions on vcDNA: vcDNA=SeqID_17822; Strand=+; Position=126-900
  misc_feature: Homolog annotation: Hit_ID=AAK52058.1; Match level="QueryCoverage =95%, HitCoverage=23%, E-value=4e-35, Identity=32%"; Hit description =RNA-directed DNA polymerase [Drosophila melanogaster]
  misc_feature: Pfam annotation: Pfam_ID=RVT_1; Match level="Score=64.3, E-value=3.4e- 16, Copies=1"; Pfam description=Reverse transcriptase (RNA-dependent
  misc_feature (51)..(51): Xaa can be any naturally occurring amino acid
  misc_feature (194)..(194): Xaa can be any naturally occurring amino acid
  misc_feature (239)..(239): Xaa can be any naturally occurring amino acid
  misc_feature (241)..(241): Xaa can be any naturally occurring amino acid
  misc_feature (244)..(244): Xaa can be any naturally occurring amino acid
  misc_feature (255)..(255): Xaa can be any naturally occurring amino acid
NLKIIVFLVAKPPRRVPLAIKKRLENTLLDLEKRGIISKCEGPTRVVEQFXVIVEKPDKTLRICLDPKDLNQALEKEYCLIPTIEEICNKLKNKCYFSVLDFKEGFYQVQLDEESSRVCAFGTPFGIWKFDRLPFGLNIAPEFFQRINLENFGDIEGCLIYFDDLLIFADSLKEHDRILNEVLERARNIGGKIXLIRYNIEWSEVKYLGNTFDKNGMRPDLDKIKAIINLKEPNNKKEXKXYWXMINNHRSFIPXLSD

SEQ ID NO: 38126 - protein, 54 aa, Diabrotica virgifera
  misc_feature: Coding regions on vcDNA: vcDNA=SeqID_17823; Strand=+; Position=2-163
VVNFSGAAMHQPPLSTTVVKSEVKSEYVEEDAELPQTNIIEIERTDEENGEVQT

SEQ ID NO: 38127 - protein, 76 aa, Diabrotica virgifera
  misc_feature: Coding regions on vcDNA: vcDNA=SeqID_17824; Strand=-; Position=1-228
  misc_feature (1)..(9): Xaa can be any naturally occurring amino acid
  misc_feature (14)..(73): Xaa can be any naturally occurring amino acid
XXXXXXXXXSSLNXXXXXXXXXXXXXXXXXXXXXXXXXXXXXXXXXXXXXXXXXXXXXXXXXXXXXXXXXXXXTSS

SEQ ID NO: 38128 - protein, 73 aa, Diabrotica virgifera
  misc_feature: Coding regions on vcDNA: vcDNA=SeqID_17825; Strand=+; Position=624-842
NIIASYPTLNFSTLLYYIQHTRFLLPYSMLLRCDSHIRVLRPSRHIEPYLPRASIHLLYDIKYVLMSASLLIY

SEQ ID NO: 38129 - protein, 62 aa, Diabrotica virgifera
  misc_feature: Coding regions on vcDNA: vcDNA=SeqID_17826; Strand=-; Position=1-186
  misc_feature (40)..(45): Xaa can be any naturally occurring amino acid
TLNPYIRLSIWSSFVVINCWFVSSSMHCTDGRANLYMIGXXXXXXAPEQTKKCCTANLSKKN

SEQ ID NO: 38130 - protein, 258 aa, Diabrotica virgifera
  misc_feature: Coding regions on vcDNA: vcDNA=SeqID_17827; Strand=-; Position=1-774
  misc_feature (1)..(28): Xaa can be any naturally occurring amino acid
  misc_feature (30)..(49): Xaa can be any naturally occurring amino acid
  misc_feature (54)..(73): Xaa can be any naturally occurring amino acid
  misc_feature (77)..(92): Xaa can be any naturally occurring amino acid
  misc_feature (95)..(215): Xaa can be any naturally occurring amino acid
  misc_feature (220)..(256): Xaa can be any naturally occurring amino acid
XXXXXXXXXXXXXXXXXXXXXXXXXXXXAXXXXXXXXXXXXXXXXXXXXPSIPXXXXXXXXXXXXXXXXXXXXQFIXXXXXXXXXXXXXXXXNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISLXXXXXXXXXXXXXXXXXXXXXXXXXXXXXXXXXXXXXEV

SEQ ID NO: 38131 - protein, 191 aa, Diabrotica virgifera
  misc_feature: Coding regions on vcDNA: vcDNA=SeqID_17828; Strand=+; Position=145-720
  misc_feature: Homolog annotation: Hit_ID=XP_314051.1; Match level="QueryCoverage =98%, HitCoverage=97%, E-value=4e-87, Identity=84%"; Hit description =ENSANGP00000015684 [Anopheles gambiae] gb|EAA44533.2| ENSANGP00000024640 [Anopheles gambiae
  misc_feature: Gene Ontology Annotation: Molecular function=ATP binding; Cellular component=cytosol; Biological process=cell-matrix adhesion
  misc_feature: Pfam annotation: Pfam_ID=Ras; Match level="Score=238.7, E-value=1.1e -68, Copies=1"; Pfam description=Ras family
  misc_feature (16)..(25): Xaa can be any naturally occurring amino acid
  misc_feature (180)..(186): Xaa can be any naturally occurring amino acid
GGLRKRSDGVGDGACXXXXXXXXXXKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAFAYLECSAKSKEGVREVFENATRAALQXXXXXXXRCVMF

SEQ ID NO: 38132 - protein, 19 aa, Diabrotica virgifera
  misc_feature: Coding regions on vcDNA: vcDNA=SeqID_17829; Strand=-; Position=1-57
  misc_feature (4)..(10): Xaa can be any naturally occurring amino acid
  misc_feature (13)..(13): Xaa can be any naturally occurring amino acid
KLIXXXXXXXQTXLHISIS

SEQ ID NO: 38133 - protein, 248 aa, Diabrotica virgifera
  misc_feature: Coding regions on vcDNA: vcDNA=SeqID_17830; Strand=-; Position=0-743
  misc_feature (8)..(77): Xaa can be any naturally occurring amino acid
  misc_feature (93)..(247): Xaa can be any naturally occurring amino acid
RQFLSHPXXXXXXXXXXXXXXXXXXXXXXXXXXXXXXXXXXXXXXXXXXXXXXXXXXXXXXXXXXXXXXXXXXXXXXATYGSSLLNVNNVNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 38134 - protein, 192 aa, Diabrotica virgifera
  misc_feature: Coding regions on vcDNA: vcDNA=SeqID_17831; Strand=-; Position=145-723
  misc_feature (1)..(12): Xaa can be any naturally occurring amino acid
  misc_feature (20)..(26): Xaa can be any naturally occurring amino acid
  misc_feature (35)..(75): Xaa can be any naturally occurring amino acid
  misc_feature (79)..(92): Xaa can be any naturally occurring amino acid
  misc_feature (96)..(155): Xaa can be any naturally occurring amino acid
  misc_feature (160)..(169): Xaa can be any naturally occurring amino acid
  misc_feature (171)..(183): Xaa can be any naturally occurring amino acid
XXXXXXXXXXXXVQINRWAXXXXXXXQKDVFLITXXXXXXXXXXXXXXXXXXXXXXXXXXXXXXXXXXXXXXXXXKNLXXXXXXXXXXXXXXYFKXXXXXXXXXXXXXXXXXXXXXXXXXXXXXXXXXXXXXXXXXXXXXXXXXXXXXXXXXXXXPFRFXXXXXXXXXXEXXXXXXXXXXXXXRDEMMRIIN

SEQ ID NO: 38135 - protein, 233 aa, Diabrotica virgifera
  misc_feature: Coding regions on vcDNA: vcDNA=SeqID_17832; Strand=+; Position=190-890
  misc_feature: Homolog annotation: Hit_ID=XP_319591.1; Match level="QueryCoverage =98%, HitCoverage=64%, E-value=3e-84, Identity=67%"; Hit description =ENSANGP00000016770 [Anopheles gambiae]
  misc_feature: Gene Ontology Annotation: Molecular function=electron transporter activity; Cellular component=cellular_component unknown; Biological process=brain development
  misc_feature: Pfam annotation: Pfam_ID=2-Hacid_dh_C; Match level="Score=136.3, E -value=7.1e-38, Copies=1"; Pfam description=D-isomer specific 2 -hydroxyacid dehyd
  misc_feature (116)..(123): Xaa can be any naturally occurring amino acid
  misc_feature (218)..(218): Xaa can be any naturally occurring amino acid
LCTPGGNAISACELTCSLITTLARNVVPAAASLKAGRWDRKLYSGHELYGKTLGILGLGRIGKEVAIRMQAWGMTTIGYDPIVPASEAKKFNVEALELEQIWPRVDYITVHTPLIXXXXXXXXEAVLNKCKKGVKIVNVARGGIINESDLLKALKSGQCGGAALDVFEQEPPKDPVTLDLIQHEKVVATPHLGASTDEAQVRVAVEISEQIIALTGRXVRYTSTPGVVNRKRL

SEQ ID NO: 38136 - protein, 43 aa, Diabrotica virgifera
  misc_feature: Coding regions on vcDNA: vcDNA=SeqID_17833; Strand=-; Position=174-305
GIIMVSEFSYYNSRSCCNTCTIITTIPFTDNLLPILISIAFCS

SEQ ID NO: 38137 - protein, 56 aa, Diabrotica virgifera
  misc_feature: Coding regions on vcDNA: vcDNA=SeqID_17834; Strand=-; Position=255-425
IGYFSMLGGKDVKQKTNKILKELLTDELASCYSYFGKRDKQPLVKTKLKDLLFSKY

SEQ ID NO: 38138 - protein, 260 aa, Diabrotica virgifera
  misc_feature: Coding regions on vcDNA: vcDNA=SeqID_17835; Strand=-; Position=1-783
  misc_feature (12)..(24): Xaa can be any naturally occurring amino acid
  misc_feature (27)..(37): Xaa can be any naturally occurring amino acid
  misc_feature (47)..(54): Xaa can be any naturally occurring amino acid
  misc_feature (57)..(70): Xaa can be any naturally occurring amino acid
  misc_feature (76)..(89): Xaa can be any naturally occurring amino acid
  misc_feature (91)..(260): Xaa can be any naturally occurring amino acid
GLLHYIDISIIXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38139 - protein, 92 aa, Diabrotica virgifera
  misc_feature: Coding regions on vcDNA: vcDNA=SeqID_17836; Strand=-; Position=0-275
  misc_feature (10)..(79): Xaa can be any naturally occurring amino acid
  misc_feature (82)..(88): Xaa can be any naturally occurring amino acid
YYINEFNTEXXXXXXXXXXXXXXXXXXXXXXXXXXXXXXXXXXXXXXXXXXXXXXXXXXXXXXXXXXXXXXXXXXXXXXVGXXXXXXXPKRR

SEQ ID NO: 38140 - protein, 74 aa, Diabrotica virgifera
  misc_feature: Coding regions on vcDNA: vcDNA=SeqID_17837; Strand=-; Position=122-346
  misc_feature (9)..(25): Xaa can be any naturally occurring amino acid
NINLNLTGXXXXXXXXXXXXXXXXXSINKITLFHKTIDICKPRILISFQKTPLFYISYHKNTTLLICYKFENNI

SEQ ID NO: 38141 - protein, 266 aa, Diabrotica virgifera
  misc_feature: Coding regions on vcDNA: vcDNA=SeqID_17838; Strand=+; Position=2-802
  misc_feature: Homolog annotation: Hit_ID=AAK14815.1; Match level="QueryCoverage =99%, HitCoverage=24%, E-value=2e-22, Identity=29%"; Hit description =polyprotein [Schistosoma japonicum]
  misc_feature: Pfam annotation: Pfam_ID=RVT_1; Match level="Score=-41.4, E-value =0.06, Copies=1"; Pfam description=Reverse transcriptase (RNA -dependent D
  misc_feature (84)..(90): Xaa can be any naturally occurring amino acid
VIEKRKARDLSTHLLFVDLEKAYDTVPLKKLFQTLTKVGLSREYVDAIANIYKNARSVVKEGNFIYESFPISKGLKQGCCLSPXXXXXXXQSSLEQWRKQVSGMGIDIGSVKCLTTLFFADDQVVVANDEEDMDYMFRKLKKEYEIWGLNMNMSKTEYLKIWDDEEDPELEIRTTKRCNEYKYLGSIISKEGTTKRDIEKRTQQGKKAGNILSSLLWSKDIRQETKLTIYRTLVEPIMTYEAEAWQMTKKDRKRIEVVEMDYLRRA

SEQ ID NO: 38142 - protein, 263 aa, Diabrotica virgifera
  misc_feature: Coding regions on vcDNA: vcDNA=SeqID_17839; Strand=-; Position=2-790
  misc_feature (4)..(13): Xaa can be any naturally occurring amino acid
  misc_feature (37)..(44): Xaa can be any naturally occurring amino acid
  misc_feature (47)..(54): Xaa can be any naturally occurring amino acid
  misc_feature (66)..(79): Xaa can be any naturally occurring amino acid
  misc_feature (81)..(263): Xaa can be any naturally occurring amino acid
FIFXXXXXXXXXXGPIVVKYINNLKIETNLAHNGVNXXXXXXXXSNXXXXXXXXPIITFNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38143 - protein, 77 aa, Diabrotica virgifera
  misc_feature: Coding regions on vcDNA: vcDNA=SeqID_17840; Strand=+; Position=606-839
LFYLCLSYFICVAQPWLFSILVSYLQPADSCDRTEIYVPASLIIVVSLIQDTCIDNYQRIVMALRMMLRSASCALIC

SEQ ID NO: 38144 - protein, 283 aa, Diabrotica virgifera
  misc_feature: Coding regions on vcDNA: vcDNA=SeqID_17841; Strand=+; Position=1-849
  misc_feature: Homolog annotation: Hit_ID=AAF36548.1; Match level="QueryCoverage =99%, HitCoverage=90%, E-value=5e-31, Identity=26%"; Hit description =82-kDa surface lipoprotein precursor [Mycoplasma hyorhinis]
  misc_feature: Gene Ontology Annotation: Molecular function=molecular_function unknown; Cellular component=extracellular space; Biological process =DNA repair
ENNGNADTQNDAAQGNENGAAAENNGNADAAQNDAAQANENGAAAENSGNTDAAQGTDNEATAENSGNADPAQGTDNEAAAENSGNENGTGAENNANADAQTDAAQGSTNEANAENNANADVQNDAAQANENGAAAENSGNADAAQGTDNGAAAENTGNADPAQGNDNGAAAENSGNENGTAAENNANADVQNDAAQVNDNGAAAENNGNADAAQSNDNGAAAENNTNADAQNDAAQSTANEANAENNANADAQNDAAQANENGAVAENNGNADAAQGTDNEA

SEQ ID NO: 38145 - protein, 191 aa, Diabrotica virgifera
  misc_feature: Coding regions on vcDNA: vcDNA=SeqID_17842; Strand=+; Position=2-577
  misc_feature: Homolog annotation: Hit_ID=XP_310169.1; Match level="QueryCoverage =99%, HitCoverage=34%, E-value=1e-45, Identity=46%"; Hit description =ENSANGP00000019950 [Anopheles gambiae]
QFFEDRFGYTSEQANDISSIVYIISGVASPILGFLVDKSGMNIYWILVGVSGTTLSHVLLGFTNISPYVAIAIMGLAYSILASSLWPLVSLIIPEYQLGTAYGVAGSIQNLGLALFNIFCGLIIDKFGYTGVEIFFIASLIAAFISSVGLLFLDRIDNGLLNKTPGGRSRHHIERESKGEHPGGKVDVVTS

SEQ ID NO: 38146 - protein, 120 aa, Diabrotica virgifera
  misc_feature: Coding regions on vcDNA: vcDNA=SeqID_17843; Strand=-; Position=370-732
  misc_feature (7)..(14): Xaa can be any naturally occurring amino acid
  misc_feature (28)..(56): Xaa can be any naturally occurring amino acid
  misc_feature (65)..(101): Xaa can be any naturally occurring amino acid
  misc_feature (105)..(114): Xaa can be any naturally occurring amino acid
KTVMTMXXXXXXXXANLQVNPVGRRASXXXXXXXXXXXXXXXXXXXXXXXXXXXXXISNCLIANXXXXXXXXXXXXXXXXXXXXXXXXXXXXXXXXXXXXXENFXXXXXXXXXXIIKLYS

SEQ ID NO: 38147 - protein, 127 aa, Diabrotica virgifera
  misc_feature: Coding regions on vcDNA: vcDNA=SeqID_17844; Strand=-; Position=56-439
  misc_feature (31)..(37): Xaa can be any naturally occurring amino acid
  misc_feature (40)..(56): Xaa can be any naturally occurring amino acid
  misc_feature (69)..(96): Xaa can be any naturally occurring amino acid
  misc_feature (107)..(114): Xaa can be any naturally occurring amino acid
  misc_feature (119)..(127): Xaa can be any naturally occurring amino acid
FLMLSVILRITIYNKILIISSFLRMFEINNXXXXXXXYTXXXXXXXXXXXXXXXXXRMSIAFHNTYLKXXXXXXXXXXXXXXXXXXXXXXXXXXXXLIHKVQKMSLXXXXXXXXLTMLXXXXXXXXX

SEQ ID NO: 38148 - protein, 123 aa, Diabrotica virgifera
  misc_feature: Coding regions on vcDNA: vcDNA=SeqID_17845; Strand=-; Position=523-894
AADKNGRYHHSVPSQRRRLVVGRMQWKRWNISVHLCRVISRLIYYMVFLLNSQFIGDLCRLLCDLNLRTYIKKCELRLRIVSCVINDILDKIQGFLARKPHFHSIGQLRRQPLRASSYQTTFL

SEQ ID NO: 38149 - protein, 89 aa, Diabrotica virgifera
  misc_feature: Coding regions on vcDNA: vcDNA=SeqID_17846; Strand=+; Position=1-267
  misc_feature (3)..(67): Xaa can be any naturally occurring amino acid
AHXXXXXXXXXXXXXXXXXXXXXXXXXXXXXXXXXXXXXXXXXXXXXXXXXXXXXXXXXXXXXXXXXVLIRFSSIKLSYMINLFNWGDY

SEQ ID NO: 38150 - protein, 85 aa, Diabrotica virgifera
  misc_feature: Coding regions on vcDNA: vcDNA=SeqID_17847; Strand=-; Position=1-255
  misc_feature (1)..(63): Xaa can be any naturally occurring amino acid
  misc_feature (65)..(85): Xaa can be any naturally occurring amino acid
XXXXXXXXXXXXXXXXXXXXXXXXXXXXXXXXXXXXXXXXXXXXXXXXXXXXXXXXXXXXXXXGXXXXXXXXXXXXXXXXXXXXX

SEQ ID NO: 38151 - protein, 60 aa, Diabrotica virgifera
  misc_feature: Coding regions on vcDNA: vcDNA=SeqID_17848; Strand=-; Position=80-262
GFSHQRILGPPSASFVISICSVYISLSICSHVVGYCCVSFVYVFDSLWECAAKKKFLCLI

SEQ ID NO: 38152 - protein, 252 aa, Diabrotica virgifera
  misc_feature: Coding regions on vcDNA: vcDNA=SeqID_17849; Strand=+; Position=1-756
  misc_feature (3)..(169): Xaa can be any naturally occurring amino acid
  misc_feature (173)..(180): Xaa can be any naturally occurring amino acid
  misc_feature (184)..(210): Xaa can be any naturally occurring amino acid
  misc_feature (212)..(245): Xaa can be any naturally occurring amino acid
YLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLFXXXXXXXXRPTXXXXXXXXXXXXXXXXXXXXXXXXXXXKXXXXXXXXXXXXXXXXXXXXXXXXXXXXXXXXXXFITLLIS

SEQ ID NO: 38153 - protein, 263 aa, Diabrotica virgifera
  misc_feature: Coding regions on vcDNA: vcDNA=SeqID_17850; Strand=-; Position=2-790
  misc_feature (8)..(8): Xaa can be any naturally occurring amino acid
  misc_feature (10)..(11): Xaa can be any naturally occurring amino acid
  misc_feature (13)..(45): Xaa can be any naturally occurring amino acid
  misc_feature (47)..(201): Xaa can be any naturally occurring amino acid
  misc_feature (204)..(241): Xaa can be any naturally occurring amino acid
  misc_feature (244)..(263): Xaa can be any naturally occurring amino acid
SIRVSRLXKXXKXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXXXXXXX

SEQ ID NO: 38154 - protein, 52 aa, Diabrotica virgifera
  misc_feature: Coding regions on vcDNA: vcDNA=SeqID_17851; Strand=+; Position=1-159
HGESYIGDQGGHKKHGKSSNGIRIRVDIVTVVADKHWIRLAEEDDILILMFS

SEQ ID NO: 38155 - protein, 70 aa, Diabrotica virgifera
  misc_feature: Coding regions on vcDNA: vcDNA=SeqID_17852; Strand=+; Position=474-686
  misc_feature (59)..(66): Xaa can be any naturally occurring amino acid
NNSYSIRPSQLLHSLNVLRYTTGSNMIITKLEMNTQICSGYNSQWPTFLSFVYQPLLSXXXXXXXXLSSK

SEQ ID NO: 38156 - protein, 22 aa, Diabrotica virgifera
  misc_feature: Coding regions on vcDNA: vcDNA=SeqID_17853; Strand=-; Position=1-66
  misc_feature (19)..(19): Xaa can be any naturally occurring amino acid
NPPLAASIKILQSLFRIRXRVR

SEQ ID NO: 38157 - protein, 204 aa, Diabrotica virgifera
  misc_feature: Coding regions on vcDNA: vcDNA=SeqID_17854; Strand=+; Position=3-617
  misc_feature (1)..(14): Xaa can be any naturally occurring amino acid
  misc_feature (18)..(54): Xaa can be any naturally occurring amino acid
  misc_feature (59)..(111): Xaa can be any naturally occurring amino acid
  misc_feature (120)..(148): Xaa can be any naturally occurring amino acid
  misc_feature (152)..(167): Xaa can be any naturally occurring amino acid
  misc_feature (170)..(176): Xaa can be any naturally occurring amino acid
  misc_feature (183)..(189): Xaa can be any naturally occurring amino acid
  misc_feature (195)..(195): Xaa can be any naturally occurring amino acid
  misc_feature (197)..(197): Xaa can be any naturally occurring amino acid
XXXXXXXXXXXXXXVPRXXXXXXXXXXXXXXXXXXXXXXXXXXXXXXXXXXXXXWNGIXXXXXXXXXXXXXXXXXXXXXXXXXXXXXXXXXXXXXXXXXXXXXXXXXXXXXIKIFHNFKXXXXXXXXXXXXXXXXXXXXXXXXXXXXXEWWXXXXXXXXXXXXXXXXYKXXXXXXXTLLLKHXXXXXXXSRWHWXIXWARILTC

SEQ ID NO: 38158 - protein, 73 aa, Diabrotica virgifera
  misc_feature: Coding regions on vcDNA: vcDNA=SeqID_17855; Strand=+; Position=616-834
MSSDFIRVVLPLMFSLLWSYFQPSATTDLTEIYVHASVIIVLRLIQDTCMHNYQMMFMFLRMIFRVASCALIY

SEQ ID NO: 38159 - protein, 73 aa, Diabrotica virgifera
  misc_feature: Coding regions on vcDNA: vcDNA=SeqID_17856; Strand=-; Position=2-220
  misc_feature (4)..(4): Xaa can be any naturally occurring amino acid
  misc_feature (6)..(42): Xaa can be any naturally occurring amino acid
  misc_feature (44)..(73): Xaa can be any naturally occurring amino acid
LYFXIXXXXXXXXXXXXXXXXXXXXXXXXXXXXXXXXXXXXXFXXXXXXXXXXXXXXXXXXXXXXXXXXXXXX

SEQ ID NO: 38160 - protein, 108 aa, Diabrotica virgifera
  misc_feature: Coding regions on vcDNA: vcDNA=SeqID_17857; Strand=+; Position=64-390
  misc_feature (10)..(17): Xaa can be any naturally occurring amino acid
  misc_feature (22)..(37): Xaa can be any naturally occurring amino acid
  misc_feature (41)..(53): Xaa can be any naturally occurring amino acid
  misc_feature (63)..(80): Xaa can be any naturally occurring amino acid
  misc_feature (88)..(105): Xaa can be any naturally occurring amino acid
SVTIAREYFXXXXXXXXFCTLXXXXXXXXXXXXXXXXLKQXXXXXXXXXXXXXNNLFGMKCHXXXXXXXXXXXXXXXXXXNISISKYXXXXXXXXXXXXXXXXXXIKM

SEQ ID NO: 38161 - protein, 247 aa, Diabrotica virgifera
  misc_feature: Coding regions on vcDNA: vcDNA=SeqID_17858; Strand=+; Position=3-746
  misc_feature (1)..(22): Xaa can be any naturally occurring amino acid
  misc_feature (25)..(62): Xaa can be any naturally occurring amino acid
  misc_feature (66)..(128): Xaa can be any naturally occurring amino acid
  misc_feature (133)..(203): Xaa can be any naturally occurring amino acid
  misc_feature (206)..(216): Xaa can be any naturally occurring amino acid
  misc_feature (220)..(245): Xaa can be any naturally occurring amino acid
XXXXXXXXXXXXXXXXXXXXXXVPXXXXXXXXXXXXXXXXXXXXXXXXXXXXXXXXXXXXXXMKRXXXXXXXXXXXXXXXXXXXXXXXXXXXXXXXXXXXXXXXXXXXXXXXXXXXXXXXXXXXXXXXRYSFXXXXXXXXXXXXXXXXXXXXXXXXXXXXXXXXXXXXXXXXXXXXXXXXXXXXXXXXXXXXXXXXXXXXXXXPTXXXXXXXXXXXAKVXXXXXXXXXXXXXXXXXXXXXXXXXXEF

SEQ ID NO: 38162 - protein, 45 aa, Diabrotica virgifera
  misc_feature: Coding regions on vcDNA: vcDNA=SeqID_17859; Strand=-; Position=0-134
LELLNAVSRTAILPFNQKLLGSKIATPRPSFKFKRVYVENYAIPR

SEQ ID NO: 38163 - protein, 115 aa, Diabrotica virgifera
  misc_feature: Coding regions on vcDNA: vcDNA=SeqID_17860; Strand=-; Position=575-922
  misc_feature (1)..(12): Xaa can be any naturally occurring amino acid
  misc_feature (14)..(19): Xaa can be any naturally occurring amino acid
  misc_feature (27)..(34): Xaa can be any naturally occurring amino acid
  misc_feature (51)..(57): Xaa can be any naturally occurring amino acid
  misc_feature (65)..(89): Xaa can be any naturally occurring amino acid
  misc_feature (99)..(115): Xaa can be any naturally occurring amino acid
XXXXXXXXXXXXRXXXXXXTPSFHLPXXXXXXXXLTRSKYPRPFQLIGGRXXXXXXXQKTCFYKXXXXXXXXXXXXXXXXXXXXXXXXXILIIIHPLLXXXXXXXXXXXXXXXXX

SEQ ID NO: 38164 - protein, 75 aa, Diabrotica virgifera
  misc_feature: Coding regions on vcDNA: vcDNA=SeqID_17861; Strand=-; Position=73-300
NIRLSPWTRTAKKSANVTVLFLSSIVFVISNYIQVLQPVACNCFFLTFHLLLQHFPKKHNLSRISQLTEGYDEMA

SEQ ID NO: 38165 - protein, 63 aa, Diabrotica virgifera
  misc_feature: Coding regions on vcDNA: vcDNA=SeqID_17862; Strand=+; Position=33-224
  misc_feature (2)..(20): Xaa can be any naturally occurring amino acid
  misc_feature (26)..(36): Xaa can be any naturally occurring amino acid
IXXXXXXXXXXXXXXXXXXXEEYIRXXXXXXXXXXXVVIFVFSIIILIIKPYLFSSLLVRRWE

SEQ ID NO: 38166 - protein, 322 aa, Diabrotica virgifera
  misc_feature: Coding regions on vcDNA: vcDNA=SeqID_17863; Strand=-; Position=1-966
  misc_feature (6)..(300): Xaa can be any naturally occurring amino acid
SSVEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRRLSTG

SEQ ID NO: 38167 - protein, 66 aa, Diabrotica virgifera; identical to SEQ ID NO: 26808
  misc_feature: Coding regions on vcDNA: vcDNA=SeqID_17864; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38168 - protein, 49 aa, Diabrotica virgifera
  misc_feature: Coding regions on vcDNA: vcDNA=SeqID_17865; Strand=+; Position=79-228
  misc_feature (24)..(29): Xaa can be any naturally occurring amino acid
VRRTRPGFDGWEVYSELIVVRFSXXXXXXNFVTNYKIGHVTRKSMNHNQ

SEQ ID NO: 38169 - protein, 64 aa, Diabrotica virgifera
  misc_feature: Coding regions on vcDNA: vcDNA=SeqID_17866; Strand=-; Position=1-192
LLSTFLLVKKRYSNESLRIRHFSVVRRILPYTLEVAVIRINRCQHSRTSQWWSDQENTARAGGG

SEQ ID NO: 38170 - protein, 111 aa, Diabrotica virgifera
  misc_feature: Coding regions on vcDNA: vcDNA=SeqID_17867; Strand=+; Position=258-593
  misc_feature (11)..(17): Xaa can be any naturally occurring amino acid
  misc_feature (31)..(41): Xaa can be any naturally occurring amino acid
  misc_feature (49)..(59): Xaa can be any naturally occurring amino acid
  misc_feature (76)..(91): Xaa can be any naturally occurring amino acid
LFCNVMLFAYXXXXXXXPNILIIYSQPIYNXXXXXXXXXXXLGMTFLIXXXXXXXXXXXPGPTIIISYNTLAIYFXXXXXXXXXXXXXXXXYKLFQFSNDDNINIKKLHIY

SEQ ID NO: 38171 - protein, 101 aa, Diabrotica virgifera
  misc_feature: Coding regions on vcDNA: vcDNA=SeqID_17868; Strand=+; Position=22-327
  misc_feature (32)..(40): Xaa can be any naturally occurring amino acid
YVIGQSSTICISTWQKILLFTRLVMIVVSRPXXXXXXXXXSLHGAVSCSFKLNLMVLSMLEHKRGCNLRIYALLVRVHSIGVSVGVRYAHLPIYPSESKAD

SEQ ID NO: 38172 - protein, 241 aa, Diabrotica virgifera
  misc_feature: Coding regions on vcDNA: vcDNA=SeqID_17869; Strand=-; Position=2-724
  misc_feature (3)..(12): Xaa can be any naturally occurring amino acid
  misc_feature (14)..(14): Xaa can be any naturally occurring amino acid
  misc_feature (17)..(99): Xaa can be any naturally occurring amino acid
  misc_feature (102)..(239): Xaa can be any naturally occurring amino acid
INXXXXXXXXXXFXITXXXXXXXXXXXXXXXXXXXXXXXXXXXXXXXXXXXXXXXXXXXXXXXXXXXXXXXXXXXXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRF

SEQ ID NO: 38173 - protein, 51 aa, Diabrotica virgifera
  misc_feature: Coding regions on vcDNA: vcDNA=SeqID_17870; Strand=+; Position=3-158
ALSRPHTKDILHYSFLVLPRMVRKGVLLIKSDYIKKLINVVQIYPRGPGLN

SEQ ID NO: 38174 - protein, 87 aa, Diabrotica virgifera
  misc_feature: Coding regions on vcDNA: vcDNA=SeqID_17871; Strand=-; Position=115-378
SPMRPSSRLCFASDRSGKVDIFHHKHTSVIGSNLQSRELSRAVSFVQAVIKTSILILNCRSLRHAKTTFCSFEKKSLWSPHSLRANK

SEQ ID NO: 38175 - protein, 66 aa, Diabrotica virgifera; identical to SEQ ID NO: 26808
  misc_feature: Coding regions on vcDNA: vcDNA=SeqID_17872; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38176 - protein, 234 aa, Diabrotica virgifera
  misc_feature: Coding regions on vcDNA: vcDNA=SeqID_17873; Strand=-; Position=154-858
  misc_feature (1)..(131): Xaa can be any naturally occurring amino acid
  misc_feature (133)..(153): Xaa can be any naturally occurring amino acid
  misc_feature (159)..(168): Xaa can be any naturally occurring amino acid
  misc_feature (171)..(195): Xaa can be any naturally occurring amino acid
  misc_feature (205)..(225): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXDTILFXXXXXXXXXXNNXXXXXXXXXXXXXXXXXXXXXXXXXNKRDTVSLRXXXXXXXXXXXXXXXXXXXXXRVVNDMIIN

SEQ ID NO: 38177 - protein, 270 aa, Diabrotica virgifera
  misc_feature: Coding regions on vcDNA: vcDNA=SeqID_17874; Strand=-; Position=1-810
  misc_feature (1)..(208): Xaa can be any naturally occurring amino acid
  misc_feature (211)..(248): Xaa can be any naturally occurring amino acid
  misc_feature (251)..(270): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXRYXXXXXXXXXXXXXXXXXXXX

SEQ ID NO: 38178 - protein, 245 aa, Diabrotica virgifera
  misc_feature: Coding regions on vcDNA: vcDNA=SeqID_17875; Strand=-; Position=74-811
  misc_feature (1)..(184): Xaa can be any naturally occurring amino acid
  misc_feature (188)..(198): Xaa can be any naturally occurring amino acid
  misc_feature (200)..(212): Xaa can be any naturally occurring amino acid
  misc_feature (215)..(226): Xaa can be any naturally occurring amino acid
  misc_feature (228)..(237): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFIXXXXXXXXXXXMXXXXXXXXXXXXXINXXXXXXXXXXXXRXXXXXXXXXXKKDILSRY

SEQ ID NO: 38179 - protein, 79 aa, Diabrotica virgifera
  misc_feature: Coding regions on vcDNA: vcDNA=SeqID_17876; Strand=+; Position=115-354
LMVDHHQYNTLKITTTLPILLYIKAYIIHRLTWLSSLYDINYATLLCGLTFTIESLSANSKSLCSMKIVNHQLLYELII

SEQ ID NO: 38180 - protein, 40 aa, Diabrotica virgifera
  misc_feature: Coding regions on vcDNA: vcDNA=SeqID_17877; Strand=-; Position=1-120
  misc_feature (6)..(25): Xaa can be any naturally occurring amino acid
  misc_feature (28)..(40): Xaa can be any naturally occurring amino acid
ISNIHXXXXXXXXXXXXXXXXXXXXIFXXXXXXXXXXXXX

SEQ ID NO: 38181 - protein, 85 aa, Diabrotica virgifera
  misc_feature: Coding regions on vcDNA: vcDNA=SeqID_17878; Strand=+; Position=354-611
  misc_feature (64)..(72): Xaa can be any naturally occurring amino acid
HFRPQHIFGTIGTFAWLLEVWLERFINSTSRLTSEFIANFFTIVKYSFIVKRKDIEVAINYTFXXXXXXXXXSLHWNKNLSCSRK

SEQ ID NO: 38182 - protein, 221 aa, Diabrotica virgifera
  misc_feature: Coding regions on vcDNA: vcDNA=SeqID_17879; Strand=-; Position=2-664
  misc_feature (5)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (66)..(221): Xaa can be any naturally occurring amino acid
YRTKXXXXXXXXNQPGSHRSKXXXXXXXXXEXXXXXXXXXXXXXXSIIEVAIFIIDLNSTIKFRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38183 - protein, 288 aa, Diabrotica virgifera
  misc_feature: Coding regions on vcDNA: vcDNA=SeqID_17880; Strand=-; Position=2-865
  misc_feature (1)..(3): Xaa can be any naturally occurring amino acid
  misc_feature (5)..(26): Xaa can be any naturally occurring amino acid
  misc_feature (30)..(31): Xaa can be any naturally occurring amino acid
  misc_feature (34)..(34): Xaa can be any naturally occurring amino acid
  misc_feature (37)..(224): Xaa can be any naturally occurring amino acid
  misc_feature (230)..(251): Xaa can be any naturally occurring amino acid
  misc_feature (253)..(265): Xaa can be any naturally occurring amino acid
  misc_feature (268)..(287): Xaa can be any naturally occurring amino acid
XXXNXXXXXXXXXXXXXXXXXXXXXXVSRXXKKXKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFVREXXXXXXXXXXXXXXXXXXXXXXGXXXXXXXXXXXXXRYXXXXXXXXXXXXXXXXXXXXV

SEQ ID NO: 38184 - protein, 41 aa, Diabrotica virgifera
  misc_feature: Coding regions on vcDNA: vcDNA=SeqID_17881; Strand=-; Position=39-164
VQHHLLRNEFNLYLKKGEINKNVGLGRPEKLYTFIYPSNKM

SEQ ID NO: 38185 - protein, 166 aa, Diabrotica virgifera
  misc_feature: Coding regions on vcDNA: vcDNA=SeqID_17882; Strand=+; Position=49-549
  misc_feature: Homolog annotation: Hit_ID=EAL44161.1; Match level="QueryCoverage =83%, HitCoverage=40%, E-value=8e-10, Identity=26%"; Hit description =hypothetical protein 290.t00011 [Entamoeba histolytica HM-1:IMSS]
  misc_feature (77)..(77): Xaa can be any naturally occurring amino acid
  misc_feature (100)..(100): Xaa can be any naturally occurring amino acid
GERKTSDRSNTAKQGNANPKQSKSRGRPRPREQETHNKQRTPQRDHTSENGQRGPQERKDEKDNKPTHGRGDGHRQXHSGRKKRKADQEDAAAPTTNAEXKEEQTNSEGAAKQNDCNYETRRDETGNTHPNEKNGSKECDKKLDDIFGESLNDDPIRRLYDMEMSL

SEQ ID NO: 38186 - protein, 283 aa, Diabrotica virgifera
  misc_feature: Coding regions on vcDNA: vcDNA=SeqID_17883; Strand=+; Position=14-862
  misc_feature (12)..(19): Xaa can be any naturally occurring amino acid
  misc_feature (24)..(34): Xaa can be any naturally occurring amino acid
  misc_feature (38)..(51): Xaa can be any naturally occurring amino acid
  misc_feature (53)..(63): Xaa can be any naturally occurring amino acid
  misc_feature (66)..(197): Xaa can be any naturally occurring amino acid
  misc_feature (199)..(206): Xaa can be any naturally occurring amino acid
  misc_feature (208)..(219): Xaa can be any naturally occurring amino acid
  misc_feature (223)..(242): Xaa can be any naturally occurring amino acid
  misc_feature (245)..(254): Xaa can be any naturally occurring amino acid
  misc_feature (258)..(258): Xaa can be any naturally occurring amino acid
  misc_feature (262)..(262): Xaa can be any naturally occurring amino acid
  misc_feature (266)..(278): Xaa can be any naturally occurring amino acid
  misc_feature (280)..(280): Xaa can be any naturally occurring amino acid
LISIVREYLSSXXXXXXXXFRTSXXXXXXXXXXXSFHXXXXXXXXXXXXXXIXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXPXXXXXXXXXXXXAKVXXXXXXXXXXXXXXXXXXXXLYXXXXXXXXXXLKAXIFLXDERXXXXXXXXXXXXXIXIII

SEQ ID NO: 38187 - protein, 143 aa, Diabrotica virgifera
  misc_feature: Coding regions on vcDNA: vcDNA=SeqID_17884; Strand=+; Position=191-622
  misc_feature (17)..(24): Xaa can be any naturally occurring amino acid
  misc_feature (88)..(98): Xaa can be any naturally occurring amino acid
  misc_feature (138)..(138): Xaa can be any naturally occurring amino acid
IGNNETKGTRSLRQTIXXXXXXXXVLRNTPSSLSQERRKYFRDKERDILKKRMQELTSNIGDLRFAPKGKVFSNNLYMTASRKSRTFXXXXXXXXXXXLSFSTRSSEWPKQTGSTQKIQIWGNWFLWEYSDLASGLNXNSFVL

SEQ ID NO: 38188 - protein, 23 aa, Diabrotica virgifera
  misc_feature: Coding regions on vcDNA: vcDNA=SeqID_17885; Strand=-; Position=1-69
  misc_feature (1)..(23): Xaa can be any naturally occurring amino acid
XXXXXXXXXXXXXXXXXXXXXXX

SEQ ID NO: 38189 - protein, 78 aa, Diabrotica virgifera
  misc_feature: Coding regions on vcDNA: vcDNA=SeqID_17886; Strand=+; Position=314-550
  misc_feature (14)..(24): Xaa can be any naturally occurring amino acid
CTFTVPSVSNQFIXXXXXXXXXXXIFHGGDAVSAIISIMRASQLVKYQYLYQKVQFLLLYITLYVNIQTSINCAVFLS

SEQ ID NO: 38190 - protein, 183 aa, Diabrotica virgifera
  misc_feature: Coding regions on vcDNA: vcDNA=SeqID_17887; Strand=+; Position=2-553
  misc_feature (3)..(12): Xaa can be any naturally occurring amino acid
  misc_feature (17)..(34): Xaa can be any naturally occurring amino acid
  misc_feature (47)..(58): Xaa can be any naturally occurring amino acid
  misc_feature (60)..(76): Xaa can be any naturally occurring amino acid
  misc_feature (81)..(133): Xaa can be any naturally occurring amino acid
  misc_feature (144)..(153): Xaa can be any naturally occurring amino acid
  misc_feature (161)..(172): Xaa can be any naturally occurring amino acid
VSXXXXXXXXXXIILRXXXXXXXXXXXXXXXXXXYCVWHCCLPISNXXXXXXXXXXXXYXXXXXXXXXXXXXXXXXSEVIXXXXXXXXXXXXXXXXXXXXXXXXXXXXXXXXXXXXXXXXXXXXXXXXXXXXXSMIILSLIDCXXXXXXXXXXTEFMFRSXXXXXXXXXXXXISQPSTARRFV

SEQ ID NO: 38191 - protein, 59 aa, Diabrotica virgifera
  misc_feature: Coding regions on vcDNA: vcDNA=SeqID_17888; Strand=-; Position=135-314
  misc_feature (35)..(44): Xaa can be any naturally occurring amino acid
FFGYFASKCSIWDLRNGNLLFISYNSAFYWVLQPXXXXXXXXXXFLVSYIFAKSIFSIK

SEQ ID NO: 38192 - protein, 29 aa, Diabrotica virgifera
  misc_feature: Coding regions on vcDNA: vcDNA=SeqID_17889; Strand=-; Position=2-88
  misc_feature (16)..(29): Xaa can be any naturally occurring amino acid
YAVIPRVIYSINQKKXXXXXXXXXXXXXX

SEQ ID NO: 38193 - protein, 161 aa, Diabrotica virgifera
  misc_feature: Coding regions on vcDNA: vcDNA=SeqID_17890; Strand=-; Position=336-821
  misc_feature (4)..(4): Xaa can be any naturally occurring amino acid
  misc_feature (7)..(7): Xaa can be any naturally occurring amino acid
  misc_feature (20)..(20): Xaa can be any naturally occurring amino acid
  misc_feature (28)..(28): Xaa can be any naturally occurring amino acid
NRDXISXSVFETQLRLTILXLDLLIILXNRRFLLFIAISTDNSNSAVMYRSISYIGYPSENIAKILNNIPNLKLSFKCKENIKSIFSHTKDKINKTSKICIYKLSCEDCPLTYVGRTMRPLNKRIKEHLSKIDKSSSGHHLHASNHNFSPQRDSRSYIVYV

SEQ ID NO: 38194 - protein, 95 aa, Diabrotica virgifera
  misc_feature: Coding regions on vcDNA: vcDNA=SeqID_17891; Strand=+; Position=2-289
  misc_feature (86)..(95): Xaa can be any naturally occurring amino acid
ILYMDEQIISWYLEHSGLLPHYSHTISICRISRPPQKNYKSSPCFTEYFPFFSWNVKLYVILDITLYEDIGYTSFLRNDEALTIIXXXXXXXXXX

SEQ ID NO: 38195 - protein, 18 aa, Diabrotica virgifera
  misc_feature: Coding regions on vcDNA: vcDNA=SeqID_17892; Strand=-; Position=1-54
RGFGPVLRAFHLSLIVRS

SEQ ID NO: 38196 - protein, 86 aa, Diabrotica virgifera
  misc_feature: Coding regions on vcDNA: vcDNA=SeqID_17893; Strand=+; Position=449-706
  misc_feature (3)..(9): Xaa can be any naturally occurring amino acid
  misc_feature (17)..(42): Xaa can be any naturally occurring amino acid
  misc_feature (51)..(71): Xaa can be any naturally occurring amino acid
  misc_feature (77)..(84): Xaa can be any naturally occurring amino acid
SNXXXXXXXSKEDNNSXXXXXXXXXXXXXXXXXXXXXXXXXXVNKNMVFLXXXXXXXXXXXXXXXXXXXXXGKVANXXXXXXXXGM

SEQ ID NO: 38197 - protein, 91 aa, Diabrotica virgifera
  misc_feature: Coding regions on vcDNA: vcDNA=SeqID_17894; Strand=-; Position=266-541
PDQGTQNFTKTSKKNKGRIKIWEQIIETVHYYIRKSLQFHIPSIHPYRGCKYTFKISQELDKMTNSKQLLFQSSFTKSTLFESSASEYVHL

SEQ ID NO: 38198 - protein, 47 aa, Diabrotica virgifera
  misc_feature: Coding regions on vcDNA: vcDNA=SeqID_17895; Strand=-; Position=2-142
  misc_feature (3)..(10): Xaa can be any naturally occurring amino acid
  misc_feature (20)..(34): Xaa can be any naturally occurring amino acid
  misc_feature (38)..(45): Xaa can be any naturally occurring amino acid
RYXXXXXXXXKDERDDSLTXXXXXXXXXXXXXXXGERXXXXXXXXIK

SEQ ID NO: 38199 - protein, 88 aa, Diabrotica virgifera
  misc_feature: Coding regions on vcDNA: vcDNA=SeqID_17896; Strand=-; Position=2-265
  misc_feature (1)..(20): Xaa can be any naturally occurring amino acid
  misc_feature (23)..(30): Xaa can be any naturally occurring amino acid
  misc_feature (37)..(69): Xaa can be any naturally occurring amino acid
  misc_feature (79)..(88): Xaa can be any naturally occurring amino acid
XXXXXXXXXXXXXXXXXXXXYIXXXXXXXXNKNLSFXXXXXXXXXXXXXXXXXXXXXXXXXXXXXXXXXYFSTVKMTRXXXXXXXXXX

SEQ ID NO: 38200 - protein, 127 aa, Diabrotica virgifera
  misc_feature: Coding regions on vcDNA: vcDNA=SeqID_17897; Strand=-; Position=246-629
  misc_feature (2)..(20): Xaa can be any naturally occurring amino acid
KXXXXXXXXXXXXXXXXXXXSDIIFRICIYCACAFFYQTSFIEFDSFVPNSTHLVLNGVLKLHNISVFGFLVQFAHIARRIPRYREVGNYFMDRCPFCYQFFLLDCDTVIRLYYGCLVRRWWGDLYF

SEQ ID NO: 38201 - protein, 154 aa, Diabrotica virgifera
  misc_feature: Coding regions on vcDNA: vcDNA=SeqID_17898; Strand=+; Position=82-546
  misc_feature (3)..(10): Xaa can be any naturally occurring amino acid
  misc_feature (12)..(17): Xaa can be any naturally occurring amino acid
  misc_feature (19)..(24): Xaa can be any naturally occurring amino acid
  misc_feature (41)..(48): Xaa can be any naturally occurring amino acid
  misc_feature (56)..(71): Xaa can be any naturally occurring amino acid
  misc_feature (77)..(93): Xaa can be any naturally occurring amino acid
  misc_feature (95)..(101): Xaa can be any naturally occurring amino acid
  misc_feature (116)..(124): Xaa can be any naturally occurring amino acid
  misc_feature (136)..(142): Xaa can be any naturally occurring amino acid
RIXXXXXXXXVXXXXXXSXXXXXXLLYLEYQDLLLHNYIFXXXXXXXXRKLKFSLXXXXXXXXXXXXXXXXLELDPXXXXXXXXXXXXXXXXXNXXXXXXXLIFSDELKNKILLLXXXXXXXXXNTSHTLKYVIHXXXXXXXLILYKLLIKTYI

SEQ ID NO: 38202 - protein, 124 aa, Diabrotica virgifera
  misc_feature: Coding regions on vcDNA: vcDNA=SeqID_17899; Strand=-; Position=1-372
  misc_feature (1)..(124): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38203 - protein, 210 aa, Diabrotica virgifera
  misc_feature: Coding regions on vcDNA: vcDNA=SeqID_17900; Strand=+; Position=53-685
  misc_feature: Homolog annotation: Hit_ID=XP_321378.1; Match level="QueryCoverage =97%, HitCoverage=82%, E-value=5e-96, Identity=81%"; Hit description =ENSANGP00000012187 [Anopheles gambiae]
  misc_feature: Gene Ontology Annotation: Molecular function=iron-sulfur electron transfer carrier; Cellular component=membrane fraction; Biological process=mitochondrial electron transport, NADH to ubiquinone
  misc_feature: Pfam annotation: Pfam_ID=Fer4; Match level="Score=66.2, E-value=9e -17, Copies=2"; Pfam description=4Fe-4S binding domain
MSLGVRKIFSVGSKLVRPSVQIVGQRCCSSGSKDGYFYVNDKEPSMEFGAITDRAAQTMFFTELFRGFGVTLAHIFKEPATINYPFEKGPLSPRFRGEHALRRYPSGEERCIACKLCEAICPAQAITIEAEERADGSRRTTRYDIDMTKCIYCGFCQEACPVDAIVEGPNFEFSTETHEELLYNKEKLLNNGDKWESEIASNIHADHLYR

SEQ ID NO: 38204 - protein, 178 aa, Diabrotica virgifera
  misc_feature: Coding regions on vcDNA: vcDNA=SeqID_17901; Strand=-; Position=4-540
  misc_feature: Homolog annotation: Hit_ID=AAC72919.1; Match level="QueryCoverage =93%, HitCoverage=36%, E-value=1e-31, Identity=40%"; Hit description =reverse transcriptase [Lymantria dispar]
  misc_feature: Pfam annotation: Pfam_ID=RVT_1; Match level="Score=-17.7, E-value =0.0018, Copies=1"; Pfam description=Reverse transcriptase (RNA -dependent D
MELYQQCTGAAFLDVSKAFDRVWHEGLTYKMRDYAYSGAMTKLISSYLTDRKFRIRIGPVLSEHGMPEAGVPQGAVLSPLLYSIYTADVPRTPGILISLYADDTAIVAKHMNLDKAVRNIQTALDTIEEWSIQWKIAINPDKTQAVIFKKRRDNPEEQPTLQDRPKEWQNEAKYQSGR

SEQ ID NO: 38205 - protein, 78 aa, Diabrotica virgifera
  misc_feature: Coding regions on vcDNA: vcDNA=SeqID_17902; Strand=-; Position=3-236
  misc_feature (3)..(10): Xaa can be any naturally occurring amino acid
  misc_feature (15)..(25): Xaa can be any naturally occurring amino acid
  misc_feature (41)..(41): Xaa can be any naturally occurring amino acid
  misc_feature (45)..(58): Xaa can be any naturally occurring amino acid
  misc_feature (65)..(77): Xaa can be any naturally occurring amino acid
YYXXXXXXXXYWSFXXXXXXXXXXXNQTGSHRFKLRSCKIXKVEXXXXXXXXXXXXXXSNIEVAXXXXXXXXXXXXXC

SEQ ID NO: 38206 - protein, 197 aa, Diabrotica virgifera
  misc_feature: Coding regions on vcDNA: vcDNA=SeqID_17903; Strand=+; Position=377-970
  misc_feature (10)..(26): Xaa can be any naturally occurring amino acid
  misc_feature (62)..(70): Xaa can be any naturally occurring amino acid
  misc_feature (75)..(104): Xaa can be any naturally occurring amino acid
  misc_feature (109)..(184): Xaa can be any naturally occurring amino acid
  misc_feature (187)..(194): Xaa can be any naturally occurring amino acid
SNIKYLLGIXXXXXXXXXXXXXXXXXRIQKFSHHLSKYRLSHPHPHHHPSQSSHFSSNFSLXXXXXXXXXKFSNXXXXXXXXXXXXXXXXXXXXXXXXXXXXXXLLKTXXXXXXXXXXXXXXXXXXXXXXXXXXXXXXXXXXXXXXXXXXXXXXXXXXXXXXXXXXXXXXXXXXXXXXXXXXXXHYXXXXXXXXSFI

SEQ ID NO: 38207 - protein, 312 aa, Diabrotica virgifera
  misc_feature: Coding regions on vcDNA: vcDNA=SeqID_17904; Strand=-; Position=3-939
  misc_feature: Homolog annotation: Hit_ID=XP_308737.1; Match level="QueryCoverage =99%, HitCoverage=24%, E-value=2e-51, Identity=36%"; Hit description =ENSANGP00000015074 [Anopheles gambiae]
  misc_feature: Pfam annotation: Pfam_ID=Peptidase_A17; Match level="Score=51.6, E -value=2.2e-12, Copies=1"; Pfam description=Pao retrotransposon peptidase
  misc_feature (21)..(23): Xaa can be any naturally occurring amino acid
  misc_feature (26)..(26): Xaa can be any naturally occurring amino acid
  misc_feature (38)..(38): Xaa can be any naturally occurring amino acid
  misc_feature (171)..(171): Xaa can be any naturally occurring amino acid
  misc_feature (192)..(198): Xaa can be any naturally occurring amino acid
  misc_feature (244)..(244): Xaa can be any naturally occurring amino acid
LMIFRLHVYVITADISKMYDXXXINXTQQIYQRVLWRXNNSEPVRDFRINRIVYRLSCSPYLAIRCLHQLANDDGDSFPLAAEALKTETYVNDMVSSCPSFENALALRDELIALLAKGGFELKKWSSNVPDLLKGLAVSDLAIKPLTFNDDISSQTLKVLGLEWDASSDTXTFGFKVQVLDSSCTKRHLLSXXXXXXXPLGFLSPMTFLIKHLIQRIWTQKIGWDYAPSKEIIRLWKKYLDDIXVNYLPRRLLIDDISRLEVHCFGDASEKGYCAVLYFRCLSPSGQPFVSFDIAKSKVAPINKGLTIPRLK

SEQ ID NO: 38208 - protein, 322 aa, Diabrotica virgifera
  misc_feature: Coding regions on vcDNA: vcDNA=SeqID_17905; Strand=-; Position=2-967
  misc_feature (2)..(51): Xaa can be any naturally occurring amino acid
  misc_feature (54)..(238): Xaa can be any naturally occurring amino acid
  misc_feature (241)..(279): Xaa can be any naturally occurring amino acid
  misc_feature (282)..(290): Xaa can be any naturally occurring amino acid
  misc_feature (298)..(321): Xaa can be any naturally occurring amino acid
IXXXXXXXXXXXXXXXXXXXXXXXXXXXXXXXXXXXXXXXXXXXXXXXXXXLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXEVXXXXXXXXXEIKIFSHXXXXXXXXXXXXXXXXXXXXXXXXK

SEQ ID NO: 38209 - protein, 194 aa, Diabrotica virgifera
  misc_feature: Coding regions on vcDNA: vcDNA=SeqID_17906; Strand=+; Position=88-667
  misc_feature: Homolog annotation: Hit_ID=AAR10032.1; Match level="QueryCoverage =78%, HitCoverage=94%, E-value=8e-25, Identity=47%"; Hit description =similar to Drosophila melanogaster Vha16 [Drosophila yakuba] ref|NP _724476.1| CG3161-PD, isoform D [Drosop
  misc_feature: Gene Ontology Annotation: Molecular function=hydrogen-transporting two-sector ATPase activity; Cellular component=integral to membrane; Biological process=proton transport
  misc_feature (29)..(29): Xaa can be any naturally occurring amino acid
  misc_feature (40)..(40): Xaa can be any naturally occurring amino acid
  misc_feature (51)..(51): Xaa can be any naturally occurring amino acid
  misc_feature (74)..(74): Xaa can be any naturally occurring amino acid
  misc_feature (102)..(102): Xaa can be any naturally occurring amino acid
  misc_feature (125)..(125): Xaa can be any naturally occurring amino acid
HPGYGPFFGVMQLAFVIIFRSLQAAYDDXNESETAIAAMXSVMTPRTYDEXLISLDMVGFIVVYGLVIAVLGLXNNIQDSSTYSLHSGYVHLNAGLCLMSFXLTLVVAIALAAFDAVKLTGQLPXCFVQMILILVFGIVLHLYVSFLDIYLYTITDLHSSPMISSPKDSEAEVAHLAPIMLVVMSTCNNTSCSL

SEQ ID NO: 38210 - protein, 74 aa, Diabrotica virgifera
  misc_feature: Coding regions on vcDNA: vcDNA=SeqID_17907; Strand=-; Position=604-828
QACTRWSACSLQYGRHILQLVHLYLIASHSYSYKKYYRSIVEYIQYNYNTLIAVVKSITLMHAFITLCQSSSIY

SEQ ID NO: 38211 - protein, 58 aa, Diabrotica virgifera
  misc_feature: Coding regions on vcDNA: vcDNA=SeqID_17908; Strand=-; Position=1-174
  misc_feature (4)..(41): Xaa can be any naturally occurring amino acid
  misc_feature (43)..(58): Xaa can be any naturally occurring amino acid
TISXXXXXXXXXXXXXXXXXXXXXXXXXXXXXXXXXXXXXXRXXXXXXXXXXXXXXXX

SEQ ID NO: 38212 - protein, 101 aa, Diabrotica virgifera
  misc_feature: Coding regions on vcDNA: vcDNA=SeqID_17909; Strand=-; Position=3-305
  misc_feature (3)..(63): Xaa can be any naturally occurring amino acid
EVXXXXXXXXXXXXXXXXXXXXXXXXXXXXXXXXXXXXXXXXXXXXXXXXXXXXXXXXXXXXXVTMRRRSVRLTLKDVRYSMDENLIKMEIEKKGHTVRNV

SEQ ID NO: 38213 - protein, 273 aa, Diabrotica virgifera
  misc_feature: Coding regions on vcDNA: vcDNA=SeqID_17910; Strand=-; Position=0-818
  misc_feature (1)..(25): Xaa can be any naturally occurring amino acid
  misc_feature (27)..(51): Xaa can be any naturally occurring amino acid
  misc_feature (57)..(117): Xaa can be any naturally occurring amino acid
  misc_feature (123)..(216): Xaa can be any naturally occurring amino acid
  misc_feature (219)..(255): Xaa can be any naturally occurring amino acid
  misc_feature (259)..(272): Xaa can be any naturally occurring amino acid
XXXXXXXXXXXXXXXXXXXXXXXXXSXXXXXXXXXXXXXXXXXXXXXXXXXPSSSFXXXXXXXXXXXXXXXXXXXXXXXXXXXXXXXXXXXXXXXXXXXXXXXXXXXXXXXXXXXXXNPNITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFPXXXXXXXXXXXXXXXXXXXXXXXXXXXXXXXXXXXXXPRSXXXXXXXXXXXXXXR

SEQ ID NO: 38214 - protein, 44 aa, Diabrotica virgifera
  misc_feature: Coding regions on vcDNA: vcDNA=SeqID_17911; Strand=-; Position=1-132
  misc_feature (13)..(24): Xaa can be any naturally occurring amino acid
  misc_feature (30)..(42): Xaa can be any naturally occurring amino acid
QIMKKFKSRTDFXXXXXXXXXXXXHHRGRXXXXXXXXXXXXXLL

SEQ ID NO: 38215 - protein, 272 aa, Diabrotica virgifera
  misc_feature: Coding regions on vcDNA: vcDNA=SeqID_17912; Strand=-; Position=2-817
  misc_feature (13)..(32): Xaa can be any naturally occurring amino acid
  misc_feature (39)..(137): Xaa can be any naturally occurring amino acid
  misc_feature (140)..(226): Xaa can be any naturally occurring amino acid
  misc_feature (229)..(256): Xaa can be any naturally occurring amino acid
  misc_feature (258)..(272): Xaa can be any naturally occurring amino acid
YTSIGSSRLLKQXXXXXXXXXXXXXXXXXXXXSSKPSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHIXXXXXXXXXXXXXXXXXXXXXXXXXXXXXXXXXXXXXXXXXXXXXXXXXXXXXXXXXXXXXXXXXXXXXXXXXXXXXXXXXXXXXXXEKXXXXXXXXXXXXXXXXXXXXXXXXXXXXLXXXXXXXXXXXXXXX

SEQ ID NO: 38216 - protein, 231 aa, Diabrotica virgifera
  misc_feature: Coding regions on vcDNA: vcDNA=SeqID_17913; Strand=+; Position=2-697
  misc_feature: Homolog annotation: Hit_ID=XP_393497.1; Match level="QueryCoverage =99%, HitCoverage=4%, E-value=4e-71, Identity=58%"; Hit description =similar to ENSANGP00000007226 [Apis mellifera]
  misc_feature: Gene Ontology Annotation: Molecular function=calcium-dependent cell adhesion molecule activity; Cellular component=integral to plasma membrane; Biological process=calcium-dependent cell-cell adhesion
  misc_feature: Pfam annotation: Pfam_ID=Laminin_G_2; Match level="Score=85.8, E -value=1.1e-22, Copies=1"; Pfam description=Laminin G domain
KGSTLWSHQRRVRSAVNLGTTSGSIGKSISIMFRTVQQNGILFYATSNKYYTSIEITNGQVLYISKLSSMVNMTDIRVINDGAWHNLTLYTHGRSIRIILDDEKFGDELDTAGVHDFLDPYLTYLSIGGASPEYYYAHDTSPHFFEGCLVNFTVNNEIQPFNGSGTIFSEVYYKGRVMKECKGSIGVGAAAAPDPLSIGITLVIVFFVVLLVAILVSFVAFRLRKQYKEKR

SEQ ID NO: 38217 - protein, 313 aa, Diabrotica virgifera
  misc_feature: Coding regions on vcDNA: vcDNA=SeqID_17914; Strand=-; Position=2-940
  misc_feature (1)..(280): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILKVTCDLSIPLLDHSTTFVKHVLEYSGKKVFM

SEQ ID NO: 38218 - protein, 105 aa, Diabrotica virgifera
  misc_feature: Coding regions on vcDNA: vcDNA=SeqID_17915; Strand=+; Position=3-320
  misc_feature (7)..(15): Xaa can be any naturally occurring amino acid
  misc_feature (20)..(29): Xaa can be any naturally occurring amino acid
  misc_feature (42)..(48): Xaa can be any naturally occurring amino acid
  misc_feature (53)..(62): Xaa can be any naturally occurring amino acid
  misc_feature (68)..(93): Xaa can be any naturally occurring amino acid
SPDPRPXXXXXXXXXPSPPXXXXXXXXXXIVNSYSERIIFSXXXXXXXFPYLXXXXXXXXXXSSSSSXXXXXXXXXXXXXXXXXXXXXXXXXXNGNGISFFKISF

SEQ ID NO: 38219 - protein, 171 aa, Diabrotica virgifera
  misc_feature: Coding regions on vcDNA: vcDNA=SeqID_17916; Strand=-; Position=1-513
  misc_feature (16)..(46): Xaa can be any naturally occurring amino acid
  misc_feature (49)..(72): Xaa can be any naturally occurring amino acid
  misc_feature (74)..(108): Xaa can be any naturally occurring amino acid
  misc_feature (117)..(123): Xaa can be any naturally occurring amino acid
  misc_feature (125)..(133): Xaa can be any naturally occurring amino acid
  misc_feature (139)..(147): Xaa can be any naturally occurring amino acid
TYIIFLNIHSINITIXXXXXXXXXXXXXXXXXXXXXXXXXXXXXXXILXXXXXXXXXXXXXXXXXXXXXXXXPXXXXXXXXXXXXXXXXXXXXXXXXXXXXXXXXXXXKQHYHSKNXXXXXXXPXXXXXXXXXQTIKFXXXXXXXXXFIITHTQHQFLNINFYIYYIHSHY

SEQ ID NO: 38220 - protein, 32 aa, Diabrotica virgifera
  misc_feature: Coding regions on vcDNA: vcDNA=SeqID_17917; Strand=-; Position=1-96
  misc_feature (18)..(18): Xaa can be any naturally occurring amino acid
  misc_feature (20)..(32): Xaa can be any naturally occurring amino acid
IGYLGQPDSSSWDIFYFXTXXXXXXXXXXXXX

SEQ ID NO: 38221 - protein, 276 aa, Diabrotica virgifera
  misc_feature: Coding regions on vcDNA: vcDNA=SeqID_17918; Strand=+; Position=24-851
  misc_feature: Homolog annotation: Hit_ID=EAA05407.2; Match level="QueryCoverage =96%, HitCoverage=7%, E-value=5e-35, Identity=32%"; Hit description =ENSANGP00000019767 [Anopheles gambiae str. PEST] ref|XP_560014.1| ENSANGP00000019767 [Anopheles gambiae str
  misc_feature (251)..(251): Xaa can be any naturally occurring amino acid
  misc_feature (261)..(261): Xaa can be any naturally occurring amino acid
  misc_feature (265)..(265): Xaa can be any naturally occurring amino acid
MKEIWNCMKLNAFIKSFSVIFISDLKIEGTERWEVASLSCDNIVVCATQTEKMKVKFSVSAVQFDNQLYSRESYDFPVLLVGQDVKESNKMPTLNIPIENLLQNSDEEALLVVDLALETWRDKYVMSNTTGVKSLQIVINPISCFVEDGYLTRLMDYFYVFIPTKLIMWPDKKLPLKLNGTSGSVSVPEIVSWQCAILARPLTVRNLNIAPISLLLSIHSSIKMYIALDQSPLQFGKFERKRVFTTPYRLXHAMTMHYLSXAIFXAGWVVSSLELI

SEQ ID NO: 38222 - protein, 93 aa, Diabrotica virgifera
  misc_feature: Coding regions on vcDNA: vcDNA=SeqID_17919; Strand=-; Position=2-280
  misc_feature (13)..(13): Xaa can be any naturally occurring amino acid
  misc_feature (15)..(27): Xaa can be any naturally occurring amino acid
  misc_feature (30)..(40): Xaa can be any naturally occurring amino acid
  misc_feature (50)..(57): Xaa can be any naturally occurring amino acid
  misc_feature (60)..(73): Xaa can be any naturally occurring amino acid
  misc_feature (79)..(92): Xaa can be any naturally occurring amino acid
HISWKDFFHSSCXLXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 38223 - protein, 33 aa, Diabrotica virgifera
  misc_feature: Coding regions on vcDNA: vcDNA=SeqID_17920; Strand=+; Position=1-99
  misc_feature (1)..(31): Xaa can be any naturally occurring amino acid
XXXXXXXXXXXXXXXXXXXXXXXXXXXXXXXTS

SEQ ID NO: 38224 - protein, 267 aa, Diabrotica virgifera
  misc_feature: Coding regions on vcDNA: vcDNA=SeqID_17921; Strand=-; Position=2-802
  misc_feature (4)..(11): Xaa can be any naturally occurring amino acid
  misc_feature (17)..(251): Xaa can be any naturally occurring amino acid
  misc_feature (253)..(267): Xaa can be any naturally occurring amino acid
KKTXXXXXXXXIGSFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 38225 - protein, 109 aa, Diabrotica virgifera
  misc_feature: Coding regions on vcDNA: vcDNA=SeqID_17922; Strand=-; Position=6-335
  misc_feature: Homolog annotation: Hit_ID=AAM75006.1; Match level="QueryCoverage =95%, HitCoverage=32%, E-value=2e-11, Identity=38%"; Hit description =GH01866p [Drosophila melanogaster]
  misc_feature: Gene Ontology Annotation: Cellular component=mitochondrion
VRNVLVFAVQTRGKKESYVMCSAIAAVAHMCDWLLVALSSKLVSMGVLSNGSYGTTKNGRLFFPANIKNAICQMVQGIPFVDLSKGLSAFTGKDVEEETTEAIIIIAAN

SEQ ID NO: 38226 - protein, 88 aa, Diabrotica virgifera
  misc_feature: Coding regions on vcDNA: vcDNA=SeqID_17923; Strand=+; Position=390-656
  misc_feature (51)..(57): Xaa can be any naturally occurring amino acid
RIYDLAPAQQMSCRPATRLYVSASSSLAPFLPPSISIDSLSLFPYEQTCKXXXXXXXVWGSKRFKCRPTCEADSFFCLLQYPVVVLSS

SEQ ID NO: 38227 - protein, 56 aa, Diabrotica virgifera
  misc_feature: Coding regions on vcDNA: vcDNA=SeqID_17924; Strand=+; Position=206-376
  misc_feature (17)..(30): Xaa can be any naturally occurring amino acid
  misc_feature (34)..(41): Xaa can be any naturally occurring amino acid
TYVPKTKSDYGSLISCXXXXXXXXXXXXXXTLLXXXXXXXXYSHIINIKRYILCCL

SEQ ID NO: 38228 - protein, 82 aa, Diabrotica virgifera
  misc_feature: Coding regions on vcDNA: vcDNA=SeqID_17925; Strand=+; Position=3-250
  misc_feature: Homolog annotation: Hit_ID=AAH86843.1; Match level="QueryCoverage =69%, HitCoverage=8%, E-value=2e-12, Identity=52%"; Hit description =Zgc:103686 [Danio rerio] ref|NP_001008584.1| zgc:103686 [Danio rerio]
  misc_feature: Gene Ontology Annotation: Molecular function=basic amino acid transporter activity; Cellular component=integral to plasma membrane; Biological process=transport
  misc_feature (27)..(27): Xaa can be any naturally occurring amino acid
STGVENGFSVPFIPWGPGISIFTNIYXYMTNIQKDTWIKYGYWMAVGIIIYFAYGLWHSTERDRSKDDEQSKAINRSDSCSS

SEQ ID NO: 38229 - protein, 78 aa, Diabrotica virgifera
  misc_feature: Coding regions on vcDNA: vcDNA=SeqID_17926; Strand=-; Position=1-234
  misc_feature (3)..(25): Xaa can be any naturally occurring amino acid
  misc_feature (30)..(57): Xaa can be any naturally occurring amino acid
  misc_feature (60)..(78): Xaa can be any naturally occurring amino acid
PPXXXXXXXXXXXXXXXXXXXXXXXNRVFXXXXXXXXXXXXXXXXXXXXXXXXXXXXTLXXXXXXXXXXXXXXXXXXX

SEQ ID NO: 38230 - protein, 228 aa, Diabrotica virgifera
  misc_feature: Coding regions on vcDNA: vcDNA=SeqID_17927; Strand=-; Position=76-762
  misc_feature (1)..(1): Xaa can be any naturally occurring amino acid
  misc_feature (4)..(164): Xaa can be any naturally occurring amino acid
  misc_feature (168)..(205): Xaa can be any naturally occurring amino acid
  misc_feature (208)..(216): Xaa can be any naturally occurring amino acid
XSFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFIXXXXXXXXXXXXXXXXXXXXXXXXXXXXXXXXXXXXXXEVXXXXXXXXXENEKMILSTDTN

SEQ ID NO: 38231 - protein, 182 aa, Diabrotica virgifera
  misc_feature: Coding regions on vcDNA: vcDNA=SeqID_17928; Strand=-; Position=1-546
  misc_feature (2)..(11): Xaa can be any naturally occurring amino acid
  misc_feature (13)..(13): Xaa can be any naturally occurring amino acid
  misc_feature (22)..(29): Xaa can be any naturally occurring amino acid
  misc_feature (31)..(44): Xaa can be any naturally occurring amino acid
  misc_feature (51)..(63): Xaa can be any naturally occurring amino acid
  misc_feature (65)..(182): Xaa can be any naturally occurring amino acid
FXXXXXXXXXXEXNLAHTGLTXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38232 - protein, 191 aa, Diabrotica virgifera
  misc_feature: Coding regions on vcDNA: vcDNA=SeqID_17929; Strand=+; Position=232-804
  misc_feature (2)..(8): Xaa can be any naturally occurring amino acid
  misc_feature (33)..(49): Xaa can be any naturally occurring amino acid
  misc_feature (78)..(117): Xaa can be any naturally occurring amino acid
  misc_feature (127)..(183): Xaa can be any naturally occurring amino acid
  misc_feature (185)..(185): Xaa can be any naturally occurring amino acid
FXXXXXXXLPPTIYLQLNTPTLLILNNSSGRAXXXXXXXXXXXXXXXXXFKNFSLFQNHVISPHFLTLSTFTFHKFFXXXXXXXXXXXXXXXXXXXXXXXXXXXXXXXXXXXXXXXXTVIKNTSFWXXXXXXXXXXXXXXXXXXXXXXXXXXXXXXXXXXXXXXXXXXXXXXXXXXXXXXXXXAXIFLKTR

SEQ ID NO: 38233 - protein, 65 aa, Diabrotica virgifera
  misc_feature: Coding regions on vcDNA: vcDNA=SeqID_17930; Strand=-; Position=81-278
  misc_feature (5)..(24): Xaa can be any naturally occurring amino acid
  misc_feature (32)..(42): Xaa can be any naturally occurring amino acid
  misc_feature (45)..(53): Xaa can be any naturally occurring amino acid
TISLXXXXXXXXXXXXXXXXXXXXKYENNKMXXXXXXXXXXXEVXXXXXXXXXEMREMISLTDTN

SEQ ID NO: 38234 - protein, 108 aa, Diabrotica virgifera
  misc_feature: Coding regions on vcDNA: vcDNA=SeqID_17931; Strand=-; Position=30-356
CRKIFMQNTFTLYIEYLTLSLLKNYMLALRIIALRICIVTKCRCYELMPYICIPIQKCITLKIYPFYLQTVLQISSLVTPSSVLIVTILSTTFFSSKSSFSTRLDTRM

SEQ ID NO: 38235 - protein, 231 aa, Diabrotica virgifera
  misc_feature: Coding regions on vcDNA: vcDNA=SeqID_17932; Strand=-; Position=49-744
  misc_feature (6)..(22): Xaa can be any naturally occurring amino acid
  misc_feature (24)..(41): Xaa can be any naturally occurring amino acid
  misc_feature (44)..(71): Xaa can be any naturally occurring amino acid
  misc_feature (74)..(207): Xaa can be any naturally occurring amino acid
HSFIPXXXXXXXXXXXXXXXXXRXXXXXXXXXXXXXXXXXXHVXXXXXXXXXXXXXXXXXXXXXXXXXXXXILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRYTNSQEYVVPKSIPTAGALAIL

SEQ ID NO: 38236 - protein, 70 aa, Diabrotica virgifera
  misc_feature: Coding regions on vcDNA: vcDNA=SeqID_17933; Strand=-; Position=0-209
  misc_feature (2)..(69): Xaa can be any naturally occurring amino acid
GXXXXXXXXXXXXXXXXXXXXXXXXXXXXXXXXXXXXXXXXXXXXXXXXXXXXXXXXXXXXXXXXXXXXT

SEQ ID NO: 38237 - protein, 42 aa, Diabrotica virgifera
  misc_feature: Coding regions on vcDNA: vcDNA=SeqID_17934; Strand=-; Position=1-126
  misc_feature (3)..(17): Xaa can be any naturally occurring amino acid
  misc_feature (26)..(39): Xaa can be any naturally occurring amino acid
EVXXXXXXXXXXXXXXXGYELTMLRXXXXXXXXXXXXXXKRN

SEQ ID NO: 38238 - protein, 86 aa, Diabrotica virgifera
  misc_feature: Coding regions on vcDNA: vcDNA=SeqID_17935; Strand=+; Position=7-267
  misc_feature (9)..(15): Xaa can be any naturally occurring amino acid
  misc_feature (22)..(28): Xaa can be any naturally occurring amino acid
  misc_feature (39)..(45): Xaa can be any naturally occurring amino acid
  misc_feature (60)..(74): Xaa can be any naturally occurring amino acid
NTFPLPQKXXXXXXXLYRGVRXXXXXXXDKFIVCTLGIXXXXXXXIYLSFPILQELYDLXXXXXXXXXXXXXXXNGHSVLIIPIFI

SEQ ID NO: 38239 - protein, 139 aa, Diabrotica virgifera
  misc_feature: Coding regions on vcDNA: vcDNA=SeqID_17936; Strand=-; Position=344-763
  misc_feature (45)..(56): Xaa can be any naturally occurring amino acid
  misc_feature (67)..(74): Xaa can be any naturally occurring amino acid
  misc_feature (81)..(129): Xaa can be any naturally occurring amino acid
GGGPFSFSPPAEKGGVPTTKIVFHPPFLSPSLFKKQPAQIMLRAXXXXXXXXXXXXRKRGFFKSRPXXXXXXXXSILVVVXXXXXXXXXXXXXXXXXXXXXXXXXXXXXXXXXXXXXXXXXXXXXXXXXIRKKLYSLML

SEQ ID NO: 38240 - protein, 86 aa, Diabrotica virgifera
  misc_feature: Coding regions on vcDNA: vcDNA=SeqID_17937; Strand=+; Position=1-261
  misc_feature (21)..(28): Xaa can be any naturally occurring amino acid
  misc_feature (48)..(58): Xaa can be any naturally occurring amino acid
  misc_feature (73)..(81): Xaa can be any naturally occurring amino acid
NRTYIVIEKSVCVQKFSNCNXXXXXXXXRLHYSILFIYIGVILYYQSXXXXXXXXXXXIQSLTMKYWLKTAQXXXXXXXXXHLHRP

SEQ ID NO: 38241 - protein, 17 aa, Diabrotica virgifera
  misc_feature: Coding regions on vcDNA: vcDNA=SeqID_17938; Strand=-; Position=0-50
  misc_feature (9)..(16): Xaa can be any naturally occurring amino acid
IKLYRGFSXXXXXXXXT

SEQ ID NO: 38242 - protein, 304 aa, Diabrotica virgifera
  misc_feature: Coding regions on vcDNA: vcDNA=SeqID_17939; Strand=+; Position=53-963
  misc_feature: Homolog annotation: Hit_ID=NP_611333.1; Match level="QueryCoverage =98%, HitCoverage=62%, E-value=1e-119, Identity=68%"; Hit description= CG30118-PA [Drosophila melanogaster] gb|AAF57688.2| CG30118-PA [Drosophila melanogaster]
  misc_feature (225)..(229): Xaa can be any naturally occurring amino acid
  misc_feature (244)..(244): Xaa can be any naturally occurring amino acid
  misc_feature (263)..(263): Xaa can be any naturally occurring amino acid
  misc_feature (283)..(283): Xaa can be any naturally occurring amino acid
MEDPKDNRILYKLVLTGGPCGGKTTGQARLCTFFENLGWKVFRVPETASVLLGGGIKFADLDERESVKFQENLLKSMLQIEDTFFELGKTCKRNCLIICDRGAMDASAFVAKETWETIMRGNAWNNVELRDNRYNQIIHMVTAAKGAEEFYSTEDHNCRSEGVELARELDTKAAAAWVGHPYFDVIDNSTDFEGKIRRMIVSVCHKIGLDTGDRLLKNSRKHKFXXXXXLPDDLLFPPFQDFEXVHNYLQSNSPNQVRLRKRXPEGHYSYIHTVRRQNHPGGXKLSKVKTQIAHRDYINLIDTK

SEQ ID NO: 38243 - protein, 85 aa, Diabrotica virgifera
  misc_feature: Coding regions on vcDNA: vcDNA=SeqID_17940; Strand=-; Position=83-340
  misc_feature (8)..(16): Xaa can be any naturally occurring amino acid
  misc_feature (19)..(26): Xaa can be any naturally occurring amino acid
INIRLNIXXXXXXXXXCSXXXXXXXXLKSPFSQTLEHCKLAKCTAELFQCISLINGSNKILQIGQKKRKLREGTRKDSLIGKKNN

SEQ ID NO: 38244 - protein, 52 aa, Diabrotica virgifera
  misc_feature: Coding regions on vcDNA: vcDNA=SeqID_17941; Strand=+; Position=115-273
  misc_feature (7)..(14): Xaa can be any naturally occurring amino acid
TCYGFTXXXXXXXXARCYSVLDISKFLRNTLNLFINNIFIAKCFVYYKYQPS

SEQ ID NO: 38245 - protein, 278 aa, Diabrotica virgifera
  misc_feature: Coding regions on vcDNA: vcDNA=SeqID_17942; Strand=+; Position=57-888
  misc_feature: Homolog annotation: Hit_ID=XP_308512.1; Match level="QueryCoverage =75%, HitCoverage=82%, E-value=2e-82, Identity=73%"; Hit description =ENSANGP00000024398 [Anopheles gambiae]
  misc_feature: Gene Ontology Annotation: Molecular function=succinate dehydrogenase (ubiquinone) activity; Cellular component=mitochondrial inner membrane; Biological process=electron transport
  misc_feature (101)..(101): Xaa can be any naturally occurring amino acid
  misc_feature (125)..(125): Xaa can be any naturally occurring amino acid
  misc_feature (133)..(133): Xaa can be any naturally occurring amino acid
  misc_feature (162)..(162): Xaa can be any naturally occurring amino acid
  misc_feature (167)..(167): Xaa can be any naturally occurring amino acid
  misc_feature (244)..(244): Xaa can be any naturally occurring amino acid
  misc_feature (259)..(259): Xaa can be any naturally occurring amino acid
  misc_feature (262)..(262): Xaa can be any naturally occurring amino acid
NFVNRLSINLGIHSLTTFLFKHSYNRLEKSQLFRLSEREVSTSSSYSRCRNFKRRSQLEAKRAEKPARPKTFAIYRWNPDKPRHSNLISQEYTVDLNSSWXPSVLDALIKIKNEVDPTLTFRRSXREGICGSXLSNIGGVNTLACISKIETSSKSTKIYPLXPHMYXVVKDLVPDMNNFYRQYKSIEPWLQRSDDSQKKNTEYLQSVEDRQKLDGLYECILCACCSTSCPSYWWNGDKYLGPAXLMQAYRLDIDSRDEXTIXDLDKMRDPSSAYRCHT

SEQ ID NO: 38246 - protein, 68 aa, Diabrotica virgifera
  misc_feature: Coding regions on vcDNA: vcDNA=SeqID_17943; Strand=-; Position=3-206
  misc_feature (27)..(51): Xaa can be any naturally occurring amino acid
  misc_feature (53)..(68): Xaa can be any naturally occurring amino acid
TIIQHRGRNLYYRYELCNKITLLSIRXXXXXXXXXXXXXXXXXXXXXXXXXVXXXXXXXXXXXXXXXX

SEQ ID NO: 38247 - protein, 51 aa, Diabrotica virgifera
  misc_feature: Coding regions on vcDNA: vcDNA=SeqID_17944; Strand=-; Position=417-572
  misc_feature (29)..(35): Xaa can be any naturally occurring amino acid
YPIIFYIYQMYFNISTERSYLLCFTKHTXXXXXXXLKYRVNFLFTIYIYNF

SEQ ID NO: 38248 - protein, 117 aa, Diabrotica virgifera
  misc_feature: Coding regions on vcDNA: vcDNA=SeqID_17945; Strand=-; Position=3-353
  misc_feature (45)..(86): Xaa can be any naturally occurring amino acid
  misc_feature (88)..(98): Xaa can be any naturally occurring amino acid
  misc_feature (108)..(117): Xaa can be any naturally occurring amino acid
TGSNLRDFPHQMWYILIVRKSIFVAPFNSICLMFHPVIILDHFEXXXXXXXXXXXXXXXXXXXXXXXXXXXXXXXXXXXXXXXXXXFXXXXXXXXXXXNQPGSHRFKXXXXXXXXXX

SEQ ID NO: 38249 - protein, 69 aa, Diabrotica virgifera
  misc_feature: Coding regions on vcDNA: vcDNA=SeqID_17946; Strand=-; Position=1-207
  misc_feature (6)..(16): Xaa can be any naturally occurring amino acid
  misc_feature (26)..(33): Xaa can be any naturally occurring amino acid
  misc_feature (39)..(48): Xaa can be any naturally occurring amino acid
  misc_feature (55)..(67): Xaa can be any naturally occurring amino acid
IYWSFXXXXXXXXXXXTNLAHTGLNXXXXXXXXRTDLIXXXXXXXXXXIQHRGRXXXXXXXXXXXXXLL

SEQ ID NO: 38250 - protein, 84 aa, Diabrotica virgifera
  misc_feature: Coding regions on vcDNA: vcDNA=SeqID_17947; Strand=+; Position=72-326
  misc_feature (3)..(13): Xaa can be any naturally occurring amino acid
  misc_feature (19)..(29): Xaa can be any naturally occurring amino acid
  misc_feature (35)..(61): Xaa can be any naturally occurring amino acid
  misc_feature (68)..(78): Xaa can be any naturally occurring amino acid
YKXXXXXXXXXXXIELHNXXXXXXXXXXXTSMKFXXXXXXXXXXXXXXXXXXXXXXXXXXXLNYLFVXXXXXXXXXXXLSSYNI

SEQ ID NO: 38251 - protein, 280 aa, Diabrotica virgifera
  misc_feature: Coding regions on vcDNA: vcDNA=SeqID_17948; Strand=-; Position=1-840
  misc_feature: Homolog annotation: Hit_ID=CAE56149.1; Match level="QueryCoverage =92%, HitCoverage=22%, E-value=5e-30, Identity=30%"; Hit description =Hypothetical protein CBG23762 [Caenorhabditis briggsae]
MELFRNCHTRLKTESPSYRFSSDKKLDYHGFLNDVKPKVLNILSEYLHQHNSIKVNFEIFGIYLKPDTNLSDIKSMNTCNKTITISTELDEVFDDFKEELMTQASEFQEKDSNWVLQEIMFLDVNINKFSSISASTYIRLPIPIVRKHAILNIENKDNKCFAWSIIAAIFPASGNPTKPESYPPYDTLLNFEGIDFPMKLKDIKKFENLNNISVNVYGLESNFVNNKRQYEIVGPLHFTSNRHPTHVNLLLITNDKQSHYCLILDMSRLVKSQKTKNVAK

SEQ ID NO: 38252 - protein, 262 aa, Diabrotica virgifera
  misc_feature: Coding regions on vcDNA: vcDNA=SeqID_17949; Strand=-; Position=1-786
  misc_feature (3)..(24): Xaa can be any naturally occurring amino acid
  misc_feature (31)..(37): Xaa can be any naturally occurring amino acid
  misc_feature (46)..(74): Xaa can be any naturally occurring amino acid
  misc_feature (77)..(93): Xaa can be any naturally occurring amino acid
  misc_feature (96)..(106): Xaa can be any naturally occurring amino acid
  misc_feature (119)..(169): Xaa can be any naturally occurring amino acid
  misc_feature (175)..(262): Xaa can be any naturally occurring amino acid
PHXXXXXXXXXXXXXXXXXXXXXXPPPRRGXXXXXXXPAAPFIILXXXXXXXXXXXXXXXXXXXXXXXXXXXXXKEXXXXXXXXXXXXXXXXXTPXXXXXXXXXXXTTLLSLFLSPLSXXXXXXXXXXXXXXXXXXXXXXXXXXXXXXXXXXXXXXXXXXXXXXXXXXXTTPLLXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38253 - protein, 271 aa, Diabrotica virgifera
  misc_feature: Coding regions on vcDNA: vcDNA=SeqID_17950; Strand=-; Position=27-842
  misc_feature (39)..(65): Xaa can be any naturally occurring amino acid
  misc_feature (68)..(84): Xaa can be any naturally occurring amino acid
  misc_feature (95)..(243): Xaa can be any naturally occurring amino acid
GGRVLVKKFKHVSLENKNFVLIEIKGSFFFIPPLHCSLXXXXXXXXXXXXXXXXXXXXXXXXXXXLYXXXXXXXXXXXXXXXXXRIPLLLLYIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINHFFIKIQHSLTLLIIYTLNKIFLYLY

SEQ ID NO: 38254 - protein, 103 aa, Diabrotica virgifera
  misc_feature: Coding regions on vcDNA: vcDNA=SeqID_17951; Strand=-; Position=39-350
APGLGNNGQLLQVIPHHYASTASSYERYCGNQYCITWYHGSSAICLEMYGTFKISYARLIGGAHVFEIAAEIPPSRKSFIKSTGSARDYFRIILLKLFLKRIW

SEQ ID NO: 38255 - protein, 70 aa, Diabrotica virgifera
  misc_feature: Coding regions on vcDNA: vcDNA=SeqID_17952; Strand=-; Position=90-302
YVCLRTRAASSFRSIIFTVHEIRWLMEKRKFIFGLHLYYYARSCKSDFRGETRLPSNQSISSEHLRLLIQ

SEQ ID NO: 38256 - protein, 66 aa, Diabrotica virgifera
  misc_feature: Coding regions on vcDNA: vcDNA=SeqID_17953; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXXXPTWLTPGLNXXXXXXXXSNXXXXXXXXXXXXXXPTSRSXXXXXXXXXXXXXXV

SEQ ID NO: 38257 - protein, 181 aa, Diabrotica virgifera
  misc_feature: Coding regions on vcDNA: vcDNA=SeqID_17954; Strand=+; Position=2-547
  misc_feature: Homolog annotation: Hit_ID=XP_392311.1; Match level="QueryCoverage =91%, HitCoverage=3%, E-value=1e-38, Identity=54%"; Hit description =similar to Short stop/Kakapo long isoform [Apis mellifera]
  misc_feature: Gene Ontology Annotation: Cellular component=cytoskeleton; Biological process=microtubule-based process
PKTSASSPTSGSSASRTPQGPITKVRERSQRSVPMGSLPRTSKSSLSAGTPDSLSHNESSTFRTPRKPSYRSTLTPGGSRSNSRPQSRTGSRPGSKPPSRHGSNLSLDSTDDATPSRIPRRTPTSGRSSALSTTKSINGSGSRPRTPSGLISPASPVGRRKSPESTYSFRLKSRSPRKDSN

SEQ ID NO: 38258 - protein, 94 aa, Diabrotica virgifera
  misc_feature: Coding regions on vcDNA: vcDNA=SeqID_17955; Strand=-; Position=1-282
  misc_feature (1)..(94): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38259 - protein, 28 aa, Diabrotica virgifera
  misc_feature: Coding regions on vcDNA: vcDNA=SeqID_17956; Strand=+; Position=1-84
  misc_feature (1)..(27): Xaa can be any naturally occurring amino acid
XXXXXXXXXXXXXXXXXXXXXXXXXXXG

SEQ ID NO: 38260 - protein, 56 aa, Diabrotica virgifera
  misc_feature: Coding regions on vcDNA: vcDNA=SeqID_17957; Strand=-; Position=102-272
  misc_feature (13)..(20): Xaa can be any naturally occurring amino acid
GYFWLRTRFSIWXXXXXXXXLWLLCGFRVRLLRCYLSNILLWVNVFLTCSEKRIIV

SEQ ID NO: 38261 - protein, 115 aa, Diabrotica virgifera
  misc_feature: Coding regions on vcDNA: vcDNA=SeqID_17958; Strand=-; Position=18-365
  misc_feature (9)..(20): Xaa can be any naturally occurring amino acid
  misc_feature (23)..(29): Xaa can be any naturally occurring amino acid
  misc_feature (32)..(42): Xaa can be any naturally occurring amino acid
  misc_feature (46)..(53): Xaa can be any naturally occurring amino acid
  misc_feature (56)..(71): Xaa can be any naturally occurring amino acid
FLRSSLNMXXXXXXXXXXXXHIXXXXXXXISXXXXXXXXXXXISFXXXXXXXXFYXXXXXXXXXXXXXXXXYMVFNYSSRTRRAQKINLSADTSRKASPYEDMSVKMTNTCKGHW

SEQ ID NO: 38262 - protein, 50 aa, Diabrotica virgifera
  misc_feature: Coding regions on vcDNA: vcDNA=SeqID_17959; Strand=-; Position=42-194
SSFFSSRGTIQVSITYIVLMLFQHGHNDTAYQIKQWSGETIYLMQKDMFF

SEQ ID NO: 38263 - protein, 76 aa, Diabrotica virgifera
  misc_feature: Coding regions on vcDNA: vcDNA=SeqID_17960; Strand=-; Position=398-628
  misc_feature (55)..(62): Xaa can be any naturally occurring amino acid
  misc_feature (67)..(73): Xaa can be any naturally occurring amino acid
CLDPSILSMCTRSHIHYHKLPCSLHLCTKIRGDYFVIAHIFKRYVYFRIVIYLPXXXXXXXXYYSFXXXXXXXQLI

SEQ ID NO: 38264 - protein, 23 aa, Diabrotica virgifera
  misc_feature: Coding regions on vcDNA: vcDNA=SeqID_17961; Strand=-; Position=1-69
YSVRDHFTYHMLWPLFIKNSCFL

SEQ ID NO: 38265 - protein, 90 aa, Diabrotica virgifera
  misc_feature: Coding regions on vcDNA: vcDNA=SeqID_17962; Strand=-; Position=0-269
FFQVFQGAASYRYRVHSFLKFGSLILSKAPPLREIKGPVFVVYLSSQISLISISKILLPLFFDIFLISPESHCASARKNMAILIPCPRVR

SEQ ID NO: 38266 - protein, 43 aa, Diabrotica virgifera; identical to SEQ ID NO: 31922
  misc_feature: Coding regions on vcDNA: vcDNA=SeqID_17963; Strand=-; Position=1-129
  misc_feature (1)..(43): Xaa can be any naturally occurring amino acid

SEQ ID NO: 38267 - protein, 92 aa, Diabrotica virgifera
  misc_feature: Coding regions on vcDNA: vcDNA=SeqID_17964; Strand=-; Position=489-767
  misc_feature (35)..(43): Xaa can be any naturally occurring amino acid
SKPRLTRPIPHYFSCGKIGYTLFHEHTPVLDHHDXXXXXXXXXKNESKLQNILLFIGTIIRAIYFHTSSVAHYNIRCRDNPRQAYIRGIAHN

SEQ ID NO: 38268 - protein, 109 aa, Diabrotica virgifera
  misc_feature: Coding regions on vcDNA: vcDNA=SeqID_17965; Strand=-; Position=538-867
  misc_feature (8)..(29): Xaa can be any naturally occurring amino acid
  misc_feature (31)..(31): Xaa can be any naturally occurring amino acid
  misc_feature (33)..(79): Xaa can be any naturally occurring amino acid
KYFLGNEXXXXXXXXXXXXXXXXXXXXXXIXKXXXXXXXXXXXXXXXXXXXXXXXXXXXXXXXXXXXXXXXXXXXXXXXLIKEFGNIFFTCLLKTCLFVLNIKSRLPTD

SEQ ID NO: 38269 - protein, 296 aa, Diabrotica virgifera
  misc_feature: Coding regions on vcDNA: vcDNA=SeqID_17966; Strand=+; Position=3-890
  misc_feature (6)..(12): Xaa can be any naturally occurring amino acid
  misc_feature (51)..(64): Xaa can be any naturally occurring amino acid
  misc_feature (66)..(76): Xaa can be any naturally occurring amino acid
  misc_feature (90)..(135): Xaa can be any naturally occurring amino acid
  misc_feature (170)..(209): Xaa can be any naturally occurring amino acid
  misc_feature (211)..(226): Xaa can be any naturally occurring amino acid
  misc_feature (229)..(278): Xaa can be any naturally occurring amino acid
  misc_feature (280)..(280): Xaa can be any naturally occurring amino acid
  misc_feature (283)..(290): Xaa can be any naturally occurring amino acid
  misc_feature (292)..(292): Xaa can be any naturally occurring amino acid
NIFSVXXXXXXXLTIVNSYRRVNIFSLLKEKFLFPYLVYQGFFLIIHHHLXXXXXXXXXXXXXXLXXXXXXXXXXXSKRYSFFKYHLIFXXXXXXXXXXXXXXXXXXXXXXXXXXXXXXXXXXXXXXXXXXXXXXQDSKDSSSFSKYRLSHLILSSSLSHLSHFFIKFFXXXXXXXXXXXXXXXXXXXXXXXXXXXXXXXXXXXXXXXXPXXXXXXXXXXXXXXXXATXXXXXXXXXXXXXXXXXXXXXXXXXXXXXXXXXXXXXXXXXXXXXXXXXXDXFYXXXXXXXXYXIINT

SEQ ID NO: 38270 - protein, 81 aa, Diabrotica virgifera
  misc_feature: Coding regions on vcDNA: vcDNA=SeqID_17967; Strand=+; Position=553-795
  misc_feature: Homolog annotation: Hit_ID=AAC41563.1; Match level="QueryCoverage =90%, HitCoverage=18%, E-value=4e-27, Identity=76%"; Hit description =RNA binding protein pir||S54729 RNA-binding protein cabeza - fruit fly (Drosophila melanogaster) gb|AAA869
  misc_feature: Gene Ontology Annotation: Molecular function=RNA polymerase II transcription factor activity; Cellular component=transcription factor TFIID complex
  misc_feature: Pfam annotation: Pfam_ID=RRM_1; Match level="Score=43.2, E-value=7.4e- 10, Copies=1"; Pfam description=RNA recognition motif. (a.k.a. RRM, RB
  misc_feature (76)..(77): Xaa can be any naturally occurring amino acid
WPVFVSGMNPDLTEDDIEQHFGSIGIIKLDKKTQKRKIWLYKDKATGVSKGEATVTYDDPNAAQSAINWFDGKDFXXMYDQ

SEQ ID NO: 38271 - protein, 151 aa, Diabrotica virgifera
  misc_feature: Coding regions on vcDNA: vcDNA=SeqID_17968; Strand=+; Position=78-533
  misc_feature (2)..(14): Xaa can be any naturally occurring amino acid
  misc_feature (27)..(35): Xaa can be any naturally occurring amino acid
  misc_feature (41)..(75): Xaa can be any naturally occurring amino acid
  misc_feature (78)..(94): Xaa can be any naturally occurring amino acid
  misc_feature (106)..(130): Xaa can be any naturally occurring amino acid
  misc_feature (135)..(140): Xaa can be any naturally occurring amino acid
  misc_feature (142)..(151): Xaa can be any naturally occurring amino acid
RXXXXXXXXXXXXXSNRDKILKYLFVXXXXXXXXXFRNGMXXXXXXXXXXXXXXXXXXXXXXXXXXXXXXXXXXXLEXXXXXXXXXXXXXXXXXKKFHILLYDMIXXXXXXXXXXXXXXXXXXXXXXXXXIDEKXXXXXXYXXXXXXXXXX

SEQ ID NO: 38272 - protein, 201 aa, Diabrotica virgifera
  misc_feature: Coding regions on vcDNA: vcDNA=SeqID_17969; Strand=+; Position=239-841
  misc_feature (13)..(58): Xaa can be any naturally occurring amino acid
  misc_feature (62)..(68): Xaa can be any naturally occurring amino acid
  misc_feature (85)..(199): Xaa can be any naturally occurring amino acid
SKRYSFLNTSNFXXXXXXXXXXXXXXXXXXXXXXXXXXXXXXXXXXXXXXXXXXXXXXLENXXXXXXXLLLIFNIIIFFFHKFFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDE

SEQ ID NO: 38273 - protein, 107 aa, Diabrotica virgifera
  misc_feature: Coding regions on vcDNA: vcDNA=SeqID_17970; Strand=-; Position=472-795
  misc_feature (1)..(20): Xaa can be any naturally occurring amino acid
  misc_feature (38)..(49): Xaa can be any naturally occurring amino acid
  misc_feature (89)..(107): Xaa can be any naturally occurring amino acid
XXXXXXXXXXXXXXXXXXXXKNYNIITYRSLSLKIKFXXXXXXXXXXXXSTLIPSKKLMISPYPSKYRGLQFIVAANLFLSKKPVFIKXXXXXXXXXXXXXXXXXXX

SEQ ID NO: 38274 - protein, 270 aa, Diabrotica virgifera
  misc_feature: Coding regions on vcDNA: vcDNA=SeqID_17971; Strand=-; Position=1-810
  misc_feature (2)..(12): Xaa can be any naturally occurring amino acid
  misc_feature (28)..(28): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(270): Xaa can be any naturally occurring amino acid
FXXXXXXXXXXXNQPGSHRFKLRSCKIXKVEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38275 - protein, 261 aa, Diabrotica virgifera
  misc_feature: Coding regions on vcDNA: vcDNA=SeqID_17972; Strand=+; Position=168-950
  misc_feature (10)..(34): Xaa can be any naturally occurring amino acid
  misc_feature (44)..(99): Xaa can be any naturally occurring amino acid
  misc_feature (120)..(236): Xaa can be any naturally occurring amino acid
  misc_feature (239)..(259): Xaa can be any naturally occurring amino acid
LIIHHHFIYXXXXXXXXXXXXXXXXXXXXXXXXXSKRYSFFKYXXXXXXXXXXXXXXXXXXXXXXXXXXXXXXXXXXXXXXXXXXXXXXXXXXXXXXXXFSKYRYYFIFHHINLIFHLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEXXXXXXXXXXXXXXXXXXXXXII

SEQ ID NO: 38276 - protein, 251 aa, Diabrotica virgifera
  misc_feature: Coding regions on vcDNA: vcDNA=SeqID_17973; Strand=+; Position=1-753
  misc_feature (1)..(22): Xaa can be any naturally occurring amino acid
  misc_feature (24)..(249): Xaa can be any naturally occurring amino acid
XXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKA

SEQ ID NO: 38277 - protein, 311 aa, Diabrotica virgifera
  misc_feature: Coding regions on vcDNA: vcDNA=SeqID_17974; Strand=-; Position=2-934
  misc_feature (1)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRR

SEQ ID NO: 38278 - protein, 72 aa, Diabrotica virgifera
  misc_feature: Coding regions on vcDNA: vcDNA=SeqID_17975; Strand=-; Position=1-216
  misc_feature (9)..(19): Xaa can be any naturally occurring amino acid
  misc_feature (29)..(36): Xaa can be any naturally occurring amino acid
  misc_feature (39)..(51): Xaa can be any naturally occurring amino acid
  misc_feature (58)..(70): Xaa can be any naturally occurring amino acid
IILYIGPFXXXXXXXXXXXTNWAHTGLNXXXXXXXXRTXXXXXXXXXXXXXIHHRGRXXXXXXXXXXXXXLL

SEQ ID NO: 38279 - protein, 253 aa, Diabrotica virgifera
  misc_feature: Coding regions on vcDNA: vcDNA=SeqID_17976; Strand=-; Position=67-828
  misc_feature (1)..(156): Xaa can be any naturally occurring amino acid
  misc_feature (158)..(186): Xaa can be any naturally occurring amino acid
  misc_feature (190)..(229): Xaa can be any naturally occurring amino acid
  misc_feature (231)..(238): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXTISXXXXXXXXXXXXXXXXXXXXXXXXXXXXXXXXXXXXXXXXGXXXXXXXXEKERDILSRILINYR

SEQ ID NO: 38280 - protein, 95 aa, Diabrotica virgifera
  misc_feature: Coding regions on vcDNA: vcDNA=SeqID_17977; Strand=+; Position=307-592
  misc_feature: Homolog annotation: Hit_ID=NP_780706.1; Match level="QueryCoverage =98%, HitCoverage=24%, E-value=2e-15, Identity=48%"; Hit description =RIKEN cDNA 4732495G21 gene [Mus musculus] dbj|BAC26313.1| unnamed protein product [Mus musculus]
  misc_feature: Gene Ontology Annotation: Molecular function=structural constituent of cytoskeleton; Cellular component=cytoskeleton; Biological process= reproduction
  misc_feature (29)..(29): Xaa can be any naturally occurring amino acid
  misc_feature (43)..(43): Xaa can be any naturally occurring amino acid
  misc_feature (60)..(60): Xaa can be any naturally occurring amino acid
LIYYHYFYNDLLCISRNNTLVLITEVPLXPLVKSKIMTQNLFXNFTTPNMMEYILSYITXYASRRTTDIVMDSGDVDTHTDPNNNVNTLPHAILR

SEQ ID NO: 38281 - protein, 80 aa, Diabrotica virgifera
  misc_feature: Coding regions on vcDNA: vcDNA=SeqID_17978; Strand=-; Position=120-362
  misc_feature (4)..(15): Xaa can be any naturally occurring amino acid
  misc_feature (48)..(55): Xaa can be any naturally occurring amino acid
  misc_feature (61)..(68): Xaa can be any naturally occurring amino acid
NYVXXXXXXXXXXXXVKIYKFYLSHKNRDIYKRLSLPFTKKCTKNISXXXXXXXXNHIKKXXXXXXXXYSYIPIHPRHKK

SEQ ID NO: 38282 - protein, 130 aa, Diabrotica virgifera
  misc_feature: Coding regions on vcDNA: vcDNA=SeqID_17979; Strand=-; Position=261-653
  misc_feature (2)..(20): Xaa can be any naturally occurring amino acid
  misc_feature (25)..(40): Xaa can be any naturally occurring amino acid
  misc_feature (51)..(80): Xaa can be any naturally occurring amino acid
  misc_feature (83)..(98): Xaa can be any naturally occurring amino acid
  misc_feature (107)..(113): Xaa can be any naturally occurring amino acid
  misc_feature (120)..(127): Xaa can be any naturally occurring amino acid
RXXXXXXXXXXXXXXXXXXXLEFMXXXXXXXXXXXXXXXXSIHHYINLNSXXXXXXXXXXXXXXXXXXXXXXXXXXXXXXIMXXXXXXXXXXXXXXXXSSIKICNNXXXXXXXDRCSKKXXXXXXXXKFI

SEQ ID NO: 38283 - protein, 39 aa, Diabrotica virgifera
  misc_feature: Coding regions on vcDNA: vcDNA=SeqID_17980; Strand=-; Position=60-179
ETRKIKVFHITISSCILTVNNTTNSVIWHFFKISHLNIH

SEQ ID NO: 38284 - protein, 83 aa, Diabrotica virgifera
  misc_feature: Coding regions on vcDNA: vcDNA=SeqID_17981; Strand=-; Position=78-329
  misc_feature (12)..(32): Xaa can be any naturally occurring amino acid
  misc_feature (38)..(60): Xaa can be any naturally occurring amino acid
  misc_feature (63)..(74): Xaa can be any naturally occurring amino acid
INIKRLFELLNXXXXXXXXXXXXXXXXXXXXXTISITXXXXXXXXXXXXXXXXXXXXXXXNKXXXXXXXXXXXXRYGEVKFFF

SEQ ID NO: 38285 - protein, 272 aa, Diabrotica virgifera
  misc_feature: Coding regions on vcDNA: vcDNA=SeqID_17982; Strand=+; Position=77-892
  misc_feature (12)..(18): Xaa can be any naturally occurring amino acid
  misc_feature (23)..(33): Xaa can be any naturally occurring amino acid
  misc_feature (37)..(60): Xaa can be any naturally occurring amino acid
  misc_feature (64)..(230): Xaa can be any naturally occurring amino acid
  misc_feature (233)..(250): Xaa can be any naturally occurring amino acid
  misc_feature (253)..(272): Xaa can be any naturally occurring amino acid
LISIVREYLLFXXXXXXXFSYLXXXXXXXXXXXHLFXXXXXXXXXXXXXXXXXXXXXXXXNRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGXXXXXXXXXXXXXXXXXXKAXXXXXXXXXXXXXXXXXXXX

SEQ ID NO: 38286 - protein, 59 aa, Diabrotica virgifera
  misc_feature: Coding regions on vcDNA: vcDNA=SeqID_17983; Strand=+; Position=135-314
PNYFSTLFSLMIIATSIIMTYLVTRHQGCTYPGNSIQNLVRAKFLQKKLSYYYICYYIC

SEQ ID NO: 38287 - protein, 207 aa, Diabrotica virgifera
  misc_feature: Coding regions on vcDNA: vcDNA=SeqID_17984; Strand=-; Position=0-620
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(205): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFL

SEQ ID NO: 38288 - protein, 319 aa, Diabrotica virgifera
  misc_feature: Coding regions on vcDNA: vcDNA=SeqID_17985; Strand=+; Position=1-957
  misc_feature: Homolog annotation: Hit_ID=XP_396884.1; Match level="QueryCoverage =99%, HitCoverage=24%, E-value=1e-105, Identity=62%"; Hit description= similar to CG12600-PA [Apis mellifera]
  misc_feature (265)..(265): Xaa can be any naturally occurring amino acid
  misc_feature (296)..(296): Xaa can be any naturally occurring amino acid
  misc_feature (306)..(306): Xaa can be any naturally occurring amino acid
IRLAEMAKMRLEYDEARKRVQHIQQKLADLEEKVQPGQLESDKDRLLLFQEKEQLLRELRSITPRMRSKEEMSDIQLECKRLEDDLNKALEISNRAIADRLRLHEEKQLLLQQLKDGLRQMTHLESQLKTLSASTLSVSSSSSLGSLSTTSSKGSLSSGLSFTDIYGGPQCMSSNNMDKPIDMADLHKRVERLLNSDSTNHIPSPSRSQPSLSPRSSLSSVSPPVSPMYENLPSIVPPPTYDQVKRERKLQIDERLVELRLSNPXIASAGNMEYHQRSSFPSLSPLTDLLESSASXMSQGSGLGRXSRYSYESSGDPPL

SEQ ID NO: 38289 - protein, 82 aa, Diabrotica virgifera
  misc_feature: Coding regions on vcDNA: vcDNA=SeqID_17986; Strand=+; Position=3-251
YGQASTGSGKFPGSDPRRSGFSTHLQNRSKSSPYGKMVKEKNLLRSQSDSSISVSGEMNHSPPFIKMKNSTPPVPPRIQGSS

SEQ ID NO: 38290 - protein, 294 aa, Diabrotica virgifera
  misc_feature: Coding regions on vcDNA: vcDNA=SeqID_17987; Strand=+; Position=42-926
  misc_feature: Homolog annotation: Hit_ID=XP_309165.1; Match level="QueryCoverage =92%, HitCoverage=36%, E-value=5e-68, Identity=50%"; Hit description =ENSANGP00000018598 [Anopheles gambiae]
  misc_feature: Gene Ontology Annotation: Molecular function=ceramidase activity; Cellular component=membrane fraction
  misc_feature: Pfam annotation: Pfam_ID=Ceramidase_alk; Match level="Score=-143.7, E- value=1.7e-13, Copies=1"; Pfam description=Neutral/alkaline non -lysosomal cerami
  misc_feature (24)..(29): Xaa can be any naturally occurring amino acid
  misc_feature (263)..(263): Xaa can be any naturally occurring amino acid
  misc_feature (271)..(271): Xaa can be any naturally occurring amino acid
  misc_feature (283)..(283): Xaa can be any naturally occurring amino acid
MQILVFRVDFFAIIAIFATRVRGXXXXXXYRLCSPVQLDGPGEFDFEQATNTSNPFWNVVRDFIFPPTPDDVVCHFPKPILIMSGRITKPYEWQPVTVSNQLVKIGQLVLIAVPGEFTTMSGRRLRDAVRKAIITNDGPSDSLVVIAGLSNVYTSYIATPEEYQLQRYEGASTIYGPYTLPIYENIYGQLTKAMMKNETVNDDSSPYKFPKDMATLITPVIMDSSGWFNNFGDCVVQPNDCYEPGQTVSAVFVAGHPRNDVMXDKTFLTVXKQESQNQDKPTXKTICTDASWGN

SEQ ID NO: 38291 - protein, 65 aa, Diabrotica virgifera
  misc_feature: Coding regions on vcDNA: vcDNA=SeqID_17988; Strand=+; Position=72-266
  misc_feature (24)..(33): Xaa can be any naturally occurring amino acid
  misc_feature (38)..(50): Xaa can be any naturally occurring amino acid
  misc_feature (52)..(62): Xaa can be any naturally occurring amino acid
LISYRRENPSPPKRKIYLSPYLVXXXXXXXXXXHHLSXXXXXXXXXXXXXIXXXXXXXXXXXSKR

SEQ ID NO: 38292 - protein, 85 aa, Diabrotica virgifera
  misc_feature: Coding regions on vcDNA: vcDNA=SeqID_17989; Strand=+; Position=278-535
  misc_feature (7)..(13): Xaa can be any naturally occurring amino acid
  misc_feature (32)..(55): Xaa can be any naturally occurring amino acid
TILFFRXXXXXXXIKSNNLETDILMRVVALDXXXXXXXXXXXXXXXXXXXXXXXXKIIAYSFSWLRNLQLDLYIYFTFDCLFFLE

SEQ ID NO: 38293 - protein, 50 aa, Diabrotica virgifera
  misc_feature: Coding regions on vcDNA: vcDNA=SeqID_17990; Strand=-; Position=175-327
IYSLVNRYRLLVTCKDRFNYERLSLPIHKIVEHRIFVNNKTYFVWASYFR

SEQ ID NO: 38294 - protein, 252 aa, Diabrotica virgifera
  misc_feature: Coding regions on vcDNA: vcDNA=SeqID_17991; Strand=+; Position=2-757
  misc_feature: Homolog annotation: Hit_ID=EAL31499.1; Match level="QueryCoverage =92%, HitCoverage=45%, E-value=3e-52, Identity=45%"; Hit description =GA17719-PA [Drosophila pseudoobscura]
  misc_feature: Gene Ontology Annotation: Molecular function=D-lactate dehydrogenase (cytochrome) activity; Cellular component=mitochondrion; Biological process=energy pathways
  misc_feature: Pfam annotation: Pfam_ID=FAD-oxidase_C; Match level="Score=181.3, E -value=2.1e-51, Copies=1"; Pfam description=FAD linked oxidases, C -terminal domain
QNFDKVLKTFKFLKAELGEIISAVEVIDTPTMDFINQIVGQTSPIGDYPFYLLVETSGSNEQHDEEKLNHFFEAALKKFLVLNGTVASEPAKIQALWSIRENIPNGFKICSSKMMYYDVSMPLSNYYSIVNDVDEFTKGLSERVFGFGHLGDGNIHLQIQLKDDLTDEIKKHIDPFVFDKILSYGGSISAEHGIGIIKQKYMNRLKTVNTLNLMKDLKSLLDPNKILNPYKVIVLLFFFLFFPGWTFISTQV

SEQ ID NO: 38295 - protein, 260 aa, Diabrotica virgifera
  misc_feature: Coding regions on vcDNA: vcDNA=SeqID_17992; Strand=-; Position=8-790
  misc_feature (1)..(8): Xaa can be any naturally occurring amino acid
  misc_feature (18)..(29): Xaa can be any naturally occurring amino acid
  misc_feature (36)..(43): Xaa can be any naturally occurring amino acid
  misc_feature (47)..(70): Xaa can be any naturally occurring amino acid
  misc_feature (74)..(87): Xaa can be any naturally occurring amino acid
  misc_feature (93)..(111): Xaa can be any naturally occurring amino acid
  misc_feature (117)..(220): Xaa can be any naturally occurring amino acid
  misc_feature (233)..(242): Xaa can be any naturally occurring amino acid
  misc_feature (245)..(260): Xaa can be any naturally occurring amino acid
XXXXXXXXCLHSYLHYSXXXXXXXXXXXXAVKMPRXXXXXXXXTRLXXXXXXXXXXXXXXXXXXXXXXXXLYIXXXXXXXXXXXXXXHHKFKXXXXXXXXXXXXXXXXXXXKVNNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRYEKLNFSFIEXXXXXXXXXXHYXXXXXXXXXXXXXXXX

SEQ ID NO: 38296 - protein, 70 aa, Diabrotica virgifera
  misc_feature: Coding regions on vcDNA: vcDNA=SeqID_17993; Strand=-; Position=382-594
KNLYFFYSYLWIDGRGVLGTDTVFPSVLMSKKVKNLCNQKHTTYSVYKTTKNTTPLMMTCSKLLMITERH

SEQ ID NO: 38297 - protein, 106 aa, Diabrotica virgifera
  misc_feature: Coding regions on vcDNA: vcDNA=SeqID_17994; Strand=+; Position=439-759
  misc_feature (19)..(25): Xaa can be any naturally occurring amino acid
  misc_feature (28)..(42): Xaa can be any naturally occurring amino acid
  misc_feature (69)..(101): Xaa can be any naturally occurring amino acid
YLSIKYFLSSLISKYLQGXXXXXXXLIXXXXXXXXXXXXXXXIFSKYGLHLILSHHNFHSLTNSILKYXXXXXXXXXXXXXXXXXXXXXXXXXXXXXXXXXNIFSR

SEQ ID NO: 38298 - protein, 280 aa, Diabrotica virgifera
  misc_feature: Coding regions on vcDNA: vcDNA=SeqID_17995; Strand=+; Position=2-841
  misc_feature (16)..(23): Xaa can be any naturally occurring amino acid
  misc_feature (49)..(58): Xaa can be any naturally occurring amino acid
  misc_feature (78)..(86): Xaa can be any naturally occurring amino acid
  misc_feature (92)..(114): Xaa can be any naturally occurring amino acid
  misc_feature (116)..(130): Xaa can be any naturally occurring amino acid
  misc_feature (132)..(158): Xaa can be any naturally occurring amino acid
  misc_feature (172)..(276): Xaa can be any naturally occurring amino acid
PRVRFLSLKIIKSLSXXXXXXXXSNDRFISYRERIFSLHKEKSSLSVPXXXXXXXXXXHHHLSLSNLKELKRLKFFIXXXXXXXXXLVIETXXXXXXXXXXXXXXXXXXXXXXXIXXXXXXXXXXXXXXXIXXXXXXXXXXXXXXXXXXXXXXXXXXXYYLHFLIIIYLFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIIF

SEQ ID NO: 38299 - protein, 48 aa, Diabrotica virgifera
  misc_feature: Coding regions on vcDNA: vcDNA=SeqID_17996; Strand=+; Position=1-147
  misc_feature (29)..(36): Xaa can be any naturally occurring amino acid
VLLIVIVEFHFLLKRIEKIYLTPENDYWXXXXXXXXGKIDFSNLVPEE

SEQ ID NO: 38300 - protein, 82 aa, Diabrotica virgifera
  misc_feature: Coding regions on vcDNA: vcDNA=SeqID_17997; Strand=-; Position=303-551
  misc_feature (8)..(13): Xaa can be any naturally occurring amino acid
NHLNIFFXXXXXXVQKFLNHSSACFYLSLLFILSLAFTHTAKNNCKHVSLSVSCFLPYNICTRFDLGGFTDYKVIRLFKRSY

SEQ ID NO: 38301 - protein, 162 aa, Diabrotica virgifera
  misc_feature: Coding regions on vcDNA: vcDNA=SeqID_17998; Strand=-; Position=258-746
  misc_feature (5)..(5): Xaa can be any naturally occurring amino acid
  misc_feature (7)..(25): Xaa can be any naturally occurring amino acid
  misc_feature (29)..(85): Xaa can be any naturally occurring amino acid
  misc_feature (91)..(123): Xaa can be any naturally occurring amino acid
  misc_feature (127)..(134): Xaa can be any naturally occurring amino acid
  misc_feature (137)..(149): Xaa can be any naturally occurring amino acid
QKYRXHXXXXXXXXXXXXXXXXXXXYKQXXXXXXXXXXXXXXXXXXXXXXXXXXXXXXXXXXXXXXXXXXXXXXXXXXXXXXXXXPYFEMXXXXXXXXXXXXXXXXXXXXXXXXXXXXXXXXXYEKXXXXXXXXRNXXXXXXXXXXXXXKNELTFRLRRKFI

SEQ ID NO: 38302 - protein, 161 aa, Diabrotica virgifera
  misc_feature: Coding regions on vcDNA: vcDNA=SeqID_17999; Strand=-; Position=326-811
  misc_feature (24)..(32): Xaa can be any naturally occurring amino acid
  misc_feature (43)..(56): Xaa can be any naturally occurring amino acid
  misc_feature (61)..(87): Xaa can be any naturally occurring amino acid
  misc_feature (91)..(113): Xaa can be any naturally occurring amino acid
  misc_feature (118)..(145): Xaa can be any naturally occurring amino acid
INDRTQAGWLRFKLRSCKILRVEXXXXXXXXXNYKLYPTSRSXXXXXXXXXXXXXXVIHKXXXXXXXXXXXXXXXXXXXXXXXXXXXFNLXXXXXXXXXXXXXXXXXXXXXXXSIGCXXXXXXXXXXXXXXXXXXXXXXXXXXXXNPSLQLSIKKLMIMVP

SEQ ID NO: 38303 - protein, 65 aa, Diabrotica virgifera
  misc_feature: Coding regions on vcDNA: vcDNA=SeqID_18000; Strand=+; Position=2-196
  misc_feature (3)..(11): Xaa can be any naturally occurring amino acid
ARXXXXXXXXXPLLRRCMTDLHLPIAKEEGRLPMMLVQRKQLRRAYRDARRTRNVLYYVSSHFRI

SEQ ID NO: 38304 - protein, 266 aa, Diabrotica virgifera
  misc_feature: Coding regions on vcDNA: vcDNA=SeqID_18001; Strand=+; Position=26-823
  misc_feature: Homolog annotation: Hit_ID=NP_523706.1; Match level="QueryCoverage =92%, HitCoverage=21%, E-value=1e-94, Identity=68%"; Hit description =CG8344-PA [Drosophila melanogaster] gb|AAF58590.1| CG8344-PA [Drosophila melanogaster]
  misc_feature: Gene Ontology Annotation: Molecular function=DNA-directed RNA polymerase activity; Cellular component=DNA-directed RNA polymerase III complex; Biological process=transcription from Pol III promoter
  misc_feature: Pfam annotation: Pfam_ID=RNA_pol_Rpb2_1; Match level="Score=99.7, E -value=7.6e-27, Copies=1"; Pfam description=RNA polymerase beta subunit
  misc_feature (69)..(74): Xaa can be any naturally occurring amino acid
  misc_feature (226)..(226): Xaa can be any naturally occurring amino acid
MKEKESYEHVYGDPKQYHMPIKEIEEKWKLVPAFLKIRGLVKQHIDSFNYFIAVEIKKIVEANNKVTCXXXXXXYIKYTNVQVGTPDVDEGFNISKPTTPHECRLRDMTYSAPITVDIEYTRGSQRLSKTGLLIGRMPIMLKSSNCVLSGKSEYELAKMNECPLDPGGYFVVKGQEKVILIQEQLTKNRMLVEEGKYGVQCQVTSSTHEKKSRTNVFVKGNKYYVXHNTFTDPILVSVVFKALNIINDQEICELIGNNDIHNLTPT

SEQ ID NO: 38305 - protein, 260 aa, Diabrotica virgifera
  misc_feature: Coding regions on vcDNA: vcDNA=SeqID_18002; Strand=+; Position=3-785
  misc_feature (1)..(14): Xaa can be any naturally occurring amino acid
  misc_feature (27)..(42): Xaa can be any naturally occurring amino acid
  misc_feature (48)..(228): Xaa can be any naturally occurring amino acid
  misc_feature (231)..(242): Xaa can be any naturally occurring amino acid
XXXXXXXXXXXXXXESFSLIDSLITYXXXXXXXXXXXXXXXXTFVYRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCAXXXXXXXXXXXXYFIESWNEGLDEKKTVFI

SEQ ID NO: 38306 - protein, 260 aa, Diabrotica virgifera
  misc_feature: Coding regions on vcDNA: vcDNA=SeqID_18003; Strand=+; Position=1-780
  misc_feature (1)..(30): Xaa can be any naturally occurring amino acid
  misc_feature (33)..(259): Xaa can be any naturally occurring amino acid
XXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXA

SEQ ID NO: 38307 - protein, 98 aa, Diabrotica virgifera
  misc_feature: Coding regions on vcDNA: vcDNA=SeqID_18004; Strand=-; Position=513-809
  misc_feature (10)..(10): Xaa can be any naturally occurring amino acid
  misc_feature (19)..(20): Xaa can be any naturally occurring amino acid
QKNVIIFYLXRIILQNPIXXRKETFKGIQKCTAFSIKKNISLCHPVNTDTPVYLKIFLDYGTMCTPNFYLNNLFSYLLQQTVIGLCHTNAPTLYVCEL

SEQ ID NO: 38308 - protein, 137 aa, Diabrotica virgifera
  misc_feature: Coding regions on vcDNA: vcDNA=SeqID_18005; Strand=+; Position=1-413
  misc_feature: Homolog annotation: Hit_ID=AAO32817.1; Match level="QueryCoverage =95%, HitCoverage=43%, E-value=1e-25, Identity=49%"; Hit description =ADP/ATP translocase [Bombyx mori]
  misc_feature: Gene Ontology Annotation: Molecular function=transporter activity; Cellular component=integral to plasma membrane; Biological process =transport
  misc_feature (19)..(19): Xaa can be any naturally occurring amino acid
  misc_feature (52)..(52): Xaa can be any naturally occurring amino acid
  misc_feature (82)..(82): Xaa can be any naturally occurring amino acid
  misc_feature (97)..(97): Xaa can be any naturally occurring amino acid
QNLLDDGLLGLYRVLGVSXTSIIIYRVDFFVFYNTVEFILPDPKKTPLESTXNIAQNENTVAVIITYPFDTVRTGMMMYYGXIKYRNHLLNHRSLMXTNAKTEGTDVYFKKAFSNALLMTVADIVLLMCDKVRNLIE

SEQ ID NO: 38309 - protein, 113 aa, Diabrotica virgifera
  misc_feature: Coding regions on vcDNA: vcDNA=SeqID_18006; Strand=-; Position=104-445
  misc_feature (68)..(76): Xaa can be any naturally occurring amino acid
KGYPKSRRYQSYSNIFLLKDFETYQILVPVIRNGTFHGPRFIAPVSIPPIHPQSISPPSYLAFPRIPXXXXXXXXXVTVENSEIYQIAINRLAMNRPASASTWRHRNGGDETS

SEQ ID NO: 38310 - protein, 116 aa, Diabrotica virgifera
  misc_feature: Coding regions on vcDNA: vcDNA=SeqID_18007; Strand=-; Position=0-347
LFINCPQCSGSQTKRNRKKCFKQNLFHNKKRRKNRLPNPNPTNENSGYCKTSAQRKFQIAKISIFRSFIDRNSASARANEPHEVSLQSSTKKLPNEVCQIIRSPPVSRLYPLEATT

SEQ ID NO: 38311 - protein, 80 aa, Diabrotica virgifera
  misc_feature: Coding regions on vcDNA: vcDNA=SeqID_18008; Strand=+; Position=498-740
RCTQVCVYLITHWSPFQNLPCPSPVLKVCYSTVHESMSRQQYALNAHKPDLDLLRRTSSSNTIDEGRQSSYLFGLKSNVE

SEQ ID NO: 38312 - protein, 44 aa, Diabrotica virgifera
  misc_feature: Coding regions on vcDNA: vcDNA=SeqID_18009; Strand=-; Position=2-133
  misc_feature (1)..(8): Xaa can be any naturally occurring amino acid
  misc_feature (23)..(23): Xaa can be any naturally occurring amino acid
  misc_feature (30)..(43): Xaa can be any naturally occurring amino acid
XXXXXXXXSNRLNYIAATPIINXNPPSRSXXXXXXXXXXXXXXV

SEQ ID NO: 38313 - protein, 91 aa, Diabrotica virgifera
  misc_feature: Coding regions on vcDNA: vcDNA=SeqID_18010; Strand=-; Position=463-738
  misc_feature (1)..(7): Xaa can be any naturally occurring amino acid
  misc_feature (15)..(25): Xaa can be any naturally occurring amino acid
  misc_feature (56)..(65): Xaa can be any naturally occurring amino acid
XXXXXXXQPFLPTFXXXXXXXXXXXPGPKYPGLPNYPVGRRAFLFIRKAVFLLPGXXXXXXXXXXKPILFLLNDTIFLITDYYPIRLLKFE

SEQ ID NO: 38314 - protein, 60 aa, Diabrotica virgifera
  misc_feature: Coding regions on vcDNA: vcDNA=SeqID_18011; Strand=-; Position=2-181
FLIYDDEYNYLHSCSCGKNNSSKIYIKQKLFSSKVATKIKFAVANLGLFFSPRIIRIHNL

SEQ ID NO: 38315 - protein, 185 aa, Diabrotica virgifera
  misc_feature: Coding regions on vcDNA: vcDNA=SeqID_18012; Strand=+; Position=173-730
  misc_feature: Homolog annotation: Hit_ID=EAL33124.1; Match level="QueryCoverage =78%, HitCoverage=34%, E-value=8e-19, Identity=36%"; Hit description =GA19813-PA [Drosophila pseudoobscura]
  misc_feature: Gene Ontology Annotation: Cellular component=nucleus; Biological process=N signaling pathway
  misc_feature (51)..(51): Xaa can be any naturally occurring amino acid
  misc_feature (82)..(82): Xaa can be any naturally occurring amino acid
  misc_feature (90)..(90): Xaa can be any naturally occurring amino acid
  misc_feature (125)..(125): Xaa can be any naturally occurring amino acid
MQSQTCPFLWSPAICANSLCELLIQLLMDSNSDFLKPFYFDFLSIDKLIKXPLIDLLRYRNESTETTVDDEYLKRTPAPEPXDSLLHDDXLCDIETSQNCILTECYDYSCKYMSTSWKNNYLCEXHIHVLMAGSCIDKTDPSRVFIIVSHDLTKLMWSFEPGTDNVVPQAVLIFHERGIDSVVVS

SEQ ID NO: 38316 - protein, 269 aa, Diabrotica virgifera
  misc_feature: Coding regions on vcDNA: vcDNA=SeqID_18013; Strand=-; Position=1-807
  misc_feature (1)..(23): Xaa can be any naturally occurring amino acid
  misc_feature (26)..(211): Xaa can be any naturally occurring amino acid
  misc_feature (214)..(252): Xaa can be any naturally occurring amino acid
  misc_feature (255)..(263): Xaa can be any naturally occurring amino acid
  misc_feature (265)..(269): Xaa can be any naturally occurring amino acid
XXXXXXXXXXXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXRYXXXXXXXXXMXXXXX

SEQ ID NO: 38317 - protein, 82 aa, Diabrotica virgifera
  misc_feature: Coding regions on vcDNA: vcDNA=SeqID_18014; Strand=-; Position=204-452
  misc_feature (3)..(19): Xaa can be any naturally occurring amino acid
  misc_feature (21)..(27): Xaa can be any naturally occurring amino acid
  misc_feature (30)..(36): Xaa can be any naturally occurring amino acid
  misc_feature (39)..(49): Xaa can be any naturally occurring amino acid
NYXXXXXXXXXXXXXXXXXEXXXXXXXDPXXXXXXXLVXXXXXXXXXXXSRFNLFLKRLEYIEERVNDFDYEENYLGLFILR

SEQ ID NO: 38318 - protein, 115 aa, Diabrotica virgifera
  misc_feature: Coding regions on vcDNA: vcDNA=SeqID_18015; Strand=+; Position=392-739
  misc_feature (2)..(8): Xaa can be any naturally occurring amino acid
  misc_feature (10)..(32): Xaa can be any naturally occurring amino acid
  misc_feature (52)..(59): Xaa can be any naturally occurring amino acid
  misc_feature (71)..(77): Xaa can be any naturally occurring amino acid
  misc_feature (82)..(93): Xaa can be any naturally occurring amino acid
  misc_feature (105)..(114): Xaa can be any naturally occurring amino acid
GXXXXXXXLXXXXXXXXXXXXXXXXXXXXXXXVNNSFSHIIIFTFHQIFFIXXXXXXXXLKLSNRMDNIQXXXXXXXVKIIXXXXXXXXXXXXHPVIKKHGFLVXXXXXXXXXXD

SEQ ID NO: 38319 - protein, 86 aa, Diabrotica virgifera
  misc_feature: Coding regions on vcDNA: vcDNA=SeqID_18016; Strand=+; Position=386-646
LLPWDMFELTNNCNVEPNLSYLFLKSLSKLNDNIKKYFPSLDTSLINWVRNPYIESSYDTALFTTDEEGELIDIKTTVDLNLSTVN

SEQ ID NO: 38320 - protein, 276 aa, Diabrotica virgifera
  misc_feature: Coding regions on vcDNA: vcDNA=SeqID_18017; Strand=-; Position=1-828
  misc_feature (1)..(27): Xaa can be any naturally occurring amino acid
  misc_feature (29)..(253): Xaa can be any naturally occurring amino acid
  misc_feature (255)..(276): Xaa can be any naturally occurring amino acid
XXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXX

SEQ ID NO: 38321 - protein, 58 aa, Diabrotica virgifera; identical to SEQ ID NO: 35188
  misc_feature: Coding regions on vcDNA: vcDNA=SeqID_18018; Strand=+; Position=1-174
  misc_feature (1)..(15): Xaa can be any naturally occurring amino acid
  misc_feature (18)..(55): Xaa can be any naturally occurring amino acid

SEQ ID NO: 38322 - protein, 94 aa, Diabrotica virgifera
  misc_feature: Coding regions on vcDNA: vcDNA=SeqID_18019; Strand=+; Position=1-285
ELLEIYNRKRLRTKNGALFYIPFKHDEFINEKLNKLEILNAKSQTDYLISECLNLIELYYNMNNLILLLLLYIIFSGLFSDTQFKDDLKYKTHV

SEQ ID NO: 38323 - protein, 263 aa, Diabrotica virgifera
  misc_feature: Coding regions on vcDNA: vcDNA=SeqID_18020; Strand=-; Position=1-789
  misc_feature (9)..(18): Xaa can be any naturally occurring amino acid
  misc_feature (24)..(241): Xaa can be any naturally occurring amino acid
  misc_feature (243)..(263): Xaa can be any naturally occurring amino acid
FINSIGSLXXXXXXXXXXKINSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXX

SEQ ID NO: 38324 - protein, 62 aa, Diabrotica virgifera
  misc_feature: Coding regions on vcDNA: vcDNA=SeqID_18021; Strand=-; Position=185-373
  misc_feature (37)..(47): Xaa can be any naturally occurring amino acid
PILTSTSNINLRNISINIYLGNNRILLCSVHLSLCQXXXXXXXXXXXYTTSLFYYYNITVYF

SEQ ID NO: 38325 - protein, 43 aa, Diabrotica virgifera
  misc_feature: Coding regions on vcDNA: vcDNA=SeqID_18022; Strand=-; Position=107-238
SYLYSNKITFSSSIISRDTYYICAPLQLVVAAAQAYIKLIFFT

SEQ ID NO: 38326 - protein, 65 aa, Diabrotica virgifera
  misc_feature: Coding regions on vcDNA: vcDNA=SeqID_18023; Strand=+; Position=356-550
FSSAVSKDDPNSLQDLTCETDETNTCYSTSKLTVLAFLFLVLSTLLYILKMKISLHLSYETTINI

SEQ ID NO: 38327 - protein, 94 aa, Diabrotica virgifera
  misc_feature: Coding regions on vcDNA: vcDNA=SeqID_18024; Strand=+; Position=300-584
  misc_feature (43)..(48): Xaa can be any naturally occurring amino acid
  misc_feature (74)..(85): Xaa can be any naturally occurring amino acid
YLSLPGFLVEKLCYCLSCNDSYCCCRSHQKGNARYKHCLFRSXXXXXXQILLILTVLSYLPILLSRQLWQLHQXXXXXXXXXXXXQGISRFHSS

SEQ ID NO: 38328 - protein, 64 aa, Diabrotica virgifera
  misc_feature: Coding regions on vcDNA: vcDNA=SeqID_18025; Strand=-; Position=175-369
THTLSLLSLFFYIQISNYLCIANSINHHSFPHKLDIFNIPLRFVHENNIQNVKCTINIAPSLLE

SEQ ID NO: 38329 - protein, 90 aa, Diabrotica virgifera
  misc_feature: Coding regions on vcDNA: vcDNA=SeqID_18026; Strand=-; Position=3-275
  misc_feature (66)..(75): Xaa can be any naturally occurring amino acid
HKSNRNYSKSECWISIASFSYLDWHSVTHIGIIVNRKRPLLFGALRRRWQHHMQSKVSVLCEEFVXXXXXXXXXXVLVKFGKFNITSQQE

SEQ ID NO: 38330 - protein, 212 aa, Diabrotica virgifera
  misc_feature: Coding regions on vcDNA: vcDNA=SeqID_18027; Strand=+; Position=152-786
  misc_feature: Homolog annotation: Hit_ID=AAH11887.2; Match level="QueryCoverage =88%, HitCoverage=63%, E-value=7e-53, Identity=45%"; Hit description =ZNF3 protein [Homo sapiens] sp|P17036|ZN38_HUMAN Zinc finger protein 38 (Zinc finger protein KOX25) (Zinc
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=176.9, E-value =4.4e-50, Copies=6"; Pfam description=Zinc finger, C2H2 type
  misc_feature (189)..(189): Xaa can be any naturally occurring amino acid
MNLKSLSVSCEDMQNDALNLLNGTGNTLNQNVAATTDVKIEENPFRCEFCSKQLTRSSSLKRHMLVHSGERPFTCDLCNKQFSTNSHLTRHMRVHTGEKPFECKICTKQFSMKHALKSHMTVHTGEKPFRCEICSKQFSTNTLLTEHRRVHTGEKPFTCTICTKQFSNSSNLTHHLKTHTGERPFACEXCNKSFTQFVRQVHMRVHTGEKSA

SEQ ID NO: 38331 - protein, 275 aa, Diabrotica virgifera
  misc_feature: Coding regions on vcDNA: vcDNA=SeqID_18028; Strand=+; Position=95-919
  misc_feature (18)..(28): Xaa can be any naturally occurring amino acid
  misc_feature (32)..(56): Xaa can be any naturally occurring amino acid
  misc_feature (64)..(110): Xaa can be any naturally occurring amino acid
  misc_feature (144)..(204): Xaa can be any naturally occurring amino acid
  misc_feature (206)..(260): Xaa can be any naturally occurring amino acid
  misc_feature (267)..(275): Xaa can be any naturally occurring amino acid
ENISSFLKEKFISLRTSXXXXXXXXXXXSFIXXXXXXXXXXXXXXXXXXXXXXXXXNETLFVFXXXXXXXXXXXXXXXXXXXXXXXXXXXXXXXXXXXXXXXXXXXXXXXLNQKFRIQNILHHFQNIGYSLHFSSSFILFSFFXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXTRKTYRXXXXXXXXX

SEQ ID NO: 38332 - protein, 100 aa, Diabrotica virgifera
  misc_feature: Coding regions on vcDNA: vcDNA=SeqID_18029; Strand=+; Position=43-345
  misc_feature (49)..(70): Xaa can be any naturally occurring amino acid
KVIEKFFISNDQFNSVSVRESLSLSKRKISPSVPPCIRDSQLIILYSSXXXXXXXXXXXXXXXXXXXXXXLSVIEIVISVFQIISQFFQENKFKFILSKQ

SEQ ID NO: 38333 - protein, 82 aa, Diabrotica virgifera
  misc_feature: Coding regions on vcDNA: vcDNA=SeqID_18030; Strand=-; Position=1-246
  misc_feature (1)..(82): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38334 - protein, 171 aa, Diabrotica virgifera; identical to SEQ ID NO: 27583
  misc_feature: Coding regions on vcDNA: vcDNA=SeqID_18031; Strand=-; Position=62-577
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 38335 - protein, 75 aa, Diabrotica virgifera
  misc_feature: Coding regions on vcDNA: vcDNA=SeqID_18032; Strand=+; Position=184-411
  misc_feature (39)..(45): Xaa can be any naturally occurring amino acid
NNTKNYKSRNSIDCIYSLLVPIICRCRLLYHRKNMNCKXXXXXXXFLSPKNHHARFTYVHPRKDSPKMVKWLANV

SEQ ID NO: 38336 - protein, 53 aa, Diabrotica virgifera
  misc_feature: Coding regions on vcDNA: vcDNA=SeqID_18033; Strand=+; Position=517-674
  misc_feature: Homolog annotation: Hit_ID=CAC12696.1; Match level="QueryCoverage =94%, HitCoverage=12%, E-value=4e-13, Identity=70%"; Hit description =prophenoloxidase activating factor [Tenebrio molitor]
  misc_feature (30)..(30): Xaa can be any naturally occurring amino acid
APYYLCNNESINTNEYGIIDIIINEGSCDXQYIDVCWDKTTTVDEPITPTPHT

SEQ ID NO: 38337 - protein, 58 aa, Diabrotica virgifera
  misc_feature: Coding regions on vcDNA: vcDNA=SeqID_18034; Strand=-; Position=95-271
SNRVSVGLSKQYSYAIKKYIKFYDNTMDNAFSKLTKINCIQHIDRFTTLMINCIGTIQ

SEQ ID NO: 38338 - protein, 87 aa, Diabrotica virgifera
  misc_feature: Coding regions on vcDNA: vcDNA=SeqID_18035; Strand=+; Position=1-264
RPRDRTWNDIFIILRGFLLRHCDVSYSFRTYDTCNTICFIISFSFLPKIQTNSIHCRDIICPKRYQKLCFAIILQMTLNLQENCGER

SEQ ID NO: 38339 - protein, 81 aa, Diabrotica virgifera
  misc_feature: Coding regions on vcDNA: vcDNA=SeqID_18036; Strand=-; Position=82-327
FCFSYQTILQRACSVRQPCRPLPRLIYARTGRARYVNNRAHIAAGPRSRPVPLYDKLTNAIRIRRFFNVPRKTAVSSTSPS

SEQ ID NO: 38340 - protein, 131 aa, Diabrotica virgifera
  misc_feature: Coding regions on vcDNA: vcDNA=SeqID_18037; Strand=+; Position=388-780
  misc_feature (9)..(16): Xaa can be any naturally occurring amino acid
  misc_feature (18)..(32): Xaa can be any naturally occurring amino acid
  misc_feature (53)..(64): Xaa can be any naturally occurring amino acid
  misc_feature (66)..(93): Xaa can be any naturally occurring amino acid
  misc_feature (101)..(128): Xaa can be any naturally occurring amino acid
ISKYLSQGXXXXXXXXLXXXXXXXXXXXXXXXFKIRYHSFSHIIIFIFLNFFXXXXXXXXXXXXRXXXXXXXXXXXXXXXXXXXXXXXXXXXXFLKTRLFXXXXXXXXXXXXXXXXXXXXXXXXXXXXSFF

SEQ ID NO: 38341 - protein, 250 aa, Diabrotica virgifera
  misc_feature: Coding regions on vcDNA: vcDNA=SeqID_18038; Strand=-; Position=1-750
  misc_feature (2)..(228): Xaa can be any naturally occurring amino acid
  misc_feature (230)..(250): Xaa can be any naturally occurring amino acid
AXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXX

SEQ ID NO: 38342 - protein, 73 aa, Diabrotica virgifera
  misc_feature: Coding regions on vcDNA: vcDNA=SeqID_18039; Strand=+; Position=351-572
  misc_feature: Homolog annotation: Hit_ID=XP_393608.1; Match level="QueryCoverage =87%, HitCoverage=20%, E-value=1e-15, Identity=55%"; Hit description =similar to CG7192-PA [Apis mellifera]
MLKSSVQHKILNYLPDDRPITAIQIIENLDKCPRGFFAINKTYDQDSDGDLRESSIFKSSSARYLCLSKTEVD

SEQ ID NO: 38343 - protein, 19 aa, Diabrotica virgifera
  misc_feature: Coding regions on vcDNA: vcDNA=SeqID_18040; Strand=-; Position=1-57
  misc_feature (11)..(11): Xaa can be any naturally occurring amino acid
  misc_feature (13)..(13): Xaa can be any naturally occurring amino acid
IEVAIFIIDLXSXNKITLL

SEQ ID NO: 38344 - protein, 238 aa, Diabrotica virgifera
  misc_feature: Coding regions on vcDNA: vcDNA=SeqID_18041; Strand=+; Position=1-714
  misc_feature (1)..(16): Xaa can be any naturally occurring amino acid
  misc_feature (18)..(222): Xaa can be any naturally occurring amino acid
  misc_feature (225)..(233): Xaa can be any naturally occurring amino acid
  misc_feature (236)..(236): Xaa can be any naturally occurring amino acid
XXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGXXXXXXXXXYLXKI

SEQ ID NO: 38345 - protein, 165 aa, Diabrotica virgifera
  misc_feature: Coding regions on vcDNA: vcDNA=SeqID_18042; Strand=+; Position=71-568
  misc_feature: Homolog annotation: Hit_ID=EAL25466.1; Match level="QueryCoverage =100%, HitCoverage=100%, E-value=2e-70, Identity=78%"; Hit description=GA16582-PA [Drosophila pseudoobscura]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11; Match level="Score=93.0, E -value=7.8e-25, Copies=1"; Pfam description=Ribosomal protein L11, RNA binding do
  misc_feature (60)..(71): Xaa can be any naturally occurring amino acid
MPPKFDPTEIKYVYMRCVGGEVGATSSLAPKIGPLGLSPKKVGDDIAKGTADWKGLKITXXXXXXXXXXXXSVVPSASSLIIRALKEPPRDRKKQKNIKHTGNITFDEIIAIARQMRPRSMAKQLSGTVKEVLGTAQSVGCTIDGKAAHDVIDEVNEGTIEVPDE

SEQ ID NO: 38346 - protein, 132 aa, Diabrotica virgifera
  misc_feature: Coding regions on vcDNA: vcDNA=SeqID_18043; Strand=+; Position=2-397
  misc_feature: Homolog annotation: Hit_ID=AAV34687.1; Match level="QueryCoverage =72%, HitCoverage=87%, E-value=3e-16, Identity=41%"; Hit description =chemosensory protein 2 [Heliothis virescens]
  misc_feature: Gene Ontology Annotation: Molecular function=structural molecule activity; Cellular component=extracellular; Biological process=post -mating behavior
  misc_feature: Pfam annotation: Pfam_ID=OS-D; Match level="Score=40.2, E-value=1.5e -10, Copies=1"; Pfam description=Insect pheromone-binding family, A10/
GVVLGAPEKSFEENLAILRKINLDEVLPNDRLVKSFVDCMCGTKTCTHEGTALKATWKQLLDNRCKEKCTEEDKTKVKQVIKHLYVKHRNWWDELAAQLDKDEEYRNKYKKQLEAIVNDDSIKPSLICGEYL

SEQ ID NO: 38347 - protein, 129 aa, Diabrotica virgifera
  misc_feature: Coding regions on vcDNA: vcDNA=SeqID_18044; Strand=-; Position=156-545
  misc_feature (60)..(68): Xaa can be any naturally occurring amino acid
SIHRFVTNSIYLCSLSKVREDEKAQYSEIPLSRDTTFRIDIRDMNTTPRLQRHRITIPPXXXXXXXXXWTRTNLCIYPCFITFLVSCTTSFLLVSRDRFVTTYGSQRITAGIGRSSLFPSSAYPIVSKQ

SEQ ID NO: 38348 - protein, 154 aa, Diabrotica virgifera
  misc_feature: Coding regions on vcDNA: vcDNA=SeqID_18045; Strand=+; Position=448-909
RNHSFDGPRTQRIFHLKKQSVTRVHSQGSNSWLVLHSFGSSGTRWKFRSRYFQRKGQTRWNTLLSSAFHPSVVKQLLGWVVNKRDSTEPASQWNHVSRKIKKEVFSYIQENWVTTQPPLVFVPIFRMCTGDNMVRRDLDKKAMGSRGWAKSNGK

SEQ ID NO: 38349 - protein, 25 aa, Diabrotica virgifera
  misc_feature: Coding regions on vcDNA: vcDNA=SeqID_18046; Strand=+; Position=1-75
  misc_feature (3)..(23): Xaa can be any naturally occurring amino acid
HLXXXXXXXXXXXXXXXXXXXXXYL

SEQ ID NO: 38350 - protein, 109 aa, Diabrotica virgifera
  misc_feature: Coding regions on vcDNA: vcDNA=SeqID_18047; Strand=-; Position=19-348
PDSERKSLGSPPRELGIPDTEIMFHRVDDWTDPSARSRTRCEIDRYLGFGEMRFLNIARFECHCRDVVVLTKMAAAMPDDDWKASAGIGEVDPFGHPRPRAENFVNLAP

SEQ ID NO: 38351 - protein, 123 aa, Diabrotica virgifera
  misc_feature: Coding regions on vcDNA: vcDNA=SeqID_18048; Strand=+; Position=582-950
  misc_feature (23)..(31): Xaa can be any naturally occurring amino acid
  misc_feature (35)..(52): Xaa can be any naturally occurring amino acid
  misc_feature (61)..(68): Xaa can be any naturally occurring amino acid
  misc_feature (71)..(85): Xaa can be any naturally occurring amino acid
  misc_feature (87)..(116): Xaa can be any naturally occurring amino acid
  misc_feature (121)..(121): Xaa can be any naturally occurring amino acid
FLIFQNFFSKIIKFKFILNLSNXXXXXXXXXRIFXXXXXXXXXXXXXXXXXXVNKNMVFFXXXXXXXXATXXXXXXXXXXXXXXXNXXXXXXXXXXXXXXXXXXXXXXXXXXXXXXVKSLXFF

SEQ ID NO: 38352 - protein, 68 aa, Diabrotica virgifera
  misc_feature: Coding regions on vcDNA: vcDNA=SeqID_18049; Strand=+; Position=204-410
  misc_feature (28)..(52): Xaa can be any naturally occurring amino acid
LIPRQKPHTPKTTNSESLSHLSERKGRXXXXXXXXXXXXXXXXXXXXXXXXXLRRNTNTLHVLRKLKS

SEQ ID NO: 38353 - protein, 247 aa, Diabrotica virgifera
  misc_feature: Coding regions on vcDNA: vcDNA=SeqID_18050; Strand=+; Position=1-744
  misc_feature (7)..(16): Xaa can be any naturally occurring amino acid
  misc_feature (19)..(29): Xaa can be any naturally occurring amino acid
  misc_feature (31)..(45): Xaa can be any naturally occurring amino acid
  misc_feature (47)..(56): Xaa can be any naturally occurring amino acid
  misc_feature (61)..(121): Xaa can be any naturally occurring amino acid
  misc_feature (135)..(246): Xaa can be any naturally occurring amino acid
RERIIFXXXXXXXXXXYLXXXXXXXXXXXHXXXXXXXXXXXXXXXHXXXXXXXXXXVIEIXXXXXXXXXXXXXXXXXXXXXXXXXXXXXXXXXXXXXXXXXXXXXXXXXXXXXXXXXXXXXFKIRYYLSFHILFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 38354 - protein, 70 aa, Diabrotica virgifera
  misc_feature: Coding regions on vcDNA: vcDNA=SeqID_18051; Strand=-; Position=1-210
  misc_feature (1)..(6): Xaa can be any naturally occurring amino acid
  misc_feature (8)..(19): Xaa can be any naturally occurring amino acid
  misc_feature (28)..(44): Xaa can be any naturally occurring amino acid
  misc_feature (47)..(70): Xaa can be any naturally occurring amino acid
XXXXXXHXXXXXXXXXXXXSSGKKISAXXXXXXXXXXXXXXXXXVMXXXXXXXXXXXXXXXXXXXXXXXX

SEQ ID NO: 38355 - protein, 294 aa, Diabrotica virgifera
  misc_feature: Coding regions on vcDNA: vcDNA=SeqID_18052; Strand=+; Position=1-885
  misc_feature (7)..(32): Xaa can be any naturally occurring amino acid
  misc_feature (35)..(162): Xaa can be any naturally occurring amino acid
  misc_feature (165)..(172): Xaa can be any naturally occurring amino acid
  misc_feature (180)..(285): Xaa can be any naturally occurring amino acid
  misc_feature (291)..(291): Xaa can be any naturally occurring amino acid
NNYIIYXXXXXXXXXXXXXXXXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSFXXXXXXXXRPPINLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEIITLXDTA

SEQ ID NO: 38356 - protein, 83 aa, Diabrotica virgifera
  misc_feature: Coding regions on vcDNA: vcDNA=SeqID_18053; Strand=-; Position=128-379
GRLCLRSSHDEKAFLPINYTANCHLSKLLLIVYVVKNLSLNIFLINNSIKITIWLKKCINNDLLFACYTPVLSNPFPRKFSPK

SEQ ID NO: 38357 - protein, 68 aa, Diabrotica virgifera
  misc_feature: Coding regions on vcDNA: vcDNA=SeqID_18054; Strand=-; Position=298-504
QVHKYIYVGSEELCPRYLDFTNENSDYALTIKNEEQTGFYTGLMFFQESKYKTLTFIQLKSFQRYVMF

SEQ ID NO: 38358 - protein, 146 aa, Diabrotica virgifera
  misc_feature: Coding regions on vcDNA: vcDNA=SeqID_18055; Strand=+; Position=113-550
  misc_feature (16)..(125): Xaa can be any naturally occurring amino acid
LMITSAWRIRDNNLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFDYKITRNHHIASNDDSSSI

SEQ ID NO: 38359 - protein, 190 aa, Diabrotica virgifera
  misc_feature: Coding regions on vcDNA: vcDNA=SeqID_18056; Strand=+; Position=381-953
  misc_feature (60)..(106): Xaa can be any naturally occurring amino acid
  misc_feature (111)..(189): Xaa can be any naturally occurring amino acid
SRIIFLKGSELSNNQISFNLKISIFSNQKFRIQIISHNLSKYRLSNLNFSSSLIIFLFFXXXXXXXXXXXXXXXXXXXXXXXXXXXXXXXXXXXXXXXXXXXXXXXLLKTXXXXXXXXXXXXXXXXXXXXXXXXXXXXXXXXXXXXXXXXXXXXXXXXXXXXXXXXXXXXXXXXXXXXXXXXXXXXXXXY

SEQ ID NO: 38360 - protein, 230 aa, Diabrotica virgifera
  misc_feature: Coding regions on vcDNA: vcDNA=SeqID_18057; Strand=+; Position=3-808
  misc_feature: Homolog annotation: Hit_ID=NP_861421.1; Match level="QueryCoverage =89%, HitCoverage=61%, E-value=4e-54, Identity=40%"; Hit description =zinc finger protein 233 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=115.7, E-value =1.1e-31, Copies=4"; Pfam description=Zinc finger, C2H2 type
KTEEIQEPKVICNELDLNEEHQTSQHGVLQSVVKTKSGKSLATDTRENSYKCETCLKEFSQEGRLKNHLRIHTGEKPFKCDICCKQFSQNEKSLTTYIRENSYKCETCLKEFSQEGNLKNHLRIHTGEKPFKCDICFKQFSQEGNLKNHLRIHTGKKPFKCDICCNQFSQNGHLKTHLRIHTGEEPQFSQNGHLKTHLRIHTGEEPYFSQNGQLKSHLRIHTGAKPYSLM

SEQ ID NO: 38361 - protein, 99 aa, Diabrotica virgifera
  misc_feature: Coding regions on vcDNA: vcDNA=SeqID_18058; Strand=-; Position=417-716
  misc_feature (93)..(99): Xaa can be any naturally occurring amino acid
RDLDRTMGVETHVTKRPRQIHTSKENLDKIYSNDHTITLKWKENCSLCGLTYRDFHYISRLEVYVFILTSISGLNHIFSHFYVHSQRKCYMSXXXXXXX

SEQ ID NO: 38362 - protein, 54 aa, Diabrotica virgifera
  misc_feature: Coding regions on vcDNA: vcDNA=SeqID_18059; Strand=+; Position=151-314
  misc_feature: Homolog annotation: Hit_ID=XP_393281.1; Match level="QueryCoverage =83%, HitCoverage=5%, E-value=2e-09, Identity=80%"; Hit description =similar to ENSANGP00000013163 [Apis mellifera]
  misc_feature (13)..(13): Xaa can be any naturally occurring amino acid
ENADLSVQVIQLXQKRLEEAEGGAECQFEINKKRDTEFARCFRKLTRRTYTYDV

SEQ ID NO: 38363 - protein, 37 aa, Diabrotica virgifera
  misc_feature: Coding regions on vcDNA: vcDNA=SeqID_18060; Strand=-; Position=88-201
YKRRDGSGFIWGRILLTGGTGPTGSYLLWRLLLIGLT

SEQ ID NO: 38364 - protein, 173 aa, Diabrotica virgifera
  misc_feature: Coding regions on vcDNA: vcDNA=SeqID_18061; Strand=-; Position=2-520
  misc_feature: Homolog annotation: Hit_ID=NP_922809.1; Match level="QueryCoverage =97%, HitCoverage=20%, E-value=2e-22, Identity=35%"; Hit description =putative transposase [Oryza sativa (japonica cultivar-group)] gb|AAP55096.1| putative
  misc_feature (47)..(47): Xaa can be any naturally occurring amino acid
  misc_feature (73)..(73): Xaa can be any naturally occurring amino acid
  misc_feature (144)..(150): Xaa can be any naturally occurring amino acid
RSYKKKQELTFRGRDESHNSSNMGNFKEIFNLVVKRDQEIQDHVKKXEGVFTGLSKTIQNDLIDCLADYVKKXISTEINESQFFSILADDTTDITEKSQCTLTIRFVNKVGQVTERFLGFFDVSDNRSADALYSLISNVLEPYXXXXXXXAQFYDGASVMAGSLNGLQSKIKV

SEQ ID NO: 38365 - protein, 135 aa, Diabrotica virgifera
  misc_feature: Coding regions on vcDNA: vcDNA=SeqID_18062; Strand=-; Position=378-785
  misc_feature (17)..(23): Xaa can be any naturally occurring amino acid
  misc_feature (31)..(38): Xaa can be any naturally occurring amino acid
  misc_feature (48)..(74): Xaa can be any naturally occurring amino acid
  misc_feature (82)..(88): Xaa can be any naturally occurring amino acid
  misc_feature (110)..(134): Xaa can be any naturally occurring amino acid
TLHSTSNKKLNDLLPYXXXXXXXIQFNPWAXXXXXXXXKRRVFINRVXXXXXXXXXXXXXXXXXXXXXXXXXXXIHYLNLKXXXXXXXEKFRKMKIMICENELLTYFENXXXXXXXXXXXXXXXXXXXXXXXXXP

SEQ ID NO: 38366 - protein, 44 aa, Diabrotica virgifera
  misc_feature: Coding regions on vcDNA: vcDNA=SeqID_18063; Strand=+; Position=559-693
RSYSLLPCEHRTHDTRARCTTLCYSTPSWRTYRCDDTGLNYKSE

SEQ ID NO: 38367 - protein, 66 aa, Diabrotica virgifera; identical to SEQ ID NO: 26808
  misc_feature: Coding regions on vcDNA: vcDNA=SeqID_18064; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38368 - protein, 26 aa, Diabrotica virgifera
  misc_feature: Coding regions on vcDNA: vcDNA=SeqID_18065; Strand=-; Position=5-85
  misc_feature (14)..(14): Xaa can be any naturally occurring amino acid
TLIHHRGRNLYYRXELSNKITLLSLR

SEQ ID NO: 38369 - protein, 18 aa, Diabrotica virgifera
  misc_feature: Coding regions on vcDNA: vcDNA=SeqID_18066; Strand=+; Position=1-54
  misc_feature (1)..(8): Xaa can be any naturally occurring amino acid
XXXXXXXXSTTPKIPTSH

SEQ ID NO: 38370 - protein, 260 aa, Diabrotica virgifera
  misc_feature: Coding regions on vcDNA: vcDNA=SeqID_18067; Strand=+; Position=50-828
  misc_feature: Homolog annotation: Hit_ID=XP_397379.1; Match level="QueryCoverage =88%, HitCoverage=38%, E-value=5e-79, Identity=61%"; Hit description =similar to ENSANGP00000011599 [Apis mellifera]
  misc_feature: Gene Ontology Annotation: Molecular function=acetate-CoA ligase activity; Cellular component=cytosol; Biological process=acetyl-CoA biosynthesis
  misc_feature (211)..(211): Xaa can be any naturally occurring amino acid
  misc_feature (222)..(222): Xaa can be any naturally occurring amino acid
  misc_feature (247)..(247): Xaa can be any naturally occurring amino acid
  misc_feature (254)..(254): Xaa can be any naturally occurring amino acid
MPEDTQSDVTLSNSSRTSVPFPLASYELEFAESIQHPERFWAKVGQYVTWSKPWKRVLDNTYEPFTKWFVGGELNACYNAVDRHVEAGKGDKVALIYDSPLLGIVRKITYFELQEKVSKLGGLLQRLGVSKGDKVIIYMPLIPETIMAMLAVARIGAVHSVVFGGFAANELCIRIQHAEPKVIIAASCGIEPSRVVNYITELNEAIALSSXQPSKCIIYQRXGVEIGDLDPDRDMDWEEKHQNCEVXPCIPVDXHDPLYI

SEQ ID NO: 38371 - protein, 50 aa, Diabrotica virgifera
  misc_feature: Coding regions on vcDNA: vcDNA=SeqID_18068; Strand=+; Position=84-236
KSNRLNNIAATPIINFNPTSRSVSLLWIRTLCYTFVGIPMLIDDNEIYVL

SEQ ID NO: 38372 - protein, 90 aa, Diabrotica virgifera
  misc_feature: Coding regions on vcDNA: vcDNA=SeqID_18069; Strand=-; Position=191-463
CTILECLPERRHHVSAIKLLVEFHDVQVLVMTRELDSHQVNLAMPNLYPKHISIFSEVTHRPLFDHPHENVTMVKRIIFHLITSFKNGCQ

SEQ ID NO: 38373 - protein, 105 aa, Diabrotica virgifera
  misc_feature: Coding regions on vcDNA: vcDNA=SeqID_18070; Strand=+; Position=210-527
  misc_feature (11)..(30): Xaa can be any naturally occurring amino acid
  misc_feature (32)..(38): Xaa can be any naturally occurring amino acid
  misc_feature (44)..(54): Xaa can be any naturally occurring amino acid
  misc_feature (59)..(84): Xaa can be any naturally occurring amino acid
  misc_feature (89)..(97): Xaa can be any naturally occurring amino acid
CYSVFKYYLIXXXXXXXXXXXXXXXXXXXXSXXXXXXXYELINXXXXXXXXXXXNRIIXXXXXXXXXXXXXXXXXXXXXXXXXXYQSIXXXXXXXXXIMITKLYI

SEQ ID NO: 38374 - protein, 93 aa, Diabrotica virgifera
  misc_feature: Coding regions on vcDNA: vcDNA=SeqID_18071; Strand=+; Position=618-896
  misc_feature (10)..(27): Xaa can be any naturally occurring amino acid
  misc_feature (35)..(42): Xaa can be any naturally occurring amino acid
  misc_feature (45)..(92): Xaa can be any naturally occurring amino acid
VSKKIRYHLXXXXXXXXXXXXXXXXXXLLKTGLFXXXXXXXXATXXXXXXXXXXXXXXXXXXXXXXXXXXXXXXXXXXXXXXXXXXXXXXXXS

SEQ ID NO: 38375 - protein, 278 aa, Diabrotica virgifera
  misc_feature: Coding regions on vcDNA: vcDNA=SeqID_18072; Strand=+; Position=76-909
  misc_feature (39)..(61): Xaa can be any naturally occurring amino acid
  misc_feature (66)..(127): Xaa can be any naturally occurring amino acid
  misc_feature (146)..(257): Xaa can be any naturally occurring amino acid
  misc_feature (260)..(271): Xaa can be any naturally occurring amino acid
  misc_feature (273)..(273): Xaa can be any naturally occurring amino acid
  misc_feature (275)..(276): Xaa can be any naturally occurring amino acid
FVSVERISFFLSQKKNSSLSVPRRIRDYLINNSSSFIIXXXXXXXXXXXXXXXXXXXXXXXRNRNXXXXXXXXXXXXXXXXXXXXXXXXXXXXXXXXXXXXXXXXXXXXXXXXXXXXXXXXXXXXXXILKYVIHLSFHHHYLFFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLXXXXXXXXXXXXYXLXXKA

SEQ ID NO: 38376 - protein, 82 aa, Diabrotica virgifera
  misc_feature: Coding regions on vcDNA: vcDNA=SeqID_18073; Strand=+; Position=4-252
IARYRESSRYTRIKSICFSPLVTQTAYPTKFIVISSVVPPLNANLLLNTATIIKMNIHPVHALELILTFHQMSSESHCTTTH

SEQ ID NO: 38377 - protein, 77 aa, Diabrotica virgifera
  misc_feature: Coding regions on vcDNA: vcDNA=SeqID_18074; Strand=+; Position=343-573
  misc_feature (52)..(59): Xaa can be any naturally occurring amino acid
ARLVKTEGWERKNSSKGPPNFNSWAVFLQRRDWKTLGVPHLNRFAELPLFPXXXXXXXXPPNLPSQKLPPLKGEGNP

SEQ ID NO: 38378 - protein, 312 aa, Diabrotica virgifera
  misc_feature: Coding regions on vcDNA: vcDNA=SeqID_18075; Strand=+; Position=3-938
  misc_feature (2)..(19): Xaa can be any naturally occurring amino acid
  misc_feature (44)..(54): Xaa can be any naturally occurring amino acid
  misc_feature (59)..(82): Xaa can be any naturally occurring amino acid
  misc_feature (85)..(261): Xaa can be any naturally occurring amino acid
  misc_feature (263)..(270): Xaa can be any naturally occurring amino acid
  misc_feature (272)..(310): Xaa can be any naturally occurring amino acid
LXXXXXXXXXXXXXXXXXXTIVNSYRERISLLFIKRKIHFSYLXXXXXXXXXXXSFIIXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXLXXXXXXXXXXXXXXXXXXXXXXXXXXXXXXXXXXXXXXXFF

SEQ ID NO: 38379 - protein, 90 aa, Diabrotica virgifera
  misc_feature: Coding regions on vcDNA: vcDNA=SeqID_18076; Strand=+; Position=1-273
  misc_feature: Homolog annotation: Hit_ID=AAU95193.1; Match level="QueryCoverage =75%, HitCoverage=22%, E-value=2e-12, Identity=55%"; Hit description =putative mitochondrial ADP/ATP translocase [Oncometopia nigricans]
  misc_feature (39)..(39): Xaa can be any naturally occurring amino acid
  misc_feature (78)..(78): Xaa can be any naturally occurring amino acid
VPLFVRYHILLRKVLHSSNNTYLADPVDFMKDFLAVDIXVAPPKTCVPPIERVKMLLEEQEISNEIGEDKPYEEMEEXFERILKEEGVVA

SEQ ID NO: 38380 - protein, 55 aa, Diabrotica virgifera
  misc_feature: Coding regions on vcDNA: vcDNA=SeqID_18077; Strand=-; Position=135-302
FITQFLVNIFSYIKKNLKTSHNTYQKSSLYNEIYKYKAKKISNTAKIRNVKYLKQ

SEQ ID NO: 38381 - protein, 17 aa, Diabrotica virgifera
  misc_feature: Coding regions on vcDNA: vcDNA=SeqID_18078; Strand=-; Position=1-51
  misc_feature (3)..(17): Xaa can be any naturally occurring amino acid
EVXXXXXXXXXXXXXXX

SEQ ID NO: 38382 - protein, 64 aa, Diabrotica virgifera
  misc_feature: Coding regions on vcDNA: vcDNA=SeqID_18079; Strand=-; Position=1-192
  misc_feature (4)..(41): Xaa can be any naturally occurring amino acid
  misc_feature (44)..(57): Xaa can be any naturally occurring amino acid
  misc_feature (59)..(64): Xaa can be any naturally occurring amino acid
TISXXXXXXXXXXXXXXXXXXXXXXXXXXXXXXXXXXXXXXEVXXXXXXXXXXXXXXTXXXXXX

SEQ ID NO: 38383 - protein, 56 aa, Diabrotica virgifera
  misc_feature: Coding regions on vcDNA: vcDNA=SeqID_18080; Strand=-; Position=2-169
  misc_feature (13)..(20): Xaa can be any naturally occurring amino acid
  misc_feature (23)..(30): Xaa can be any naturally occurring amino acid
  misc_feature (42)..(54): Xaa can be any naturally occurring amino acid
KDRNHPGLTRFKXXXXXXXXSTXXXXXXXXPIINLIQHRGPXXXXXXXXXXXXXAV

SEQ ID NO: 38384 - protein, 51 aa, Diabrotica virgifera
  misc_feature: Coding regions on vcDNA: vcDNA=SeqID_18081; Strand=-; Position=115-270
HFASKSIQLTSYFSLKLLLLFSTSPSKILNTYIFINIPSYTSLHKQITRWG

SEQ ID NO: 38385 - protein, 21 aa, Diabrotica virgifera
  misc_feature: Coding regions on vcDNA: vcDNA=SeqID_18082; Strand=+; Position=3-68
NQPGSHRFKLRSCKILKVEQT

SEQ ID NO: 38386 - protein, 294 aa, Diabrotica virgifera
  misc_feature: Coding regions on vcDNA: vcDNA=SeqID_18083; Strand=+; Position=81-962
  misc_feature: Homolog annotation: Hit_ID=XP_320530.1; Match level="QueryCoverage =98%, HitCoverage=42%, E-value=9e-90, Identity=56%"; Hit description =ENSANGP00000008671 [Anopheles gambiae]
  misc_feature: Gene Ontology Annotation: Molecular function=molecular_function unknown; Cellular component=cytosolic ribosome (sensu Eukarya); Biological process=response to stress
  misc_feature (215)..(227): Xaa can be any naturally occurring amino acid
  misc_feature (260)..(260): Xaa can be any naturally occurring amino acid
  misc_feature (277)..(277): Xaa can be any naturally occurring amino acid
MGTCSEYIKNVFPAIDEESKQYVEGVLLNGADDFEDSEEVYDAVGEVLKEISNDKSEDDIRNICNDLLCMLKPDKGEKATNGAMKVLNAPVHLGSMVDNTDTNIDDVKSIWLIQRDDSLKVDARKLEKAEAKLQEKLDKRTKEIKVIAPPKLQTATASQVTSKKDSKLEAKGTNRTQDIRIENFDVAYGDRVLLQGADLTLASGRRYGLVGRNGXXXXXXXXXXXXXQLRIPSHISILHVEQEVVGDDTVALDSVLECDXVPEEMLKKEKEISAAIXSGSVDPQLNSQLTEVYN

SEQ ID NO: 38387 - protein, 104 aa, Diabrotica virgifera
  misc_feature: Coding regions on vcDNA: vcDNA=SeqID_18084; Strand=+; Position=365-679
ALLSDIDIVTARRSLSCKRISSIAILFIVSSLVIVISSLSRMYLNISETTTYMYMSSIIPYMRYCSLRSVISFRHVLLRRTVIVVHLFTRVCHDQCYVLSNLCA

SEQ ID NO: 38388 - protein, 218 aa, Diabrotica virgifera
  misc_feature: Coding regions on vcDNA: vcDNA=SeqID_18085; Strand=+; Position=77-730
  misc_feature (24)..(29): Xaa can be any naturally occurring amino acid
  misc_feature (36)..(74): Xaa can be any naturally occurring amino acid
  misc_feature (77)..(137): Xaa can be any naturally occurring amino acid
  misc_feature (142)..(218): Xaa can be any naturally occurring amino acid
IILHLQSDQFNLSISSSRISLHFXXXXXXYLLPYLXXXXXXXXXXXXXXXXXXXXXXXXXXXXXXXXXXXXXXXETXXXXXXXXXXXXXXXXXXXXXXXXXXXXXXXXXXXXXXXXXXXXXXXXXXXXXXXXXXXXXILKYXXXXXXXXXXXXXXXXXXXXXXXXXXXXXXXXXXXXXXXXXXXXXXXXXXXXXXXXXXXXXXXXXXXXXXXXXXXXX

SEQ ID NO: 38389 - protein, 30 aa, Diabrotica virgifera
  misc_feature: Coding regions on vcDNA: vcDNA=SeqID_18086; Strand=+; Position=1-93
  misc_feature (3)..(10): Xaa can be any naturally occurring amino acid
  misc_feature (21)..(27): Xaa can be any naturally occurring amino acid
FLXXXXXXXXKVNLFMNNIIXXXXXXXDSY

SEQ ID NO: 38390 - protein, 257 aa, Diabrotica virgifera
  misc_feature: Coding regions on vcDNA: vcDNA=SeqID_18087; Strand=+; Position=64-834
  misc_feature: Homolog annotation: Hit_ID=EAA08090.3; Match level="QueryCoverage =95%, HitCoverage=93%, E-value=2e-19, Identity=30%"; Hit description =ENSANGP00000014883 [Anopheles gambiae str. PEST] ref|XP_563791.1| ENSANGP00000014883 [Anopheles gambiae st
MVYESDFYTTRRPYRATPSVSSYTISGVPSRQVRVLPGLGKVHVTYTYDRIVPYVGHKRLTVVTAPPRVWGTRPSVLQREFDRIENKIRPWTGYSATNRYLNSNSAVIFDDETRLIRAQTASLLKRIHDPVPRVQRYSWPAVAAKYDNGLPARLHNDNYIHRLLVTSPNSKTEYTTYYTEPVKKYIGDRVYSRRPHIYLYEDPLKNDIQLLSYYINKFKQEKAITASSEPAKAKVEKAQSPEKETEKPEITEIPNNQ

SEQ ID NO: 38391 - protein, 279 aa, Diabrotica virgifera
  misc_feature: Coding regions on vcDNA: vcDNA=SeqID_18088; Strand=+; Position=1-837
  misc_feature (2)..(9): Xaa can be any naturally occurring amino acid
  misc_feature (12)..(39): Xaa can be any naturally occurring amino acid
  misc_feature (44)..(81): Xaa can be any naturally occurring amino acid
  misc_feature (85)..(267): Xaa can be any naturally occurring amino acid
  misc_feature (270)..(270): Xaa can be any naturally occurring amino acid
  misc_feature (274)..(274): Xaa can be any naturally occurring amino acid
FXXXXXXXXLFXXXXXXXXXXXXXXXXXXXXXXXXXXXXIFRTXXXXXXXXXXXXXXXXXXXXXXXXXXXXXXXXXXXXXXNRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFXVKAXIFLKT

SEQ ID NO: 38392 - protein, 238 aa, Diabrotica virgifera
  misc_feature: Coding regions on vcDNA: vcDNA=SeqID_18089; Strand=+; Position=147-863
  misc_feature: Homolog annotation: Hit_ID=AAK77263.1; Match level="QueryCoverage =92%, HitCoverage=24%, E-value=4e-52, Identity=43%"; Hit description =GH03753p [Drosophila melanogaster]
  misc_feature: Pfam annotation: Pfam_ID=Exo_endo_phos; Match level="Score=86.3, E -value=8.1e-23, Copies=1"; Pfam description =Endonuclease/Exonuclease/phosphatase f
  misc_feature (99)..(106): Xaa can be any naturally occurring amino acid
  misc_feature (207)..(207): Xaa can be any naturally occurring amino acid
  misc_feature (210)..(210): Xaa can be any naturally occurring amino acid
MANDLRIVAWNANGLLNHQQELQAILDIEKIDLFLVSETHFTNQSYIKFKGYKVYHTIHPDNAAKGGSAIIIKDNICHHEELEYKTEHIQATTVHIKTXXXXXXXXSIYCPPKHSIKKEQYNEFLKSLGERFIIGDDFNAKNTHWGSRITTTKGKELLLAIKEQRCEALSTGRPTYWPTDRNKTPDLIDFFIIKNISTNFIDIDDCXDLXSDHSPIVLTMSDRIIKKQSNPTLTKTDL

SEQ ID NO: 38393 - protein, 66 aa, Diabrotica virgifera; identical to SEQ ID NO: 26808
  misc_feature: Coding regions on vcDNA: vcDNA=SeqID_18090; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38394 - protein, 247 aa, Diabrotica virgifera
  misc_feature: Coding regions on vcDNA: vcDNA=SeqID_18091; Strand=-; Position=0-740
  misc_feature (4)..(189): Xaa can be any naturally occurring amino acid
  misc_feature (192)..(230): Xaa can be any naturally occurring amino acid
  misc_feature (232)..(239): Xaa can be any naturally occurring amino acid
  misc_feature (242)..(246): Xaa can be any naturally occurring amino acid
SFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXGXXXXXXXXENXXXXXG

SEQ ID NO: 38395 - protein, 90 aa, Diabrotica virgifera
  misc_feature: Coding regions on vcDNA: vcDNA=SeqID_18092; Strand=+; Position=356-628
FITFSQPKSTQRPSRSFHFKNLFHRSDDGRHFNTFSPSKKCTTAAKEGFTLKIYFAEEMTIDNSILFPHTKSAQRPSRSFHYKNLFPRSE

SEQ ID NO: 38396 - protein, 304 aa, Diabrotica virgifera
  misc_feature: Coding regions on vcDNA: vcDNA=SeqID_18093; Strand=+; Position=15-926
  misc_feature (6)..(35): Xaa can be any naturally occurring amino acid
  misc_feature (38)..(81): Xaa can be any naturally occurring amino acid
  misc_feature (84)..(167): Xaa can be any naturally occurring amino acid
  misc_feature (172)..(222): Xaa can be any naturally occurring amino acid
  misc_feature (224)..(293): Xaa can be any naturally occurring amino acid
YKYVFXXXXXXXXXXXXXXXXXXXXXXXXXXXXXXRTXXXXXXXXXXXXXXXXXXXXXXXXXXXXXXXXXXXXXXXXXXXXFLXXXXXXXXXXXXXXXXXXXXXXXXXXXXXXXXXXXXXXXXXXXXXXXXXXXXXXXXXXXXXXXXXXXXXXXXXXXXXXXXXXXXFKFSXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXYIMNLSRLVVI

SEQ ID NO: 38397 - protein, 100 aa, Diabrotica virgifera
  misc_feature: Coding regions on vcDNA: vcDNA=SeqID_18094; Strand=-; Position=413-715
  misc_feature (2)..(9): Xaa can be any naturally occurring amino acid
  misc_feature (48)..(55): Xaa can be any naturally occurring amino acid
  misc_feature (58)..(73): Xaa can be any naturally occurring amino acid
  misc_feature (79)..(86): Xaa can be any naturally occurring amino acid
AXXXXXXXXYQLYKDSCFLIQPVIPTFNKTAIDYTTLARSVYRAQSNXXXXXXXXMLXXXXXXXXXXXXXXXXNFLINXXXXXXXXNHLICNISIILNLR

SEQ ID NO: 38398 - protein, 45 aa, Diabrotica virgifera
  misc_feature: Coding regions on vcDNA: vcDNA=SeqID_18095; Strand=+; Position=1-138
IYINTKCAIFWKLNIELALLERSRDASCDSVSVVYLAYCEIGYIH

SEQ ID NO: 38399 - protein, 17 aa, Diabrotica virgifera
  misc_feature: Coding regions on vcDNA: vcDNA=SeqID_18096; Strand=-; Position=1-51
  misc_feature (7)..(7): Xaa can be any naturally occurring amino acid
FIIDLTXPIKLRWYPKG

SEQ ID NO: 38400 - protein, 68 aa, Diabrotica virgifera
  misc_feature: Coding regions on vcDNA: vcDNA=SeqID_18097; Strand=-; Position=183-389
  misc_feature (62)..(68): Xaa can be any naturally occurring amino acid
NDVSSLNYGNVLGVFVCRYQYCYNVLLCNILLHRYMIVAVYNILVIHILRVFLDNVLSCTDXXXXXXX

SEQ ID NO: 38401 - protein, 281 aa, Diabrotica virgifera
  misc_feature: Coding regions on vcDNA: vcDNA=SeqID_18098; Strand=+; Position=1-846
  misc_feature (1)..(9): Xaa can be any naturally occurring amino acid
  misc_feature (16)..(260): Xaa can be any naturally occurring amino acid
  misc_feature (270)..(270): Xaa can be any naturally occurring amino acid
  misc_feature (277)..(277): Xaa can be any naturally occurring amino acid
XXXXXXXXXLRNRNRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIYRIIYLRXYSVNLLXESNR

SEQ ID NO: 38402 - protein, 89 aa, Diabrotica virgifera
  misc_feature: Coding regions on vcDNA: vcDNA=SeqID_18099; Strand=+; Position=391-661
  misc_feature: Homolog annotation: Hit_ID=BAC10611.1; Match level="QueryCoverage =91%, HitCoverage=52%, E-value=9e-10, Identity=43%"; Hit description =FK506-binding protein [Bombyx mori] dbj|BAB85190.1| FK506-binding protein [Bombyx mori]
  misc_feature (43)..(43): Xaa can be any naturally occurring amino acid
  misc_feature (64)..(64): Xaa can be any naturally occurring amino acid
SSYSDAKPTPFNVYTESYCHQDNLINREDLRDYLNKQMTDADXETSQVIETKNMIEDHCYVEKXIFQPEDLDKCGYLSYAEFYDLKHNL

SEQ ID NO: 38403 - protein, 32 aa, Diabrotica virgifera
  misc_feature: Coding regions on vcDNA: vcDNA=SeqID_18100; Strand=-; Position=1-96
  misc_feature (3)..(22): Xaa can be any naturally occurring amino acid
  misc_feature (25)..(32): Xaa can be any naturally occurring amino acid
RYXXXXXXXXXXXXXXXXXXXXVKXXXXXXXX

SEQ ID NO: 38404 - protein, 52 aa, Diabrotica virgifera
  misc_feature: Coding regions on vcDNA: vcDNA=SeqID_18101; Strand=-; Position=480-638
IKTLVWTCRPSIPIFYKTVIDYNTLARSRYRAHSTSSSRQAIMVTRYIKPCI

SEQ ID NO: 38405 - protein, 27 aa, Diabrotica virgifera
  misc_feature: Coding regions on vcDNA: vcDNA=SeqID_18102; Strand=-; Position=10-93
  misc_feature (6)..(17): Xaa can be any naturally occurring amino acid
  misc_feature (20)..(20): Xaa can be any naturally occurring amino acid
QKIINXXXXXXXXXXXXDHXNLNEFII

SEQ ID NO: 38406 - protein, 22 aa, Diabrotica virgifera
  misc_feature: Coding regions on vcDNA: vcDNA=SeqID_18103; Strand=-; Position=0-65
  misc_feature (3)..(13): Xaa can be any naturally occurring amino acid
PFXXXXXXXXXXXTNLAHTGLT

SEQ ID NO: 38407 - protein, 49 aa, Diabrotica virgifera
  misc_feature: Coding regions on vcDNA: vcDNA=SeqID_18104; Strand=-; Position=33-182
ISRFVGATDCDSRQFIIFSVTSMCLFSRPNRCLASEKSGFQVCSNVWCY

SEQ ID NO: 38408 - protein, 130 aa, Diabrotica virgifera
  misc_feature: Coding regions on vcDNA: vcDNA=SeqID_18105; Strand=-; Position=2-391
  misc_feature (21)..(31): Xaa can be any naturally occurring amino acid
  misc_feature (42)..(49): Xaa can be any naturally occurring amino acid
  misc_feature (51)..(130): Xaa can be any naturally occurring amino acid
DYSVIHKVIYSYSQNSWLKKXXXXXXXXXXXNFLYSHHKLYXXXXXXXXIXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38409 - protein, 72 aa, Diabrotica virgifera
  misc_feature: Coding regions on vcDNA: vcDNA=SeqID_18106; Strand=+; Position=397-615
  misc_feature (42)..(56): Xaa can be any naturally occurring amino acid
IYLINHLLFKIVRKIFANSIDYRWQCSGMKMADVIGITYFDXXXXXXXXXXXXXXXHSIDVDTYVIYSIMDT

SEQ ID NO: 38410 - protein, 17 aa, Diabrotica virgifera
  misc_feature: Coding regions on vcDNA: vcDNA=SeqID_18107; Strand=-; Position=1-51
  misc_feature (3)..(17): Xaa can be any naturally occurring amino acid
EVXXXXXXXXXXXXXXX

SEQ ID NO: 38411 - protein, 107 aa, Diabrotica virgifera
  misc_feature: Coding regions on vcDNA: vcDNA=SeqID_18108; Strand=-; Position=1-321
  misc_feature (17)..(29): Xaa can be any naturally occurring amino acid
  misc_feature (32)..(52): Xaa can be any naturally occurring amino acid
  misc_feature (58)..(80): Xaa can be any naturally occurring amino acid
  misc_feature (87)..(107): Xaa can be any naturally occurring amino acid
GYKILLSKKLHLKVINXXXXXXXXXXXXXAPXXXXXXXXXXXXXXXXXXXXXILYRVXXXXXXXXXXXXXXXXXXXXXXXSFLFHPXXXXXXXXXXXXXXXXXXXXX

SEQ ID NO: 38412 - protein, 250 aa, Diabrotica virgifera
  misc_feature: Coding regions on vcDNA: vcDNA=SeqID_18109; Strand=+; Position=1-750
  misc_feature (1)..(22): Xaa can be any naturally occurring amino acid
  misc_feature (28)..(93): Xaa can be any naturally occurring amino acid
  misc_feature (99)..(108): Xaa can be any naturally occurring amino acid
  misc_feature (123)..(135): Xaa can be any naturally occurring amino acid
  misc_feature (137)..(143): Xaa can be any naturally occurring amino acid
  misc_feature (152)..(163): Xaa can be any naturally occurring amino acid
  misc_feature (165)..(177): Xaa can be any naturally occurring amino acid
  misc_feature (190)..(240): Xaa can be any naturally occurring amino acid
XXXXXXXXXXXXXXXXXXXXXXEGKGVXXXXXXXXXXXXXXXXXXXXXXXXXXXXXXXXXXXXXXXXXXXXXXXXXXXXXXXXXXXXXXXXXXRGEGVXXXXXXXXXXRNNIGKKNNLIICFXXXXXXXXXXXXXVXXXXXXXGFERRGGAXXXXXXXXXXXXVXXXXXXXXXXXXXLIIKEGGGLFPRXXXXXXXXXXXXXXXXXXXXXXXXXXXXXXXXXXXXXXXXXXXXXXXXXXXRRRGPPAGGG

SEQ ID NO: 38413 - protein, 61 aa, Diabrotica virgifera
  misc_feature: Coding regions on vcDNA: vcDNA=SeqID_18110; Strand=+; Position=111-296
IQRPMTDPVPSSPQTSRRPRYLSAMLGMLQNESYFGEVKMTNKCFLIDEIIRYTCNHHHMI

SEQ ID NO: 38414 - protein, 41 aa, Diabrotica virgifera
  misc_feature: Coding regions on vcDNA: vcDNA=SeqID_18111; Strand=-; Position=0-122
  misc_feature (9)..(40): Xaa can be any naturally occurring amino acid
KKFPFFSLXXXXXXXXXXXXXXXXXXXXXXXXXXXXXXXXP

SEQ ID NO: 38415 - protein, 119 aa, Diabrotica virgifera; identical to SEQ ID NO: 29283
  misc_feature: Coding regions on vcDNA: vcDNA=SeqID_18112; Strand=+; Position=183-542
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 38416 - protein, 211 aa, Diabrotica virgifera
  misc_feature: Coding regions on vcDNA: vcDNA=SeqID_18113; Strand=+; Position=32-667
MNFNQQITMIRSSPFYQSLTSQQKLLLNQELSLRNDSSNMHDPVLNSLLSNLDAIPGSNTHPTHSLSAALSILNNASSKMNPMMNQNPAMMPPMGPNMNQPGLLGAAPGIPNMHPEFPINFDPRNGGLLGNAPMPFGGFPQQQEPQNFNYNDDYYPPENQGGFRGGNREMRGGFNRDRRSRGRNSYHSRHNGNRNFRNNRNHRSNRTHSPP

SEQ ID NO: 38417 - protein, 42 aa, Diabrotica virgifera
  misc_feature: Coding regions on vcDNA: vcDNA=SeqID_18114; Strand=-; Position=0-125
  misc_feature (3)..(27): Xaa can be any naturally occurring amino acid
  misc_feature (35)..(41): Xaa can be any naturally occurring amino acid
SRXXXXXXXXXXXXXXXXXXXXXXXXXLYRGLSRXXXXXXXS

SEQ ID NO: 38418 - protein, 128 aa, Diabrotica virgifera
  misc_feature: Coding regions on vcDNA: vcDNA=SeqID_18115; Strand=-; Position=276-662
  misc_feature (33)..(42): Xaa can be any naturally occurring amino acid
KCFLAKYKYGNLLYSGNGLWAYTLGCKINRTPXXXXXXXXXXFLNLFSDLSDLLICYSPILQQHRCNSIATKQSNLHCTPSAPIKPCPFSQSSHHPVEHSSIYKILKSKSNNSLMFSQDFDSFAYIRP

SEQ ID NO: 38419 - protein, 187 aa, Diabrotica virgifera
  misc_feature: Coding regions on vcDNA: vcDNA=SeqID_18116; Strand=+; Position=34-597
  misc_feature: Homolog annotation: Hit_ID=XP_308908.1; Match level="QueryCoverage =60%, HitCoverage=46%, E-value=1e-30, Identity=56%"; Hit description =ENSANGP00000013326 [Anopheles gambiae]
  misc_feature: Gene Ontology Annotation: Molecular function=structural constituent of eye lens
  misc_feature: Pfam annotation: Pfam_ID=Chitin_bind_4; Match level="Score=110.4, E -value=4.6e-30, Copies=1"; Pfam description=Insect cuticle protein
MFVKVAVMAVACAMCSAGYIDISPYHEANSYGKLVGSPIYETPYYGGEYDGNGYGYGYEKDYDHHAYPKYEFAYGVNDPHTGDHKSQHEERDGDVVKGYYTVADPDGTLRTVHYTADDHNGFNAIVEKDGHSIHPQPVVEKVYVEPVVEKVVLEPVYEKAIYEKPIYEKPFYGYENGPIGDKYGFGY

SEQ ID NO: 38420 - protein, 128 aa, Diabrotica virgifera
  misc_feature: Coding regions on vcDNA: vcDNA=SeqID_18117; Strand=+; Position=285-671
  misc_feature (82)..(89): Xaa can be any naturally occurring amino acid
LSVLFTYSFLFVALFFQFEILRSFKSFLTSFLHRVFGLRFFFFSPIPPVIILWAVLCLALLSSRHIFTSWISSFIFGLLILXXXXXXXXCLLLYHSTLSLMTVLCHQRMLGIDVLVDVQVLSDSFRLL

SEQ ID NO: 38421 - protein, 70 aa, Diabrotica virgifera
  misc_feature: Coding regions on vcDNA: vcDNA=SeqID_18118; Strand=-; Position=11-223
VCNLRSKNITLVYSGGWKRVELTTADSWCGFGRHLHIDSFLKLLCSLELGSTDAPTTAAPYTNAAVIVFP

SEQ ID NO: 38422 - protein, 196 aa, Diabrotica virgifera
  misc_feature: Coding regions on vcDNA: vcDNA=SeqID_18119; Strand=-; Position=1-588
  misc_feature (3)..(179): Xaa can be any naturally occurring amino acid
  misc_feature (182)..(196): Xaa can be any naturally occurring amino acid
QWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 38423 - protein, 291 aa, Diabrotica virgifera
  misc_feature: Coding regions on vcDNA: vcDNA=SeqID_18120; Strand=+; Position=3-875
  misc_feature: Homolog annotation: Hit_ID=AAF87756.1; Match level="QueryCoverage =100%, HitCoverage=66%, E-value=1e-108, Identity=72%"; Hit description=cytochrome oxidase subunit I [Diabrotica lemniscata]
  misc_feature: Pfam annotation: Pfam_ID=COX1; Match level="Score=89.9, E-value=6.6e -24, Copies=1"; Pfam description=Cytochrome C and Quinol oxidase polyp
  misc_feature (14)..(14): Xaa can be any naturally occurring amino acid
  misc_feature (59)..(67): Xaa can be any naturally occurring amino acid
  misc_feature (71)..(77): Xaa can be any naturally occurring amino acid
  misc_feature (88)..(95): Xaa can be any naturally occurring amino acid
  misc_feature (116)..(116): Xaa can be any naturally occurring amino acid
  misc_feature (151)..(151): Xaa can be any naturally occurring amino acid
  misc_feature (168)..(168): Xaa can be any naturally occurring amino acid
  misc_feature (171)..(177): Xaa can be any naturally occurring amino acid
  misc_feature (204)..(210): Xaa can be any naturally occurring amino acid
  misc_feature (224)..(224): Xaa can be any naturally occurring amino acid
  misc_feature (232)..(248): Xaa can be any naturally occurring amino acid
  misc_feature (278)..(278): Xaa can be any naturally occurring amino acid
  misc_feature (285)..(285): Xaa can be any naturally occurring amino acid
PIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIXSLNFLI

SEQ ID NO: 38424 - protein, 68 aa, Diabrotica virgifera
  misc_feature: Coding regions on vcDNA: vcDNA=SeqID_18121; Strand=-; Position=152-358
RSSRQWRLVMFTIGEAIPNCKISRQICTSKKNPPKKSNLRPHFYDHFLFTFYISIIHNFIISYHFKNS

SEQ ID NO: 38425 - protein, 217 aa, Diabrotica virgifera
  misc_feature: Coding regions on vcDNA: vcDNA=SeqID_18122; Strand=+; Position=241-895
  misc_feature: Homolog annotation: Hit_ID=XP_320139.1; Match level="QueryCoverage =100%, HitCoverage=85%, E-value=1e-29, Identity=36%"; Hit description= ENSANGP00000011763 [Anopheles gambiae]
  misc_feature: Gene Ontology Annotation: Molecular function=DNA-directed RNA polymerase III activity; Cellular component=transcription factor complex; Biological process=regulation of transcription from Pol III promoter
  misc_feature (190)..(190): Xaa can be any naturally occurring amino acid
  misc_feature (196)..(196): Xaa can be any naturally occurring amino acid
  misc_feature (201)..(201): Xaa can be any naturally occurring amino acid
  misc_feature (212)..(212): Xaa can be any naturally occurring amino acid
MGGRGRGGRGGRGGVSKSFNKEQLTSLGVGNKELVPGPVLEPPLLYPIMERRPAPLSQSLEMDYLLILRQDFIDHMQLSGSYLKMPESKHQPQQEIDKLVAQLPSAKEKFDWRLFPSELRPKVLVKRIPKSEKSKNVNIEQRLNALEKLEVKTENVETTKVKTEVEENDDEDKEDFEGLEDEEDEEMDDXTDYANXLLDNXEGYEDEDDNLXDGAIY

SEQ ID NO: 38426 - protein, 260 aa, Diabrotica virgifera
  misc_feature: Coding regions on vcDNA: vcDNA=SeqID_18123; Strand=+; Position=1-780
  misc_feature (1)..(21): Xaa can be any naturally occurring amino acid
  misc_feature (23)..(248): Xaa can be any naturally occurring amino acid
  misc_feature (250)..(259): Xaa can be any naturally occurring amino acid
XXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXT

SEQ ID NO: 38427 - protein, 298 aa, Diabrotica virgifera
  misc_feature: Coding regions on vcDNA: vcDNA=SeqID_18124; Strand=-; Position=0-893
  misc_feature (1)..(263): Xaa can be any naturally occurring amino acid
  misc_feature (266)..(296): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGXXXXXXXXXXXXXXXXXXXXXXXXXXXXXXXGG

SEQ ID NO: 38428 - protein, 97 aa, Diabrotica virgifera
  misc_feature: Coding regions on vcDNA: vcDNA=SeqID_18125; Strand=+; Position=593-883
  misc_feature (87)..(97): Xaa can be any naturally occurring amino acid
ILRPIPTKTYIGNCCEINLNLDCPNKSCHFPKDDAIVGYVKRTHLLKKSSKRCTDQILEHNVQINILSYMVCRHLKKTIDKYYNILXXXXXXXXXXX

SEQ ID NO: 38429 - protein, 244 aa, Diabrotica virgifera
  misc_feature: Coding regions on vcDNA: vcDNA=SeqID_18126; Strand=+; Position=91-822
  misc_feature: Homolog annotation: Hit_ID=EAL27165.1; Match level="QueryCoverage =91%, HitCoverage=44%, E-value=3e-45, Identity=42%"; Hit description =GA11018-PA [Drosophila pseudoobscura]
  misc_feature (166)..(171): Xaa can be any naturally occurring amino acid
MLSLILFGVALALFYYVAIKPLSYWKERGVIFQEGALWLLGNQWKFFLNRQDMFEVFEDAYNVAPNARYVGFYQFTVPSLMIRDPQLLKQITVKDFDHFVNHRTFIPQGADPLWSKNLLSLRDQRWRDMRSVLSPSFTSSKMKMMFHLMAGCSENMVKHFLTKNQXXXXXXFKDVATRFANDIIASTAFGISTNSFQKPKNEFYLMGKEITSFSSFCKNLKDMRLITIPKNFKLPKRSISLMGP

SEQ ID NO: 38430 - protein, 164 aa, Diabrotica virgifera
  misc_feature: Coding regions on vcDNA: vcDNA=SeqID_18127; Strand=+; Position=1-495
  misc_feature: Homolog annotation: Hit_ID=AAF87758.1; Match level="QueryCoverage =79%, HitCoverage=29%, E-value=6e-51, Identity=80%"; Hit description =cytochrome oxidase subunit I [Diabrotica porracea]
  misc_feature: Pfam annotation: Pfam_ID=COX1; Match level="Score=-275.6, E-value =0.069, Copies=1"; Pfam description=Cytochrome C and Quinol oxidase polyp
  misc_feature (15)..(15): Xaa can be any naturally occurring amino acid
  misc_feature (50)..(50): Xaa can be any naturally occurring amino acid
  misc_feature (67)..(67): Xaa can be any naturally occurring amino acid
  misc_feature (70)..(76): Xaa can be any naturally occurring amino acid
  misc_feature (103)..(109): Xaa can be any naturally occurring amino acid
  misc_feature (123)..(123): Xaa can be any naturally occurring amino acid
  misc_feature (131)..(146): Xaa can be any naturally occurring amino acid
IYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXVSKLKLLPSSFFTTSSIT

SEQ ID NO: 38431 - protein, 109 aa, Diabrotica virgifera
  misc_feature: Coding regions on vcDNA: vcDNA=SeqID_18128; Strand=-; Position=293-622
RFLHVFLDVIHYLLCLKFGDHHGILSLMRMSAVLTLSSQSCVTERGLITKGTNLMGIIKSRFGERKCRLFRNALYMFQSSFRRSSRNRTVIFIKVSNSAITLSVSCDQS

SEQ ID NO: 38432 - protein, 108 aa, Diabrotica virgifera; identical to SEQ ID NO: 27732
  misc_feature: Coding regions on vcDNA: vcDNA=SeqID_18129; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 38433 - protein, 125 aa, Diabrotica virgifera
  misc_feature: Coding regions on vcDNA: vcDNA=SeqID_18130; Strand=-; Position=2-376
  misc_feature (9)..(17): Xaa can be any naturally occurring amino acid
AHSKKSSIXXXXXXXXXNIYLKRRFTKQVTNFFQNETMNPSKSYHQTPCWVPAYCLRSVWVFHVPEAVFSSFLLGFLPSLRRPRRCRLAFLPFPVPLLLRWSFPFSSPSVKGSSLLLCSFLRPRR

SEQ ID NO: 38434 - protein, 52 aa, Diabrotica virgifera
  misc_feature: Coding regions on vcDNA: vcDNA=SeqID_18131; Strand=-; Position=1-156
  misc_feature (1)..(50): Xaa can be any naturally occurring amino acid
XXXXXXXXXXXXXXXXXXXXXXXXXXXXXXXXXXXXXXXXXXXXXXXXXXNN

SEQ ID NO: 38435 - protein, 44 aa, Diabrotica virgifera
  misc_feature: Coding regions on vcDNA: vcDNA=SeqID_18132; Strand=-; Position=3-134
  misc_feature (8)..(43): Xaa can be any naturally occurring amino acid
FNHPKLNXXXXXXXXXXXXXXXXXXXXXXXXXXXXXXXXXXXXN

SEQ ID NO: 38436 - protein, 66 aa, Diabrotica virgifera; identical to SEQ ID NO: 26808
  misc_feature: Coding regions on vcDNA: vcDNA=SeqID_18133; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38437 - protein, 88 aa, Diabrotica virgifera
  misc_feature: Coding regions on vcDNA: vcDNA=SeqID_18134; Strand=+; Position=479-745
EQLNLLHRLINIRPIAITDDPIPIYDSLVIITGNASSIILTRFISEYYHIIPRSKSKTHHHSIQLYGGHPIIYQHLIRIFGHTSSILL

SEQ ID NO: 38438 - protein, 209 aa, Diabrotica virgifera
  misc_feature: Coding regions on vcDNA: vcDNA=SeqID_18135; Strand=+; Position=103-729
  misc_feature: Homolog annotation: Hit_ID=XP_313462.1; Match level="QueryCoverage =93%, HitCoverage=26%, E-value=6e-51, Identity=53%"; Hit description =ENSANGP00000019635 [Anopheles gambiae]
  misc_feature: Gene Ontology Annotation: Molecular function=ATP-binding cassette (ABC) transporter activity; Cellular component=plasma membrane; Biological process=programmed cell death
  misc_feature: Pfam annotation: Pfam_ID=ABC_tran; Match level="Score=46.8, E-value =6.4e-11, Copies=1"; Pfam description=ABC transporter
  misc_feature (40)..(47): Xaa can be any naturally occurring amino acid
MSNCSVIVRDVFKSYGNKEILKNFCMTVEKGEIYGLLGAXXXXXXXXLNTLVGRKKVDSGQIWVLNSKVGDKGSSVQGNKIGYMPQDVALVGEFTVRDAIFYFGRIFGMKESRIEERFSELSEFLNLPPDNRFIKNCSGGQQRRVSLAVALVHKPQLLILDEPTVGIDPLLKRKDFVLICQKSPNQYKYISGHTTTHYITGMAIKLRNI

SEQ ID NO: 38439 - protein, 70 aa, Diabrotica virgifera
  misc_feature: Coding regions on vcDNA: vcDNA=SeqID_18136; Strand=-; Position=311-523
  misc_feature (8)..(28): Xaa can be any naturally occurring amino acid
  misc_feature (30)..(40): Xaa can be any naturally occurring amino acid
  misc_feature (52)..(58): Xaa can be any naturally occurring amino acid
  misc_feature (62)..(68): Xaa can be any naturally occurring amino acid
KKFFSNKXXXXXXXXXXXXXXXXXXXXXIXXXXXXXXXXXFSSSVIIFSINXXXXXXXKYMXXXXXXXRS

SEQ ID NO: 38440 - protein, 58 aa, Diabrotica virgifera
  misc_feature: Coding regions on vcDNA: vcDNA=SeqID_18137; Strand=-; Position=125-301
  misc_feature (6)..(16): Xaa can be any naturally occurring amino acid
  misc_feature (30)..(43): Xaa can be any naturally occurring amino acid
  misc_feature (48)..(57): Xaa can be any naturally occurring amino acid
LGYELXXXXXXXXXXXLNNISRVLFFRIIXXXXXXXXXXXXXXPIYFXXXXXXXXXXG

SEQ ID NO: 38441 - protein, 112 aa, Diabrotica virgifera
  misc_feature: Coding regions on vcDNA: vcDNA=SeqID_18138; Strand=-; Position=219-557
  misc_feature (22)..(38): Xaa can be any naturally occurring amino acid
  misc_feature (41)..(48): Xaa can be any naturally occurring amino acid
  misc_feature (60)..(67): Xaa can be any naturally occurring amino acid
  misc_feature (70)..(76): Xaa can be any naturally occurring amino acid
IIDMVILPYNFYLRQNFLVYAXXXXXXXXXXXXXXXXXLIXXXXXXXXLDIILFLSPCLXXXXXXXXEKXXXXXXXFTIFDAISFPERTSSYLFSLFTCYISGHIFPTRRLQ

SEQ ID NO: 38442 - protein, 85 aa, Diabrotica virgifera
  misc_feature: Coding regions on vcDNA: vcDNA=SeqID_18139; Strand=+; Position=302-556
  misc_feature: Homolog annotation: Hit_ID=CAA45706.1; Match level="QueryCoverage =80%, HitCoverage=13%, E-value=2e-13, Identity=54%"; Hit description =H(+)-transporting ATPase [Manduca sexta] sp|P31401|VATB_MANSE Vacuolar ATP synthase subunit B (V-ATPase B
  misc_feature: Gene Ontology Annotation: Molecular function=hydrogen-transporting ATPase activity, rotational mechanism; Cellular component=hydrogen -transporting ATPase V1 domain; Biological process=vacuolar acidification
MWIRKKREFIRFRENLVEKGYRSQAEKYLHIQAETISPWACIYPEEMNLSGIAVVDVMNSIARGQKSPTFSVVDLSSKDVAAQIS

SEQ ID NO: 38443 - protein, 66 aa, Diabrotica virgifera; identical to SEQ ID NO: 26808
  misc_feature: Coding regions on vcDNA: vcDNA=SeqID_18140; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38444 - protein, 111 aa, Diabrotica virgifera
  misc_feature: Coding regions on vcDNA: vcDNA=SeqID_18141; Strand=-; Position=1-333
  misc_feature (6)..(13): Xaa can be any naturally occurring amino acid
  misc_feature (18)..(86): Xaa can be any naturally occurring amino acid
  misc_feature (94)..(111): Xaa can be any naturally occurring amino acid
LLLLRXXXXXXXXIGSKXXXXXXXXXXXXXXXXXXXXXXXXXXXXXXXXXXXXXXXXXXXXXXXXXXXXXXXXXXXXXXXXXXXXXFFIQPFIXXXXXXXXXXXXXXXXXX

SEQ ID NO: 38445 - protein, 34 aa, Diabrotica virgifera
  misc_feature: Coding regions on vcDNA: vcDNA=SeqID_18142; Strand=-; Position=72-176
MKFSIHNRLTFNTSIFLNPYLILFIVINLKLFCY

SEQ ID NO: 38446 - protein, 68 aa, Diabrotica virgifera
  misc_feature: Coding regions on vcDNA: vcDNA=SeqID_18143; Strand=-; Position=2-205
  misc_feature (18)..(39): Xaa can be any naturally occurring amino acid
  misc_feature (43)..(68): Xaa can be any naturally occurring amino acid
AVFPISLIFSLFVQKKCXXXXXXXXXXXXXXXXXXXXXXSPPXXXXXXXXXXXXXXXXXXXXXXXXXX

SEQ ID NO: 38447 - protein, 43 aa, Diabrotica virgifera
  misc_feature: Coding regions on vcDNA: vcDNA=SeqID_18144; Strand=-; Position=1-129
FYIHTDIQEFLISKNSELRKIIVKKKGNQIWLTFPFIFNSFRF

SEQ ID NO: 38448 - protein, 25 aa, Diabrotica virgifera
  misc_feature: Coding regions on vcDNA: vcDNA=SeqID_18145; Strand=-; Position=13-90
  misc_feature (15)..(22): Xaa can be any naturally occurring amino acid
KNLFNSFIKLYRVFXXXXXXXXFLP

SEQ ID NO: 38449 - protein, 168 aa, Diabrotica virgifera
  misc_feature: Coding regions on vcDNA: vcDNA=SeqID_18146; Strand=+; Position=1-507
  misc_feature: Homolog annotation: Hit_ID=AAA92124.2; Match level="QueryCoverage =95%, HitCoverage=19%, E-value=9e-18, Identity=36%"; Hit description =ORF1 [Drosophila virilis]
NTSVVPPKITFGSLPYIPDLTPKLFNIFKNVNGLKIATRNVKTVSMLYTKTKDPFTMQESSNVVYSIPCFNCNNVYIGETSRNFHSRAISHRSDIKVNKINACALTEHAITLKHEFNFEGSCILARETNHCKRVFVEMCCIKSSNSCINKKSDIEKLSNIYCYLLAQH

SEQ ID NO: 38450 - protein, 44 aa, Diabrotica virgifera
  misc_feature: Coding regions on vcDNA: vcDNA=SeqID_18147; Strand=+; Position=24-158
FVRTQRTNISTFFNCIPINQNKLITKEYHTEHFRIVSPKYSLMY

SEQ ID NO: 38451 - protein, 95 aa, Diabrotica virgifera
  misc_feature: Coding regions on vcDNA: vcDNA=SeqID_18148; Strand=+; Position=3-287
SLTGPEHHNTQTEHAFSGQTRPPNRNAKEAEKKDDRNRKKYQRKSERRGPKMPATKRGLVTITSSTIVMYVGSDESATILFLVTLVFPDFKEYIV

SEQ ID NO: 38452 - protein, 49 aa, Diabrotica virgifera
  misc_feature: Coding regions on vcDNA: vcDNA=SeqID_18149; Strand=-; Position=157-306
TIFTCFYSKGSTSVTRSLLLHSHDERPTNLCIFIISQLIIQLLNKTQKL

SEQ ID NO: 38453 - protein, 123 aa, Diabrotica virgifera
  misc_feature: Coding regions on vcDNA: vcDNA=SeqID_18150; Strand=-; Position=538-909
  misc_feature (1)..(20): Xaa can be any naturally occurring amino acid
  misc_feature (23)..(93): Xaa can be any naturally occurring amino acid
XXXXXXXXXXXXXXXXXXXXMSXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 38454 - protein, 80 aa, Diabrotica virgifera
  misc_feature: Coding regions on vcDNA: vcDNA=SeqID_18151; Strand=-; Position=106-348
INVVEPVVPAMAHPPPMNLRADSMCGETGGAWEPRIRGRGVAFICDSTPIFPIVFVGFLPTSVASNYISSVLPGQFWSQG

SEQ ID NO: 38455 - protein, 43 aa, Diabrotica virgifera
  misc_feature: Coding regions on vcDNA: vcDNA=SeqID_18152; Strand=+; Position=34-162
PLHRFYYFFIVVLYLKSVAKIVHCYVAGSDRMIRAYLLDYLDY

SEQ ID NO: 38456 - protein, 136 aa, Diabrotica virgifera
  misc_feature: Coding regions on vcDNA: vcDNA=SeqID_18153; Strand=-; Position=1-408
  misc_feature (19)..(30): Xaa can be any naturally occurring amino acid
  misc_feature (32)..(132): Xaa can be any naturally occurring amino acid
ILPYYKAVVLTSSKKMFNXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEGR

SEQ ID NO: 38457 - protein, 68 aa, Diabrotica virgifera
  misc_feature: Coding regions on vcDNA: vcDNA=SeqID_18154; Strand=-; Position=2-205
VKAQLHDACNTYEPLSHRVYWRQVSHRDSGVYSLKSFFNGQTRYQILRSFSINHSNHWYQLPEACYRS

SEQ ID NO: 38458 - protein, 34 aa, Diabrotica virgifera
  misc_feature: Coding regions on vcDNA: vcDNA=SeqID_18155; Strand=-; Position=1-102
ERCATVQSYAVGRARLHVSIPKSQVFNTQVKTMF

SEQ ID NO: 38459 - protein, 73 aa, Diabrotica virgifera
  misc_feature: Coding regions on vcDNA: vcDNA=SeqID_18156; Strand=-; Position=98-319
RDLVELNLKYWIPGRGEAPIVERDFNCGTCHPDKLMILKTSRLFLSLFNGKLCIICEKCLSDIYVGDFNKSDT

SEQ ID NO: 38460 - protein, 52 aa, Diabrotica virgifera
  misc_feature: Coding regions on vcDNA: vcDNA=SeqID_18157; Strand=-; Position=3-158
  misc_feature (11)..(50): Xaa can be any naturally occurring amino acid
ISNIKLRKIIXXXXXXXXXXXXXXXXXXXXXXXXXXXXXXXXXXXXXXXXVI

SEQ ID NO: 38461 - protein, 265 aa, Diabrotica virgifera
  misc_feature: Coding regions on vcDNA: vcDNA=SeqID_18158; Strand=+; Position=85-879
  misc_feature: Homolog annotation: Hit_ID=NP_510726.1; Match level="QueryCoverage =53%, HitCoverage=27%, E-value=2e-10, Identity=29%"; Hit description =C2H2 type zinc finger containing protein family member (XR491) [Caenorhabditis elegans]
  misc_feature: Pfam annotation: Pfam_ID=zf-C2H2; Match level="Score=53.5, E-value =5.9e-13, Copies=3"; Pfam description=Zinc finger, C2H2 type
MDSKELPKGWKKCEICNKSFVSKSNFRAHIKLKHPDDVEKLDPGAKPTAQCNVCNKSIDKRYMTKHLKLKHPELEETLPGKKLYDSTLCHKKFDTSHASLKHNHKCLKMLTCSLCEYENTSQNKLISHMKTMHSIDIKSQDLMFDSVEKFEQWKTELERDTVSKYNITHGSYVTQKYKRSQYYCQRSGYYIAKGKQLRGLKSQGSKKINGFCPAKIDCRQEGEKCSVTFISTHVGHAADLRHLTLTSTERQEIARKIAQKIPFEL

SEQ ID NO: 38462 - protein, 66 aa, Diabrotica virgifera; identical to SEQ ID NO: 26808
  misc_feature: Coding regions on vcDNA: vcDNA=SeqID_18159; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38463 - protein, 193 aa, Diabrotica virgifera
  misc_feature: Coding regions on vcDNA: vcDNA=SeqID_18160; Strand=-; Position=2-580
  misc_feature (49)..(97): Xaa can be any naturally occurring amino acid
  misc_feature (99)..(133): Xaa can be any naturally occurring amino acid
  misc_feature (136)..(193): Xaa can be any naturally occurring amino acid
RGFSFAAKGQVYYTRVKRLFASSLISSIYFFYIYTFFILSLSSMVDLNXXXXXXXXXXXXXXXXXXXXXXXXXXXXXXXXXXXXXXXXXXXXXXXXXSXXXXXXXXXXXXXXXXXXXXXXXXXXXXXXXXXXXRIXXXXXXXXXXXXXXXXXXXXXXXXXXXXXXXXXXXXXXXXXXXXXXXXXXXXXXXXXX

SEQ ID NO: 38464 - protein, 44 aa, Diabrotica virgifera
  misc_feature: Coding regions on vcDNA: vcDNA=SeqID_18161; Strand=-; Position=2-133
  misc_feature (11)..(24): Xaa can be any naturally occurring amino acid
  misc_feature (30)..(43): Xaa can be any naturally occurring amino acid
TQISKILKSNXXXXXXXXXXXXXXPPSRSXXXXXXXXXXXXXXV

SEQ ID NO: 38465 - protein, 282 aa, Diabrotica virgifera
  misc_feature: Coding regions on vcDNA: vcDNA=SeqID_18162; Strand=+; Position=22-869
  misc_feature: Homolog annotation: Hit_ID=NP_647643.1; Match level="QueryCoverage =95%, HitCoverage=96%, E-value=5e-79, Identity=57%"; Hit description =CG7974-PA [Drosophila melanogaster] gb|AAF47544.1| CG7974-PA [Drosophila melanogaster]
  misc_feature: Pfam annotation: Pfam_ID=Hep_59; Match level="Score=140.1, E-value=5e- 39, Copies=1"; Pfam description=Hepatocellular carcinoma-associated a
  misc_feature (4)..(4): Xaa can be any naturally occurring amino acid
  misc_feature (202)..(202): Xaa can be any naturally occurring amino acid
  misc_feature (210)..(210): Xaa can be any naturally occurring amino acid
  misc_feature (220)..(220): Xaa can be any naturally occurring amino acid
  misc_feature (240)..(240): Xaa can be any naturally occurring amino acid
  misc_feature (243)..(243): Xaa can be any naturally occurring amino acid
MSNXKSKIRKQFRKRLKEEDSDENETEVIAKLQEMKEVQKLRERPNGVSLVGLALGTKVLTDTEIKDSFNKNIGGLVNLQALNSGNWKVDDAYDTGIGTQFSVETNKRDEDEEMMKFIEVELSKRKGKEKQSEGQDGNSKYHTPEEIALQSVPEHLRVSSKKQSEEMLSNQMLSGIPEVDLGIEAKIKNIEATEEAKLRLLXEKQNKKDXPSQFVPSNMXCNFVQHNRFNTGASEIRQRXLKXEEKPKKKDEKATDDYYYERFKKQFKRYIKCFSKKTIILS

SEQ ID NO: 38466 - protein, 269 aa, Diabrotica virgifera
  misc_feature: Coding regions on vcDNA: vcDNA=SeqID_18163; Strand=+; Position=50-859
  misc_feature: Homolog annotation: Hit_ID=XP_312463.1; Match level="QueryCoverage =78%, HitCoverage=34%, E-value=5e-22, Identity=32%"; Hit description =ENSANGP00000021985 [Anopheles gambiae]
  misc_feature: Pfam annotation: Pfam_ID=TUDOR; Match level="Score=38.2, E-value=2.5e- 08, Copies=1"; Pfam description=Tudor domain
MELERFVDDIDDAEQYNINEAITGYDPTDEARICRFTRPDGTCFKKHCKLEHIQSRKDGFTTDQDEVYTKAMCPLILPSMDSNVPILITGNISVCRFYAQIINNPYNTGRYIMDLQFHNLDREMNAVETVKKYETFKIDPALGEIVLVWLDHWKRWSRAIVRELLFSGDDRKVQVYMLDYGEYQIRLTNELRKILPQFLLLPFQAVECYIQDYELNTSCPLKEANKFFDINMHLRNFTGITKSEDEPFSILRNQTNTDVGQTLEEHGFC

SEQ ID NO: 38467 - protein, 72 aa, Diabrotica virgifera
  misc_feature: Coding regions on vcDNA: vcDNA=SeqID_18164; Strand=-; Position=241-459
SNKINRQLVRKILTPRILETNENRITTYELFSIVIITYIIQSSSLVRSSSLTLYITKVFQLSTQPSIYNKQY

SEQ ID NO: 38468 - protein, 54 aa, Diabrotica virgifera
  misc_feature: Coding regions on vcDNA: vcDNA=SeqID_18165; Strand=-; Position=62-226
SQFITKSLYILILLHYLIINIIFIIKFNLFLKIFAIFYIYYHLFSKKLLKIHIH

SEQ ID NO: 38469 - protein, 245 aa, Diabrotica virgifera
  misc_feature: Coding regions on vcDNA: vcDNA=SeqID_18166; Strand=+; Position=24-758
  misc_feature: Homolog annotation: Hit_ID=XP_309361.1; Match level="QueryCoverage =99%, HitCoverage=26%, E-value=5e-38, Identity=38%"; Hit description =ENSANGP00000014903 [Anopheles gambiae]
  misc_feature: Gene Ontology Annotation: Biological process=signal transduction
  misc_feature (237)..(237): Xaa can be any naturally occurring amino acid
ASEEFDDLELNSNNEDDETNDKSEEFEDDDIGSDENDSEDDEDIEFEAINNKNKSKKRKLKEAVVPPLPDVSNSASDESDGNDDFDAVDTNEIDPEDEGLSDDEDGSDNEDSEEKDVHKGAAKQFPDGTWEDIYGRLRGKDGSIITKKSESKYVPPALRGKETDKKRSEQLSRLRKQLKGLINRLAESNMHSIASQIEDLYMNNSRNDMNDTLTNLMMESLVAEVLTPERLMIEHVXLSIVLTLN

SEQ ID NO: 38470 - protein, 235 aa, Diabrotica virgifera
  misc_feature: Coding regions on vcDNA: vcDNA=SeqID_18167; Strand=-; Position=40-747
  misc_feature (14)..(21): Xaa can be any naturally occurring amino acid
  misc_feature (156)..(162): Xaa can be any naturally occurring amino acid
RGQSRGFIHSSQKXXXXXXXXYRQNLIGFASDGANVMVGKHNLFVSRLKADIRHVYIIKCICHSFHICASYACLKLPRGIENLARDIYSYFSNSPKRVEILKDFQHFSNVKVHKILHPAQTRWLSIKSVVSRILEQYSPLILFFTDASFNDRTLAXXXXXXXLKDQFTKIYLQFLEFSLPFFNNINRQMQSEKPELQQLYKCVSAVLGPCKFGKATPISTLCNFTRTFNYIGQLY

SEQ ID NO: 38471 - protein, 66 aa, Diabrotica virgifera
  misc_feature: Coding regions on vcDNA: vcDNA=SeqID_18168; Strand=-; Position=132-332
  misc_feature (5)..(12): Xaa can be any naturally occurring amino acid
  misc_feature (58)..(64): Xaa can be any naturally occurring amino acid
FNTCXXXXXXXXALFNVQCIILVAFLLFMCHLSLFFIIINYRIVFQIFSVDGRHTFLXXXXXXXVH

SEQ ID NO: 38472 - protein, 36 aa, Diabrotica virgifera
  misc_feature: Coding regions on vcDNA: vcDNA=SeqID_18169; Strand=+; Position=1-108
  misc_feature (2)..(2): Xaa can be any naturally occurring amino acid
  misc_feature (5)..(36): Xaa can be any naturally occurring amino acid
IXLYXXXXXXXXXXXXXXXXXXXXXXXXXXXXXXXX

SEQ ID NO: 38473 - protein, 36 aa, Diabrotica virgifera
  misc_feature: Coding regions on vcDNA: vcDNA=SeqID_18170; Strand=-; Position=1-108
  misc_feature (3)..(11): Xaa can be any naturally occurring amino acid
  misc_feature (22)..(34): Xaa can be any naturally occurring amino acid
VDXXXXXXXXXNINLIHHRGRXXXXXXXXXXXXXLL

SEQ ID NO: 38474 - protein, 231 aa, Diabrotica virgifera
  misc_feature: Coding regions on vcDNA: vcDNA=SeqID_18171; Strand=-; Position=0-692
  misc_feature (1)..(229): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKS

SEQ ID NO: 38475 - protein, 230 aa, Diabrotica virgifera; identical to SEQ ID NO: 30743
  misc_feature: Coding regions on vcDNA: vcDNA=SeqID_18172; Strand=-; Position=0-689
  misc_feature (1)..(228): Xaa can be any naturally occurring amino acid

SEQ ID NO: 38476 - protein, 66 aa, Diabrotica virgifera
  misc_feature: Coding regions on vcDNA: vcDNA=SeqID_18173; Strand=+; Position=608-805
LAWVAYGKLREVFKSDIPMCLKRKILPMCTRKIINKIQVAQRAKTMERIMLNISLIDTFSKSNRRK

SEQ ID NO: 38477 - protein, 78 aa, Diabrotica virgifera
  misc_feature: Coding regions on vcDNA: vcDNA=SeqID_18174; Strand=-; Position=306-542
KELQKGEDQFLVTRVVRRLFSLFFFIEKNRYRLFFDHKLLNFYAKNFLLFLLKELIVCLKKHHVSFLGKMQSFPFIWL

SEQ ID NO: 38478 - protein, 66 aa, Diabrotica virgifera; identical to SEQ ID NO: 26808
  misc_feature: Coding regions on vcDNA: vcDNA=SeqID_18175; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38479 - protein, 53 aa, Diabrotica virgifera
  misc_feature: Coding regions on vcDNA: vcDNA=SeqID_18176; Strand=+; Position=128-289
KMNISLNFYFMTVMRSHICLNSHRKKFMLIINNVVIIKNLHIIKINYLHVRVP

SEQ ID NO: 38480 - protein, 122 aa, Diabrotica virgifera
  misc_feature: Coding regions on vcDNA: vcDNA=SeqID_18177; Strand=-; Position=429-797
  misc_feature (1)..(1): Xaa can be any naturally occurring amino acid
  misc_feature (15)..(20): Xaa can be any naturally occurring amino acid
XMILGLFPTFCENFXXXXXXRKNCEPKCFISSTKCYVYSVLYYGVESLTLNVETMRRLNAFEMWTYRRIMRVSWVDRVTNRDCNCWIQHPGIQLDPALFSHAGSSKPCLIQQRGSANVSNLK

SEQ ID NO: 38481 - protein, 93 aa, Diabrotica virgifera
  misc_feature: Coding regions on vcDNA: vcDNA=SeqID_18178; Strand=-; Position=58-339
  misc_feature (18)..(30): Xaa can be any naturally occurring amino acid
PKNKAPLWGKLILNFFKXXXXXXXXXXXXXFSTKSKQVKLKIKLVPFFWQEIGKITTQLAFQMNSIANTSQVFYSRIYWSYDLQASPVQSSYF

SEQ ID NO: 38482 - protein, 64 aa, Diabrotica virgifera
  misc_feature: Coding regions on vcDNA: vcDNA=SeqID_18179; Strand=+; Position=47-241
  misc_feature (2)..(2): Xaa can be any naturally occurring amino acid
  misc_feature (5)..(5): Xaa can be any naturally occurring amino acid
  misc_feature (16)..(19): Xaa can be any naturally occurring amino acid
  misc_feature (35)..(44): Xaa can be any naturally occurring amino acid
  misc_feature (50)..(60): Xaa can be any naturally occurring amino acid
KXLIXGEKKGEGERNXXXXKKSPFFVACVLGIIKXXXXXXXXXXQQSYEXXXXXXXXXXXRMVL

SEQ ID NO: 38483 - protein, 206 aa, Diabrotica virgifera
  misc_feature: Coding regions on vcDNA: vcDNA=SeqID_18180; Strand=-; Position=2-619
  misc_feature (1)..(13): Xaa can be any naturally occurring amino acid
  misc_feature (15)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
  misc_feature (80)..(206): Xaa can be any naturally occurring amino acid
XXXXXXXXXXXXXLXXXXXXXXXXXXPTWAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38484 - protein, 87 aa, Diabrotica virgifera
  misc_feature: Coding regions on vcDNA: vcDNA=SeqID_18181; Strand=+; Position=649-909
LIIQVLPPPVPPVKSESAQGEAINDEAAVGKQNIQHKGRVQIVVKKVLEPEEDDSDDEEETVVSKAKIPEVVTKHEADSDDDDVNEE

SEQ ID NO: 38485 - protein, 26 aa, Diabrotica virgifera
  misc_feature: Coding regions on vcDNA: vcDNA=SeqID_18182; Strand=-; Position=1-78
  misc_feature (3)..(26): Xaa can be any naturally occurring amino acid
KKXXXXXXXXXXXXXXXXXXXXXXXX

SEQ ID NO: 38486 - protein, 67 aa, Diabrotica virgifera
  misc_feature: Coding regions on vcDNA: vcDNA=SeqID_18183; Strand=+; Position=62-265
SCVHYRVSLTLPLHFFLSPGATRRRCVEKRTNCRYKQSMTAEQRDCHRPTMSVVCGLDGDHTRGFCA

SEQ ID NO: 38487 - protein, 170 aa, Diabrotica virgifera
  misc_feature: Coding regions on vcDNA: vcDNA=SeqID_18184; Strand=+; Position=150-659
  misc_feature: Homolog annotation: Hit_ID=AAK25797.1; Match level="QueryCoverage =95%, HitCoverage=47%, E-value=2e-54, Identity=61%"; Hit description =delta-9 desaturase 3 [Acheta domesticus] gb|AAK25796.1| delta-9 desaturase 1 [Acheta domesticus]
  misc_feature: Gene Ontology Annotation: Molecular function=stearoyl-CoA desaturase activity; Cellular component=mitochondrion; Biological process=lipid metabolism
  misc_feature: Pfam annotation: Pfam_ID=FA_desaturase; Match level="Score=-27.5, E -value=0.00013, Copies=1"; Pfam description=Fatty acid desaturase
MAPNTSMPTGVLHEHDDEVQAKMIPAEIVKPSERKLELVWRNIILFAYLHMVALYGFYLMIAQAKVFTSILAVVLYICGGLGITAGAHRLWAHRSYQAKWPLKIILTIFNTLAFENSVIEWSRDHRVHHKFSETDADPHNAKRGFFFAHDGCLLCRKHPRRQEPWQSNRH

SEQ ID NO: 38488 - protein, 244 aa, Diabrotica virgifera
  misc_feature: Coding regions on vcDNA: vcDNA=SeqID_18185; Strand=+; Position=1-735
  misc_feature: Homolog annotation: Hit_ID=XP_392496.1; Match level="QueryCoverage =100%, HitCoverage=35%, E-value=1e-106, Identity=77%"; Hit description=similar to ENSANGP00000018542 [Apis mellifera]
  misc_feature: Gene Ontology Annotation: Molecular function=carrier activity; Cellular component=integral to plasma membrane; Biological process =transport
  misc_feature: Pfam annotation: Pfam_ID=Mito_carr; Match level="Score=125.4, E-value= 1.3e-34, Copies=1"; Pfam description=Mitochondrial carrier protein
  misc_feature (97)..(102): Xaa can be any naturally occurring amino acid
QEIMTSIKSHLLTKQVQSHLIEAATISQGGSRVSFPYFIAFNSLLNNMELVKRIYLNVTNGHRTQEVSKEEFMHSAQAMSQMTPLEVDILFQLCDVXXXXXXIVYNDLYAIAPEQYFKQITNRLAEIHAVSSPEDRGVVIQILESTYRFALGSIAGAVGATAVYPIDLVKTRMQNQRAGSFIGELMYRNSFDCFKKVIRHEGVFGLYRGLVPQLLGVAPEKAIKLTVNDLIRDKLMDKNGNLPI

SEQ ID NO: 38489 - protein, 167 aa, Diabrotica virgifera
  misc_feature: Coding regions on vcDNA: vcDNA=SeqID_18186; Strand=-; Position=2-502
  misc_feature (46)..(54): Xaa can be any naturally occurring amino acid
  misc_feature (56)..(167): Xaa can be any naturally occurring amino acid
MKDVQRWAKWIMLAFLGARSTRCVDNEDNEFTALARSVYGGHSTCXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38490 - protein, 40 aa, Diabrotica virgifera
  misc_feature: Coding regions on vcDNA: vcDNA=SeqID_18187; Strand=+; Position=2-124
  misc_feature (13)..(19): Xaa can be any naturally occurring amino acid
RGILSRAKGALIXXXXXXXRGKEGRRDKKTSTLLSCYKKI

SEQ ID NO: 38491 - protein, 74 aa, Diabrotica virgifera
  misc_feature: Coding regions on vcDNA: vcDNA=SeqID_18188; Strand=-; Position=1-222
  misc_feature (14)..(38): Xaa can be any naturally occurring amino acid
  misc_feature (41)..(67): Xaa can be any naturally occurring amino acid
NFIYFIISKKRLGXXXXXXXXXXXXXXXXXXXXXXXXXPPXXXXXXXXXXXXXXXXXXXXXXXXXXXSIRVLFV

SEQ ID NO: 38492 - protein, 34 aa, Diabrotica virgifera; identical to SEQ ID NO: 27603
  misc_feature: Coding regions on vcDNA: vcDNA=SeqID_18189; Strand=-; Position=80-184

SEQ ID NO: 38493 - protein, 153 aa, Diabrotica virgifera
  misc_feature: Coding regions on vcDNA: vcDNA=SeqID_18190; Strand=-; Position=186-647
  misc_feature (38)..(46): Xaa can be any naturally occurring amino acid
  misc_feature (56)..(65): Xaa can be any naturally occurring amino acid
  misc_feature (77)..(92): Xaa can be any naturally occurring amino acid
  misc_feature (98)..(136): Xaa can be any naturally occurring amino acid
YKNIISLINTQQNYFLIPSLTLHIFTKYQLSKSSSYLXXXXXXXXXLYNTTNNILXXXXXXXXXXISYFKTTKLIYXXXXXXXXXXXXXXXXPYIIFXXXXXXXXXXXXXXXXXXXXXXXXXXXXXXXXXXXXXXXIILPYPFQNTTSIQINH

SEQ ID NO: 38494 - protein, 38 aa, Diabrotica virgifera
  misc_feature: Coding regions on vcDNA: vcDNA=SeqID_18191; Strand=-; Position=0-113
  misc_feature (1)..(15): Xaa can be any naturally occurring amino acid
  misc_feature (19)..(27): Xaa can be any naturally occurring amino acid
  misc_feature (29)..(37): Xaa can be any naturally occurring amino acid
XXXXXXXXXXXXXXXANKXXXXXXXXXSXXXXXXXXXL

SEQ ID NO: 38495 - protein, 37 aa, Diabrotica virgifera
  misc_feature: Coding regions on vcDNA: vcDNA=SeqID_18192; Strand=-; Position=1-111
  misc_feature (1)..(5): Xaa can be any naturally occurring amino acid
  misc_feature (20)..(37): Xaa can be any naturally occurring amino acid
XXXXXQPFLPAFNKKSNDYXXXXXXXXXXXXXXXXXX

SEQ ID NO: 38496 - protein, 308 aa, Diabrotica virgifera
  misc_feature: Coding regions on vcDNA: vcDNA=SeqID_18193; Strand=-; Position=2-925
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
  misc_feature (67)..(298): Xaa can be any naturally occurring amino acid
  misc_feature (301)..(308): Xaa can be any naturally occurring amino acid
PFXXXXXXXXXXXTTLAHTGLNXXXXXXXXSNXXXXXXXXPIINXNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEXXXXXXXX

SEQ ID NO: 38497 - protein, 85 aa, Diabrotica virgifera
  misc_feature: Coding regions on vcDNA: vcDNA=SeqID_18194; Strand=-; Position=525-782
  misc_feature (6)..(6): Xaa can be any naturally occurring amino acid
  misc_feature (36)..(44): Xaa can be any naturally occurring amino acid
TPSLCXVSVGFRTFSFSACTGYLLFVFCSHFTKNVXXXXXXXXXPDRPPLFIYAHAHIMVPSHVPRIEMYHWFHHFITLIQQQTE

SEQ ID NO: 38498 - protein, 297 aa, Diabrotica virgifera
  misc_feature: Coding regions on vcDNA: vcDNA=SeqID_18195; Strand=+; Position=1-890
  misc_feature: Homolog annotation: Hit_ID=AAG26008.1; Match level="QueryCoverage =100%, HitCoverage=59%, E-value=3e-83, Identity=47%"; Hit description= beta-glucosidase precursor [Tenebrio molitor]
  misc_feature: Gene Ontology Annotation: Cellular component=endoplasmic reticulum; Biological process=aging
  misc_feature: Pfam annotation: Pfam_ID=Glyco_hydro_1; Match level="Score=101.4, E -value=2.3e-27, Copies=1"; Pfam description=Glycosyl hydrolase family 1
  misc_feature (287)..(287): Xaa can be any naturally occurring amino acid
  misc_feature (290)..(290): Xaa can be any naturally occurring amino acid
DVACDSYHKWQEDVHILKDLGVDFYRFSISWSRILPTGYSNKINEEGVKYYENLIDGLLKNGIQPMITLYHWDLPMPIQELGGWTNIKTAEYFEDYARIVFERFGNKVKYWITINTALLGYADSEFPPYINQPGISNYMCIYVTLLAHAKAFRLYHNEFKQYKGQVGIVVDGRWYQPGSDSDKDVEATNRALEFEIGIWLHPLLSPKGDFPEIVKERVAAISMAEGYRQSRLLKFSTTDIDLLKGSVDFVGLNLYTSHLVEHVEDEHFKGTSTIRDEGIRLYQDASXKGXQSTWLKV

SEQ ID NO: 38499 - protein, 39 aa, Diabrotica virgifera
  misc_feature: Coding regions on vcDNA: vcDNA=SeqID_18196; Strand=-; Position=724-843
  misc_feature (20)..(20): Xaa can be any naturally occurring amino acid
HASETWTISKTDENFLLIFXQKILRGICENGIWRRRYNY

SEQ ID NO: 38500 - protein, 144 aa, Diabrotica virgifera
  misc_feature: Coding regions on vcDNA: vcDNA=SeqID_18197; Strand=-; Position=544-978
  misc_feature (1)..(41): Xaa can be any naturally occurring amino acid
  misc_feature (44)..(114): Xaa can be any naturally occurring amino acid
XXXXXXXXXXXXXXXXXXXXXXXXXXXXXXXXXXXXXXXXXDEXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 38501 - protein, 72 aa, Diabrotica virgifera
  misc_feature: Coding regions on vcDNA: vcDNA=SeqID_18198; Strand=+; Position=72-290
  misc_feature (1)..(7): Xaa can be any naturally occurring amino acid
  misc_feature (46)..(54): Xaa can be any naturally occurring amino acid
XXXXXXXPLCSFLRINLFSMNKNNLILFLMKGEHLLYRSSKRVIVXXXXXXXXXMFYFVDLVCKRVENNFPM

SEQ ID NO: 38502 - protein, 111 aa, Diabrotica virgifera
  misc_feature: Coding regions on vcDNA: vcDNA=SeqID_18199; Strand=+; Position=26-361
  misc_feature: Homolog annotation: Hit_ID=XP_396755.1; Match level="QueryCoverage =56%, HitCoverage=1%, E-value=2e-10, Identity=50%"; Hit description =similar to CG33208-PF [Apis mellifera]
MAKPQFSPSKGTPVNNFGTDNDEPYPSLSDYHDYEPNLEFDDSELQHSTTVLAHTVDMIQVESNSMGSPISDFTDDYFEEELAEVWEVNEGSREGMRDFLHILYGIGSLLV

SEQ ID NO: 38503 - protein, 145 aa, Diabrotica virgifera
  misc_feature: Coding regions on vcDNA: vcDNA=SeqID_18200; Strand=+; Position=1-438
LIPSVLPIRNTFRNYHQELIYPSKDLFGSSLSLDFPLGLSLKKPRIEIPPFTQFALFESPKINGPPVFPLFTPNTIDQRPETVGQIEEYKKALAEEAEEKLKEQQENVIPSSFRQFSGLGSFDLTTKPTHYVNVKSDAYTYKYRV

SEQ ID NO: 38504 - protein, 173 aa, Diabrotica virgifera
  misc_feature: Coding regions on vcDNA: vcDNA=SeqID_18201; Strand=+; Position=59-580
  misc_feature: Homolog annotation: Hit_ID=EAL29130.1; Match level="QueryCoverage =80%, HitCoverage=72%, E-value=7e-58, Identity=72%"; Hit description =GA19846-PA [Drosophila pseudoobscura]
  misc_feature: Gene Ontology Annotation: Molecular function=molecular_function unknown; Cellular component=nucleolus; Biological process=ribosomal large subunit biogenesis
  misc_feature: Pfam annotation: Pfam_ID=Ribosomal_L24e; Match level="Score=101.1, E -value=2.9e-27, Copies=1"; Pfam description=Ribosomal protein L24e
  misc_feature (40)..(45): Xaa can be any naturally occurring amino acid
  misc_feature (141)..(148): Xaa can be any naturally occurring amino acid
MRIETCYFCSSRIYPGHGIQFVRNDCKIFKFCRSKCHAAXXXXXXPRKVKWTKAYRKTVGKELTIDPSFEFEKRRNIPLKYNRETWSKAVEAMKTVEKIKQKRQGAYIMQRLRKGREIEQERDIKEVQRDLSLIRSPAVGXXXXXXXXSMAQDHRESDEEMEGIIEDGGEVTL

SEQ ID NO: 38505 - protein, 26 aa, Diabrotica virgifera
  misc_feature: Coding regions on vcDNA: vcDNA=SeqID_18202; Strand=+; Position=3-83
  misc_feature (3)..(12): Xaa can be any naturally occurring amino acid
IEXXXXXXXXXXRIKLIYIINSFKLP

SEQ ID NO: 38506 - protein, 53 aa, Diabrotica virgifera
  misc_feature: Coding regions on vcDNA: vcDNA=SeqID_18203; Strand=-; Position=235-396
  misc_feature (19)..(25): Xaa can be any naturally occurring amino acid
DSTTIVCVEYSYILKVSMXXXXXXXISKSINLVAITLIFDTSAYNTIYSVRSS

SEQ ID NO: 38507 - protein, 59 aa, Diabrotica virgifera
  misc_feature: Coding regions on vcDNA: vcDNA=SeqID_18204; Strand=+; Position=1-180
  misc_feature (1)..(27): Xaa can be any naturally occurring amino acid
  misc_feature (35)..(58): Xaa can be any naturally occurring amino acid
XXXXXXXXXXXXXXXXXXXXXXXXXXXLKNCIFSXXXXXXXXXXXXXXXXXXXXXXXXH

SEQ ID NO: 38508 - protein, 50 aa, Diabrotica virgifera
  misc_feature: Coding regions on vcDNA: vcDNA=SeqID_18205; Strand=+; Position=152-304
NTAHNIFYRKLLPYHKVQASSADIFMVIVLTITLISWYRLSGSKQCRVYS

SEQ ID NO: 38509 - protein, 48 aa, Diabrotica virgifera
  misc_feature: Coding regions on vcDNA: vcDNA=SeqID_18206; Strand=-; Position=0-143
  misc_feature (7)..(20): Xaa can be any naturally occurring amino acid
  misc_feature (27)..(36): Xaa can be any naturally occurring amino acid
NFKKWTXXXXXXXXXXXXXXPTIEVAXXXXXXXXXXKIPRLSLRVIYS

SEQ ID NO: 38510 - protein, 62 aa, Diabrotica virgifera
  misc_feature: Coding regions on vcDNA: vcDNA=SeqID_18207; Strand=-; Position=399-587
  misc_feature (1)..(9): Xaa can be any naturally occurring amino acid
  misc_feature (42)..(53): Xaa can be any naturally occurring amino acid
XXXXXXXXXSIGFVYSVIFAGYLFTSLIYIVKFSITMSNLPXXXXXXXXXXXXVLRLMTKLK

SEQ ID NO: 38511 - protein, 20 aa, Diabrotica virgifera
  misc_feature: Coding regions on vcDNA: vcDNA=SeqID_18208; Strand=-; Position=0-59
  misc_feature (4)..(17): Xaa can be any naturally occurring amino acid
NIYXXXXXXXXXXXXXXLFT

SEQ ID NO: 38512 - protein, 96 aa, Diabrotica virgifera
  misc_feature: Coding regions on vcDNA: vcDNA=SeqID_18209; Strand=-; Position=34-324
  misc_feature (4)..(19): Xaa can be any naturally occurring amino acid
  misc_feature (21)..(27): Xaa can be any naturally occurring amino acid
  misc_feature (41)..(53): Xaa can be any naturally occurring amino acid
  misc_feature (59)..(85): Xaa can be any naturally occurring amino acid
  misc_feature (90)..(96): Xaa can be any naturally occurring amino acid
KAWXXXXXXXXXXXXXXXXGXXXXXXXGQFKKICVIKKDLXXXXXXXXXXXXXQWGFCXXXXXXXXXXXXXXXXXXXXXXXXXXXLPFHXXXXXXX

SEQ ID NO: 38513 - protein, 64 aa, Diabrotica virgifera
  misc_feature: Coding regions on vcDNA: vcDNA=SeqID_18210; Strand=+; Position=3-197
  misc_feature (26)..(33): Xaa can be any naturally occurring amino acid
RRCRTSLKQFRRLILNKKQALKPTYXXXXXXXXYQHSLECVHIEIGCWLLPWDRNIEALVGSNR

SEQ ID NO: 38514 - protein, 233 aa, Diabrotica virgifera
  misc_feature: Coding regions on vcDNA: vcDNA=SeqID_18211; Strand=+; Position=128-826
  misc_feature: Homolog annotation: Hit_ID=XP_392849.1; Match level="QueryCoverage =96%, HitCoverage=82%, E-value=4e-73, Identity=55%"; Hit description =similar to CG4852-PA [Apis mellifera]
  misc_feature: Gene Ontology Annotation: Molecular function=prenyl-dependent CAAX protease activity; Cellular component=integral to plasma membrane; Biological process=proteolysis and peptidolysis
  misc_feature: Pfam annotation: Pfam_ID=Abi; Match level="Score=57.3, E-value=4.3e -14, Copies=1"; Pfam description=CAAX amino terminal protease family
MEWKESIQCYKSIILCFLLSVTYLLSLHIWKNPHGRDHPSTIKKRFISAFIMLFISPCFLYIGLDQEMLQKHTFIEILGLRTQGLCQAIFMPLFLTMILFLGPISMELYSGLSKVYIEEMYWFSNLKNLIWLRNHIVAPFTEEFTFRSCIVPMLLNCFTPLTSVLSSPLFFGVAHFHHMWERIHHMGMAFDLALKISCFQFIYTTIFGMYSAYIFYRTGHFVSVFIVHAFCNH

SEQ ID NO: 38515 - protein, 36 aa, Diabrotica virgifera; identical to SEQ ID NO: 37268
  misc_feature: Coding regions on vcDNA: vcDNA=SeqID_18212; Strand=-; Position=1-108
  misc_feature (1)..(36): Xaa can be any naturally occurring amino acid

SEQ ID NO: 38516 - protein, 94 aa, Diabrotica virgifera
  misc_feature: Coding regions on vcDNA: vcDNA=SeqID_18213; Strand=+; Position=29-313
YYICVKGTTTYTMKIILIGKIIVKPLSTRMREKQVITLILETDQEAYLDMFSTRCLDSGEYLIKSDDMICYVYCCLVTGYHFYNIYRLFFTYMT

SEQ ID NO: 38517 - protein, 80 aa, Diabrotica virgifera
  misc_feature: Coding regions on vcDNA: vcDNA=SeqID_18214; Strand=-; Position=421-663
  misc_feature (66)..(72): Xaa can be any naturally occurring amino acid
VTMLPIHGEYLSSSPVTQWSADTVSLRQYAVGTIVRRYVCECIRLSEIMNFRLNDDLFLMHYHVVXXXXXXXVCYSIQSN

SEQ ID NO: 38518 - protein, 101 aa, Diabrotica virgifera
  misc_feature: Coding regions on vcDNA: vcDNA=SeqID_18215; Strand=-; Position=157-462
  misc_feature (21)..(30): Xaa can be any naturally occurring amino acid
  misc_feature (46)..(54): Xaa can be any naturally occurring amino acid
  misc_feature (58)..(64): Xaa can be any naturally occurring amino acid
AQNLLAMLIKCINFFRILEKXXXXXXXXXXRLKDYITYYRGPKVRXXXXXXXXXIFEXXXXXXXPVTYSNKHRGFQGFSALGNNVTVYSGVKFFKNTNEFS

SEQ ID NO: 38519 - protein, 72 aa, Diabrotica virgifera
  misc_feature: Coding regions on vcDNA: vcDNA=SeqID_18216; Strand=-; Position=2-217
  misc_feature (5)..(15): Xaa can be any naturally occurring amino acid
  misc_feature (24)..(31): Xaa can be any naturally occurring amino acid
  misc_feature (35)..(43): Xaa can be any naturally occurring amino acid
  misc_feature (47)..(47): Xaa can be any naturally occurring amino acid
  misc_feature (61)..(61): Xaa can be any naturally occurring amino acid
VLLVXXXXXXXXXXXTLAHTGLNXXXXXXXXSTDXXXXXXXXXITFXQHRGRNLYYRFDSXNKFTLLSLGKL

SEQ ID NO: 38520 - protein, 44 aa, Diabrotica virgifera
  misc_feature: Coding regions on vcDNA: vcDNA=SeqID_18217; Strand=-; Position=1-132
  misc_feature (1)..(8): Xaa can be any naturally occurring amino acid
  misc_feature (11)..(18): Xaa can be any naturally occurring amino acid
  misc_feature (30)..(42): Xaa can be any naturally occurring amino acid
XXXXXXXXSTXXXXXXXXPIITLIQHRGRXXXXXXXXXXXXXLL

SEQ ID NO: 38521 - protein, 76 aa, Diabrotica virgifera
  misc_feature: Coding regions on vcDNA: vcDNA=SeqID_18218; Strand=+; Position=2-232
  misc_feature: Homolog annotation: Hit_ID=CAE47497.1; Match level="QueryCoverage =85%, HitCoverage=20%, E-value=6e-09, Identity=49%"; Hit description =cathepsin L-like proteinase [Diabrotica virgifera virgifera]
  misc_feature (28)..(28): Xaa can be any naturally occurring amino acid
  misc_feature (41)..(49): Xaa can be any naturally occurring amino acid
ERVRLTMMLLAAVLIECTIDELEAFEEXTMFIASHNKSYKXXXXXXXXXDFHDNLNKIEEHNAKYEMSQNKPTTCM

SEQ ID NO: 38522 - protein, 177 aa, Diabrotica virgifera
  misc_feature: Coding regions on vcDNA: vcDNA=SeqID_18219; Strand=+; Position=133-666
  misc_feature: Homolog annotation: Hit_ID=EAL34172.1; Match level="QueryCoverage =94%, HitCoverage=73%, E-value=1e-20, Identity=34%"; Hit description =GA11013-PA [Drosophila pseudoobscura]
  misc_feature: Gene Ontology Annotation: Molecular function=pre-mRNA splicing factor activity; Cellular component=spliceosome complex; Biological process =mRNA splicing
  misc_feature: Pfam annotation: Pfam_ID=RRM_1; Match level="Score=66.4, E-value=8.1e- 17, Copies=1"; Pfam description=RNA recognition motif. (a.k.a. RRM, RB
MDESKTVWIGNLSNKVTEELLFELFLQVAPLEKVRIPTDKEGRQSNFAFVTFKHEQSVEYAVRLLNGIKMYDKNLNIKPKNPSAMTQNHFPERNFSHENQYGHMNNQNQFYNNERDNRQNRHNFRDRDNYRDDRYRDNPYSRHDDRDRYDHNRQKQHYNERRGSSDGRYFANHNAET

SEQ ID NO: 38523 - protein, 260 aa, Diabrotica virgifera
  misc_feature: Coding regions on vcDNA: vcDNA=SeqID_18220; Strand=+; Position=136-914
  misc_feature: Homolog annotation: Hit_ID=XP_394460.1; Match level="QueryCoverage =75%, HitCoverage=70%, E-value=2e-32, Identity=33%"; Hit description =similar to ENSANGP00000011944 [Apis mellifera]
  misc_feature: Pfam annotation: Pfam_ID=zf-DHHC; Match level="Score=8.3, E-value =1.3e-05, Copies=1"; Pfam description=DHHC zinc finger domain
  misc_feature (234)..(234): Xaa can be any naturally occurring amino acid
  misc_feature (248)..(249): Xaa can be any naturally occurring amino acid
MILINSVRMDDDSASLCCCEYYDINYERNHILACCCNCEDLDEAFESLITRQGVTEKNKKGLMMTMKDRFRIPWKGGAKQVAFDAILPIFILPTTLILASISLWWTIFAFTSVIIFLILISSFLIRTLPHTKFFFVWSLTSLIILYVIFEFIVIPFLEILLEENIALSILIFGFLICGFIMKKRTKQLPRLGENELEKGLISKSYYRLVNCSICQVRVPDKDHHCVWFDWCVGXHNQCAFISVLFFAXXALLYSSNLTLT

SEQ ID NO: 38524 - protein, 68 aa, Diabrotica virgifera
  misc_feature: Coding regions on vcDNA: vcDNA=SeqID_18221; Strand=-; Position=143-349
  misc_feature (21)..(28): Xaa can be any naturally occurring amino acid
KKLQIFKYIIHLQPKFTTPFXXXXXXXXSSPSHHILSLNIYQYKPYHFISNQLDFSLKLSHSKSNNVS

SEQ ID NO: 38525 - protein, 212 aa, Diabrotica virgifera
  misc_feature: Coding regions on vcDNA: vcDNA=SeqID_18222; Strand=-; Position=2-637
  misc_feature (5)..(210): Xaa can be any naturally occurring amino acid
MFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRR

SEQ ID NO: 38526 - protein, 109 aa, Diabrotica virgifera
  misc_feature: Coding regions on vcDNA: vcDNA=SeqID_18223; Strand=+; Position=611-940
  misc_feature (27)..(33): Xaa can be any naturally occurring amino acid
  misc_feature (57)..(57): Xaa can be any naturally occurring amino acid
  misc_feature (61)..(61): Xaa can be any naturally occurring amino acid
NHLNHHFQRFLSKKSSVFKSLADIASXXXXXXXLGLLRFLLVDGLQFYIFFVHLFSXILCXCQYQLSLLASLSLLCLDQFLFLSEYLPFSPYKSSESSLIIIFMDLILI

SEQ ID NO: 38527 - protein, 294 aa, Diabrotica virgifera
  misc_feature: Coding regions on vcDNA: vcDNA=SeqID_18224; Strand=-; Position=1-882
  misc_feature (1)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXE

SEQ ID NO: 38528 - protein, 43 aa, Diabrotica virgifera
  misc_feature: Coding regions on vcDNA: vcDNA=SeqID_18225; Strand=-; Position=1-129
  misc_feature (5)..(41): Xaa can be any naturally occurring amino acid
GSLVXXXXXXXXXXXXXXXXXXXXXXXXXXXXXXXXXXXXXDY

SEQ ID NO: 38529 - protein, 71 aa, Diabrotica virgifera
  misc_feature: Coding regions on vcDNA: vcDNA=SeqID_18226; Strand=-; Position=604-819
NIAITAVRWRHVSINLQVSQPVTSTSSSYPLVILNKKLKTRIHKDAIMSFAVTVIPYSTFQEHNYYNACTI

SEQ ID NO: 38530 - protein, 229 aa, Diabrotica virgifera
  misc_feature: Coding regions on vcDNA: vcDNA=SeqID_18227; Strand=+; Position=25-717
  misc_feature: Homolog annotation: Hit_ID=XP_320971.1; Match level="QueryCoverage =87%, HitCoverage=30%, E-value=2e-42, Identity=52%"; Hit description =ENSANGP00000019887 [Anopheles gambiae]
  misc_feature: Gene Ontology Annotation: Molecular function=protein binding; Biological process=reproduction
  misc_feature (39)..(39): Xaa can be any naturally occurring amino acid
  misc_feature (44)..(44): Xaa can be any naturally occurring amino acid
  misc_feature (63)..(63): Xaa can be any naturally occurring amino acid
  misc_feature (101)..(101): Xaa can be any naturally occurring amino acid
  misc_feature (108)..(108): Xaa can be any naturally occurring amino acid
  misc_feature (126)..(126): Xaa can be any naturally occurring amino acid
  misc_feature (136)..(136): Xaa can be any naturally occurring amino acid
  misc_feature (151)..(151): Xaa can be any naturally occurring amino acid
  misc_feature (154)..(154): Xaa can be any naturally occurring amino acid
  misc_feature (177)..(177): Xaa can be any naturally occurring amino acid
  misc_feature (189)..(189): Xaa can be any naturally occurring amino acid
TIAVTLTKLLILNYLKNTAPNAVIVLHITYSCSQVFSHXRFEIXATDHTMKTTPLYVKFTKTXRIIRNDVKKQITMNPMNDYFLIDQRSVLACSSYDHSAXQTDMKHXPFEVTLDEHHPYIEAEYXGIRHILLPKXARSMDLTQRKETAKXILXKSVTYADITVSAYFIDSLEQATXDAGIIAGLQVLXIINKPTDAAIAYDLIQHTANAERNVLIFDLHRVYFVMHQS

SEQ ID NO: 38531 - protein, 139 aa, Diabrotica virgifera
  misc_feature: Coding regions on vcDNA: vcDNA=SeqID_18228; Strand=+; Position=288-707
PREVYNRKAVSNSIKRAAVKDLNEKPMKLICKELMKPNIETFTNNDINRVRQNLYYARTTYSLIKPPKYISEFHKALDPSSIITNRNENFIIKNDKDKSYCYINVFQIFVFFRLFPIGMLTELLNTVLVFSLNCLVYMA

SEQ ID NO: 38532 - protein, 254 aa, Diabrotica virgifera
  misc_feature: Coding regions on vcDNA: vcDNA=SeqID_18229; Strand=-; Position=1-762
  misc_feature (10)..(32): Xaa can be any naturally occurring amino acid
  misc_feature (34)..(34): Xaa can be any naturally occurring amino acid
  misc_feature (37)..(254): Xaa can be any naturally occurring amino acid
NSIGSLVFKXXXXXXXXXXXXXXXXXXXXXXXPXHPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38533 - protein, 49 aa, Diabrotica virgifera
  misc_feature: Coding regions on vcDNA: vcDNA=SeqID_18230; Strand=+; Position=2-151
KFNLLKKALEEHKASKKLVLFTDSYDVIFLGKMDEIIRRLMLNDVRTFY

SEQ ID NO: 38534 - protein, 98 aa, Diabrotica virgifera
  misc_feature: Coding regions on vcDNA: vcDNA=SeqID_18231; Strand=-; Position=147-443
TVIQHEKEMTVCFINVNASFPRYGLLKFFLHTNDLFIAVKPVAICKQNLQVRNNYILKHTKFQLHISTSFRALNKSSVCQKNFNIPYLRNEAFADICL

SEQ ID NO: 38535 - protein, 74 aa, Diabrotica virgifera
  misc_feature: Coding regions on vcDNA: vcDNA=SeqID_18232; Strand=+; Position=155-379
IKSNVLTQEILNLKKLLHRRRKNPSYSVPGLDRVVFAYSNITPFNVNRNHSLLPLNFKLFYICVKALLNLIALI

SEQ ID NO: 38536 - protein, 56 aa, Diabrotica virgifera
  misc_feature: Coding regions on vcDNA: vcDNA=SeqID_18233; Strand=+; Position=469-639
  misc_feature (11)..(20): Xaa can be any naturally occurring amino acid
IIQIIFVILLXXXXXXXXXXRHLSTTRITRINVIKMSPTKCNHRRAFFSVTYNLMR

SEQ ID NO: 38537 - protein, 62 aa, Diabrotica virgifera
  misc_feature: Coding regions on vcDNA: vcDNA=SeqID_18234; Strand=-; Position=243-431
KSTSFIPLLYDNYSFIIFINVDIYNTTVLLIFIPNLVVIFITYTSVVINILMIPIFNGFANR

SEQ ID NO: 38538 - protein, 152 aa, Diabrotica virgifera
  misc_feature: Coding regions on vcDNA: vcDNA=SeqID_18235; Strand=-; Position=320-778
  misc_feature (4)..(10): Xaa can be any naturally occurring amino acid
  misc_feature (13)..(22): Xaa can be any naturally occurring amino acid
  misc_feature (35)..(41): Xaa can be any naturally occurring amino acid
  misc_feature (45)..(68): Xaa can be any naturally occurring amino acid
  misc_feature (71)..(140): Xaa can be any naturally occurring amino acid
GFVXXXXXXXLCXXXXXXXXXXQSQFFFHSTFHSXXXXXXXMICXXXXXXXXXXXXXXXXXXXXXXXXQRXXXXXXXXXXXXXXXXXXXXXXXXXXXXXXXXXXXXXXXXXXXXXXXXXXXXXXXXXXXXXXXXXXXXXXFNPKLLFKTLDA

SEQ ID NO: 38539 - protein, 122 aa, Diabrotica virgifera
  misc_feature: Coding regions on vcDNA: vcDNA=SeqID_18236; Strand=+; Position=1-369
  misc_feature (8)..(69): Xaa can be any naturally occurring amino acid
  misc_feature (98)..(105): Xaa can be any naturally occurring amino acid
  misc_feature (110)..(119): Xaa can be any naturally occurring amino acid
DMFLINRXXXXXXXXXXXXXXXXXXXXXXXXXXXXXXXXXXXXXXXXXXXXXXXXXXXXXXXXXXXXXXKRDSLFIIYHLIRYKFNLLFNTIFITKYXXXXXXXXFAGMXXXXXXXXXXNFM

SEQ ID NO: 38540 - protein, 69 aa, Diabrotica virgifera
  misc_feature: Coding regions on vcDNA: vcDNA=SeqID_18237; Strand=+; Position=44-253
  misc_feature (16)..(24): Xaa can be any naturally occurring amino acid
  misc_feature (35)..(45): Xaa can be any naturally occurring amino acid
TATRSEVVCGSLEDLXXXXXXXXXGKKVAAAPLAXXXXXXXXXXXPLFEKRTRNFGIELNIQPRRDISR

SEQ ID NO: 38541 - protein, 30 aa, Diabrotica virgifera
  misc_feature: Coding regions on vcDNA: vcDNA=SeqID_18238; Strand=-; Position=3-95
  misc_feature (10)..(29): Xaa can be any naturally occurring amino acid
IIKKMGSKNXXXXXXXXXXXXXXXXXXXXK

SEQ ID NO: 38542 - protein, 63 aa, Diabrotica virgifera
  misc_feature: Coding regions on vcDNA: vcDNA=SeqID_18239; Strand=+; Position=2-190
  misc_feature (8)..(21): Xaa can be any naturally occurring amino acid
  misc_feature (28)..(48): Xaa can be any naturally occurring amino acid
YTNIIIIXXXXXXXXXXXXXXLILAFLXXXXXXXXXXXXXXXXXXXXXSTAYVDWTRDFDRAN

SEQ ID NO: 38543 - protein, 21 aa, Diabrotica virgifera
  misc_feature: Coding regions on vcDNA: vcDNA=SeqID_18240; Strand=-; Position=1-63
  misc_feature (2)..(21): Xaa can be any naturally occurring amino acid
SXXXXXXXXXXXXXXXXXXXX

SEQ ID NO: 38544 - protein, 69 aa, Diabrotica virgifera
  misc_feature: Coding regions on vcDNA: vcDNA=SeqID_18241; Strand=+; Position=1-210
  misc_feature (1)..(35): Xaa can be any naturally occurring amino acid
XXXXXXXXXXXXXXXXXXXXXXXXXXXXXXXXXXXTHSRKIILKLVTDLNRCYYFYSDSPLATAKSAVR

SEQ ID NO: 38545 - protein, 311 aa, Diabrotica virgifera
  misc_feature: Coding regions on vcDNA: vcDNA=SeqID_18242; Strand=+; Position=26-958
  misc_feature (15)..(292): Xaa can be any naturally occurring amino acid
FKYLFKNCLQIINYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPQPALKSILYLRVLTSTPQ

SEQ ID NO: 38546 - protein, 39 aa, Diabrotica virgifera
  misc_feature: Coding regions on vcDNA: vcDNA=SeqID_18243; Strand=-; Position=3-119
  misc_feature (23)..(29): Xaa can be any naturally occurring amino acid
  misc_feature (35)..(39): Xaa can be any naturally occurring amino acid
NMCINLNKHKFDGVIHTLRRELXXXXXXXDLWLPXXXXX

SEQ ID NO: 38547 - protein, 152 aa, Diabrotica virgifera
  misc_feature: Coding regions on vcDNA: vcDNA=SeqID_18244; Strand=-; Position=1-459
  misc_feature (1)..(152): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38548 - protein, 154 aa, Diabrotica virgifera
  misc_feature: Coding regions on vcDNA: vcDNA=SeqID_18245; Strand=+; Position=196-660
  misc_feature (18)..(47): Xaa can be any naturally occurring amino acid
  misc_feature (50)..(67): Xaa can be any naturally occurring amino acid
  misc_feature (71)..(124): Xaa can be any naturally occurring amino acid
  misc_feature (140)..(147): Xaa can be any naturally occurring amino acid
TLLKRYVILTYASRVYYXXXXXXXXXXXXXXXXXXXXXXXXXXXXXXNKXXXXXXXXXXXXXXXXXXIKYXXXXXXXXXXXXXXXXXXXXXXXXXXXXXXXXXXXXXXXXXXXXXXXXXXXXXXVFPCLLKTCSFCIEYXXXXXXXXFCMDAEF

SEQ ID NO: 38549 - protein, 188 aa, Diabrotica virgifera
  misc_feature: Coding regions on vcDNA: vcDNA=SeqID_18246; Strand=+; Position=9-572
  misc_feature: Homolog annotation: Hit_ID=AAF87760.1; Match level="QueryCoverage =98%, HitCoverage=42%, E-value=1e-63, Identity=70%"; Hit description =cytochrome oxidase subunit I [Diabrotica virgifera zeae]
  misc_feature (16)..(16): Xaa can be any naturally occurring amino acid
  misc_feature (19)..(25): Xaa can be any naturally occurring amino acid
  misc_feature (52)..(58): Xaa can be any naturally occurring amino acid
  misc_feature (72)..(72): Xaa can be any naturally occurring amino acid
  misc_feature (80)..(96): Xaa can be any naturally occurring amino acid
  misc_feature (126)..(126): Xaa can be any naturally occurring amino acid
  misc_feature (142)..(149): Xaa can be any naturally occurring amino acid
  misc_feature (170)..(170): Xaa can be any naturally occurring amino acid
VANHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 38550 - protein, 89 aa, Diabrotica virgifera
  misc_feature: Coding regions on vcDNA: vcDNA=SeqID_18247; Strand=-; Position=3-272
  misc_feature (26)..(41): Xaa can be any naturally occurring amino acid
  misc_feature (46)..(57): Xaa can be any naturally occurring amino acid
  misc_feature (70)..(82): Xaa can be any naturally occurring amino acid
EKITVKIFYYLIVLLHLNFHNIQIIXXXXXXXXXXXXXXXXNLFWXXXXXXXXXXXXPKVDKKGIFHIIXXXXXXXXXXXXXPIYFADA

SEQ ID NO: 38551 - protein, 70 aa, Diabrotica virgifera
  misc_feature: Coding regions on vcDNA: vcDNA=SeqID_18248; Strand=-; Position=2-211
  misc_feature (63)..(70): Xaa can be any naturally occurring amino acid
YSSSRFKFVFSLFTLIYRWISHSRFLTRHTPGPLKKHIPPPRPPPPKPPRNPPRPPAGAACAXXXXXXXX

SEQ ID NO: 38552 - protein, 147 aa, Diabrotica virgifera
  misc_feature: Coding regions on vcDNA: vcDNA=SeqID_18249; Strand=+; Position=1-444
  misc_feature (1)..(100): Xaa can be any naturally occurring amino acid
  misc_feature (103)..(113): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSCXXXXXXXXXXXENVIFKFNKFRKLLHLSFAQYSTYRLNALSLLAY

SEQ ID NO: 38553 - protein, 203 aa, Diabrotica virgifera
  misc_feature: Coding regions on vcDNA: vcDNA=SeqID_18250; Strand=-; Position=0-608
  misc_feature (6)..(18): Xaa can be any naturally occurring amino acid
  misc_feature (21)..(31): Xaa can be any naturally occurring amino acid
  misc_feature (33)..(59): Xaa can be any naturally occurring amino acid
  misc_feature (63)..(80): Xaa can be any naturally occurring amino acid
  misc_feature (84)..(100): Xaa can be any naturally occurring amino acid
  misc_feature (105)..(111): Xaa can be any naturally occurring amino acid
  misc_feature (119)..(202): Xaa can be any naturally occurring amino acid
LTGENXXXXXXXXXXXXXLNXXXXXXXXXXXSXXXXXXXXXXXXXXXXXXXXXXXXXXXHILXXXXXXXXXXXXXXXXXXFYFXXXXXXXXXXXXXXXXXLNILXXXXXXXGYDFVNVXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 38554 - protein, 156 aa, Diabrotica virgifera
  misc_feature: Coding regions on vcDNA: vcDNA=SeqID_18251; Strand=+; Position=2-472
  misc_feature (148)..(154): Xaa can be any naturally occurring amino acid
KKGSRVLSKTVQRLRNKTSRQRFPFKAVFKKLPLKLPRRAMTDIDLVKYASLLNIPHFRGVFMRDSLPNVIRKHESGIVNHDTESGNGTHWTAYTKQNTLITYFDSYGNLPPPTELVRYFKSNGNAIIVYNYDVIQNFNSFNCGQNCXXXXXXXYN

SEQ ID NO: 38555 - protein, 57 aa, Diabrotica virgifera
  misc_feature: Coding regions on vcDNA: vcDNA=SeqID_18252; Strand=+; Position=347-517
MIPNATYVYYCDKETDDGVEYHYILESIVVLLVTVLISIIMYNILDISRFGCNIAGV

SEQ ID NO: 38556 - protein, 97 aa, Diabrotica virgifera
  misc_feature: Coding regions on vcDNA: vcDNA=SeqID_18253; Strand=-; Position=104-397
GVVNELSLFCMALFCMVTEGSALFGSLEAPDPSGSQRRSAGGYDQELVVGLRSQFQYRWTACHGIPWKSSRAMTCTPPSGAIFLWDAINVAAGVRDV

SEQ ID NO: 38557 - protein, 89 aa, Diabrotica virgifera
  misc_feature: Coding regions on vcDNA: vcDNA=SeqID_18254; Strand=-; Position=2-268
  misc_feature (3)..(23): Xaa can be any naturally occurring amino acid
  misc_feature (25)..(36): Xaa can be any naturally occurring amino acid
  misc_feature (46)..(53): Xaa can be any naturally occurring amino acid
  misc_feature (56)..(69): Xaa can be any naturally occurring amino acid
  misc_feature (75)..(88): Xaa can be any naturally occurring amino acid
ERXXXXXXXXXXXXXXXXXXXXXLXXXXXXXXXXXXTNLAHTGLNXXXXXXXXSNXXXXXXXXXXXXXXPTSRSXXXXXXXXXXXXXXV

SEQ ID NO: 38558 - protein, 160 aa, Diabrotica virgifera
  misc_feature: Coding regions on vcDNA: vcDNA=SeqID_18255; Strand=+; Position=2-484
  misc_feature (26)..(35): Xaa can be any naturally occurring amino acid
  misc_feature (72)..(80): Xaa can be any naturally occurring amino acid
  misc_feature (93)..(100): Xaa can be any naturally occurring amino acid
  misc_feature (102)..(143): Xaa can be any naturally occurring amino acid
LSRPSRLDVYKLLPLFINVYKGLFVXXXXXXXXXXTKNPCFNVTIEVVGKNSNQIKIMNILVYHIQRESVFXXXXXXXXXKYCFCNVMLFICXXXXXXXXQXXXXXXXXXXXXXXXXXXXXXXXXXXXXXXXXXXXXXXXXXXIQKLQILTSVIIYFDIV

SEQ ID NO: 38559 - protein, 219 aa, Diabrotica virgifera
  misc_feature: Coding regions on vcDNA: vcDNA=SeqID_18256; Strand=+; Position=147-804
  misc_feature: Homolog annotation: Hit_ID=XP_319016.1; Match level="QueryCoverage =81%, HitCoverage=38%, E-value=2e-51, Identity=53%"; Hit description =ENSANGP00000014776 [Anopheles gambiae]
  misc_feature: Gene Ontology Annotation: Molecular function=hydrogen:amino acid symporter activity; Cellular component=plasma membrane; Biological process=alanine transport
  misc_feature (164)..(164): Xaa can be any naturally occurring amino acid
MADASSKAKKDDPDEEYDPYLHRNLPNPNKSIETLGHLVKGIIGTGILALPEGFKLAGMLVGIISTILIGLLSTYCLRILVQSQYELCKKKRVGLLTYPESMQYACEVGPKCFRRFSPYAGGLTNFFLVTFQIGTCCVYVVFVAVNIKFVGDEYTDPKIALNLXILMFFVPFLCIIMVRNLKIFAPFSIAGNNNNIIENWAFVATIYVKILPPVFQTVH

SEQ ID NO: 38560 - protein, 44 aa, Diabrotica virgifera
  misc_feature: Coding regions on vcDNA: vcDNA=SeqID_18257; Strand=-; Position=2-133
  misc_feature (1)..(17): Xaa can be any naturally occurring amino acid
  misc_feature (19)..(32): Xaa can be any naturally occurring amino acid
  misc_feature (35)..(44): Xaa can be any naturally occurring amino acid
XXXXXXXXXXXXXXXXXPXXXXXXXXXXXXXXKNXXXXXXXXXX

SEQ ID NO: 38561 - protein, 103 aa, Diabrotica virgifera
  misc_feature: Coding regions on vcDNA: vcDNA=SeqID_18258; Strand=+; Position=615-926
  misc_feature: Homolog annotation: Hit_ID=AAT40504.1; Match level="QueryCoverage =88%, HitCoverage=11%, E-value=5e-10, Identity=35%"; Hit description =putative polyprotein [Solanum demissum]
  misc_feature (77)..(77): Xaa can be any naturally occurring amino acid
  misc_feature (87)..(87): Xaa can be any naturally occurring amino acid
MNRVLWDRQITRNTKRIYKSLVHSVMTYGAENWVINNQNKSKITATEPEFMRKNCRVTRINRIKNEKIKRRMAVEQXTQLHRRKRLXWYGHVKRADHTRWISK

SEQ ID NO: 38562 - protein, 77 aa, Diabrotica virgifera
  misc_feature: Coding regions on vcDNA: vcDNA=SeqID_18259; Strand=+; Position=124-357
  misc_feature (5)..(12): Xaa can be any naturally occurring amino acid
  misc_feature (63)..(74): Xaa can be any naturally occurring amino acid
FLEIXXXXXXXXKCLLVENYFFSLWCDIDRIFNFEANFRAFKTFFVLKENSILKILIYVNISXXXXXXXXXXXXTRI

SEQ ID NO: 38563 - protein, 56 aa, Diabrotica virgifera
  misc_feature: Coding regions on vcDNA: vcDNA=SeqID_18260; Strand=-; Position=0-167
  misc_feature (39)..(52): Xaa can be any naturally occurring amino acid
MCQLVRSLTNNKFSLCITMDNCCSQRRINCSSGTNPPFXXXXXXXXXXXXXXQSKS

SEQ ID NO: 38564 - protein, 67 aa, Diabrotica virgifera
  misc_feature: Coding regions on vcDNA: vcDNA=SeqID_18261; Strand=-; Position=0-200
MREWGKSDCQHCAVAMCDYRFYFQFFGEWFYCPSLYCDLVVISNVVFNDSLTSSLPKDTKWKGKIIS

SEQ ID NO: 38565 - protein, 275 aa, Diabrotica virgifera
  misc_feature: Coding regions on vcDNA: vcDNA=SeqID_18262; Strand=-; Position=1-825
  misc_feature (13)..(25): Xaa can be any naturally occurring amino acid
  misc_feature (27)..(37): Xaa can be any naturally occurring amino acid
  misc_feature (47)..(55): Xaa can be any naturally occurring amino acid
  misc_feature (57)..(70): Xaa can be any naturally occurring amino acid
  misc_feature (77)..(89): Xaa can be any naturally occurring amino acid
  misc_feature (91)..(262): Xaa can be any naturally occurring amino acid
VLLFIFQLLLVNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMMIILVLLPTRP

SEQ ID NO: 38566 - protein, 23 aa, Diabrotica virgifera
  misc_feature: Coding regions on vcDNA: vcDNA=SeqID_18263; Strand=-; Position=0-68
  misc_feature (1)..(22): Xaa can be any naturally occurring amino acid
XXXXXXXXXXXXXXXXXXXXXXP

SEQ ID NO: 38567 - protein, 309 aa, Diabrotica virgifera
  misc_feature: Coding regions on vcDNA: vcDNA=SeqID_18264; Strand=-; Position=1-927
  misc_feature (2)..(11): Xaa can be any naturally occurring amino acid
  misc_feature (15)..(15): Xaa can be any naturally occurring amino acid
  misc_feature (19)..(19): Xaa can be any naturally occurring amino acid
  misc_feature (22)..(31): Xaa can be any naturally occurring amino acid
  misc_feature (33)..(41): Xaa can be any naturally occurring amino acid
  misc_feature (52)..(65): Xaa can be any naturally occurring amino acid
  misc_feature (67)..(309): Xaa can be any naturally occurring amino acid
PXXXXXXXXXXIETXLGSXRFXXXXXXXXXXDXXXXXXXXXIIKLNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38568 - protein, 66 aa, Diabrotica virgifera
  misc_feature: Coding regions on vcDNA: vcDNA=SeqID_18265; Strand=-; Position=0-197
  misc_feature (10)..(61): Xaa can be any naturally occurring amino acid
KKMPFFPQGXXXXXXXXXXXXXXXXXXXXXXXXXXXXXXXXXXXXXXXXXXXXXXXXXXXXIRVFS

SEQ ID NO: 38569 - protein, 60 aa, Diabrotica virgifera
  misc_feature: Coding regions on vcDNA: vcDNA=SeqID_18266; Strand=-; Position=177-359
SVLILAKLVDHLTEVMITGEIVDLHRRWLSNLCSKNTPDLSGSIFRKASFITDSRDYESK

SEQ ID NO: 38570 - protein, 254 aa, Diabrotica virgifera
  misc_feature: Coding regions on vcDNA: vcDNA=SeqID_18267; Strand=-; Position=1-762
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
  misc_feature (68)..(254): Xaa can be any naturally occurring amino acid
GPSXXXXXXXXXXXTNLALTVLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38571 - protein, 287 aa, Diabrotica virgifera
  misc_feature: Coding regions on vcDNA: vcDNA=SeqID_18268; Strand=-; Position=1-861
  misc_feature (1)..(12): Xaa can be any naturally occurring amino acid
  misc_feature (14)..(25): Xaa can be any naturally occurring amino acid
  misc_feature (27)..(285): Xaa can be any naturally occurring amino acid
XXXXXXXXXXXXNXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQM

SEQ ID NO: 38572 - protein, 89 aa, Diabrotica virgifera
  misc_feature: Coding regions on vcDNA: vcDNA=SeqID_18269; Strand=-; Position=1-267
  misc_feature (46)..(89): Xaa can be any naturally occurring amino acid
VMMLILALNLHTLNLFSINFSLTSTFNLSKFNANILTIAKLFKFSXXXXXXXXXXXXXXXXXXXXXXXXXXXXXXXXXXXXXXXXXXXX

SEQ ID NO: 38573 - protein, 242 aa, Diabrotica virgifera
  misc_feature: Coding regions on vcDNA: vcDNA=SeqID_18270; Strand=+; Position=100-828
  misc_feature: Homolog annotation: Hit_ID=NP_572604.1; Match level="QueryCoverage =94%, HitCoverage=82%, E-value=1e-71, Identity=57%"; Hit description =CG2974-PA [Drosophila melanogaster] gb|AAF46554.1| CG2974-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=YjeF_N; Match level="Score=180.7, E-value =3.1e-51, Copies=1"; Pfam description=YjeF-related protein N-terminus
  misc_feature (178)..(186): Xaa can be any naturally occurring amino acid
  misc_feature (223)..(223): Xaa can be any naturally occurring amino acid
MVKLLGQKEAQSIDLELFNGYSFSVDQLMELAGLSCSSAIAKSYQHTDIGNKSILVCCGPGNNGGDGLVCARHLVLFGYKPVVYYPKETKNNLYNNLIKQCQLMNISVIKSLPDKSNFESEFGIIVDALFGFSFKPPVREEFIPVVSLMKETKVPIASIDIPSGWDVNSGPPEDGIKXXXXXXXXXPKMCAKFFEGKYHYLGGRFVPPALEEKYNLQLPKYPXTECCVLLPAVHDAKECNKK

SEQ ID NO: 38574 - protein, 257 aa, Diabrotica virgifera
  misc_feature: Coding regions on vcDNA: vcDNA=SeqID_18271; Strand=-; Position=216-989
  misc_feature (3)..(14): Xaa can be any naturally occurring amino acid
  misc_feature (16)..(63): Xaa can be any naturally occurring amino acid
  misc_feature (65)..(86): Xaa can be any naturally occurring amino acid
  misc_feature (96)..(102): Xaa can be any naturally occurring amino acid
  misc_feature (141)..(157): Xaa can be any naturally occurring amino acid
  misc_feature (175)..(190): Xaa can be any naturally occurring amino acid
  misc_feature (206)..(212): Xaa can be any naturally occurring amino acid
  misc_feature (219)..(237): Xaa can be any naturally occurring amino acid
KFXXXXXXXXXXXXIXXXXXXXXXXXXXXXXXXXXXXXXXXXXXXXXXXXXXXXXXXXXXXXXLXXXXXXXXXXXXXXXXXXXXXXFISFNLSFHXXXXXXXFILPYHLQNISSIQIITYHLNLYINSKLHISNKQYTIIXXXXXXXXXXXXXXXXXLLLILTSFLNLNNQNLYXXXXXXXXXXXXXXXXLITYHKLLYFSFLYFXXXXXXXTNLSLHXXXXXXXXXXXXXXXXXXXPNKLHLFIYLNHKHHQSLLT

SEQ ID NO: 38575 - protein, 54 aa, Diabrotica virgifera
  misc_feature: Coding regions on vcDNA: vcDNA=SeqID_18272; Strand=+; Position=41-202
  misc_feature (13)..(20): Xaa can be any naturally occurring amino acid
  misc_feature (23)..(30): Xaa can be any naturally occurring amino acid
  misc_feature (44)..(50): Xaa can be any naturally occurring amino acid
RLRPRCWIKVILXXXXXXXXWSXXXXXXXXSLTGGDPGGFQSLXXXXXXXRKGP

SEQ ID NO: 38576 - protein, 61 aa, Diabrotica virgifera
  misc_feature: Coding regions on vcDNA: vcDNA=SeqID_18273; Strand=+; Position=53-238
HNIICIQVNNFHLYLYPLLIRSGDCSSAITKEILTTLSSSNTTNEKIEVTLRVLRNTRKKR

SEQ ID NO: 38577 - protein, 49 aa, Diabrotica virgifera
  misc_feature: Coding regions on vcDNA: vcDNA=SeqID_18274; Strand=-; Position=1-147
YVSRRLGSKYKCLRYKHKIHFVNRDHLAFNTNFFNDKQKRYVNLNIYYN

SEQ ID NO: 38578 - protein, 273 aa, Diabrotica virgifera
  misc_feature: Coding regions on vcDNA: vcDNA=SeqID_18275; Strand=+; Position=76-893
  misc_feature: Homolog annotation: Hit_ID=EAA00113.2; Match level="QueryCoverage =98%, HitCoverage=45%, E-value=1e-52, Identity=43%"; Hit description =ENSANGP00000021203 [Anopheles gambiae str. PEST] ref|XP_552342.1| ENSANGP00000021203 [Anopheles gambiae st
  misc_feature: Pfam annotation: Pfam_ID=RRM_1; Match level="Score=18.3, E-value =0.00071, Copies=1"; Pfam description=RNA recognition motif. (a.k.a. RRM, R
  misc_feature (190)..(190): Xaa can be any naturally occurring amino acid
  misc_feature (241)..(241): Xaa can be any naturally occurring amino acid
  misc_feature (256)..(256): Xaa can be any naturally occurring amino acid
MENSTEGLSSGRLKKIEKKLRKLQHVIQKEVGAQCSVDNATKILVLANAGLINGLTEEIVFEHFSKYGTITNILLIPGKSCCFLQYKEEGSAVNAYHNYNGTLKIAQDSKPIYLLYCDALPKVELNRTWNGSVPGLVIIDDFVSAEEERLLLQLNNFEVEDTGQMKHRQVKHFGYEFRYDINNIDKDKPXEDKIPEECNFWRRLENMEFKGFIPDQLTVNHYLPGQGIPHHIDTHSAFEDXIMSLSLGSFSIMEFXKDDAHVCVLLPQRSLTI

SEQ ID NO: 38579 - protein, 89 aa, Diabrotica virgifera
  misc_feature: Coding regions on vcDNA: vcDNA=SeqID_18276; Strand=+; Position=80-349
  misc_feature (8)..(14): Xaa can be any naturally occurring amino acid
WLKLYNLXXXXXXXLLRAWAQSVACQGVQCVLNERIHLFRILRKLINVFERFKPRMKDYIITEGRKYLKTSVMFILISYRGENKEDNLV

SEQ ID NO: 38580 - protein, 72 aa, Diabrotica virgifera
  misc_feature: Coding regions on vcDNA: vcDNA=SeqID_18277; Strand=+; Position=223-441
KMCITVCKLQAGALNIRNVYHCFFWFYSMDLMDCRCRLSTSSLPLESQPESSHSSGITSSSAQQDTEMYFLE

SEQ ID NO: 38581 - protein, 189 aa, Diabrotica virgifera
  misc_feature: Coding regions on vcDNA: vcDNA=SeqID_18278; Strand=+; Position=75-641
  misc_feature: Homolog annotation: Hit_ID=NP_919360.1; Match level="QueryCoverage =92%, HitCoverage=63%, E-value=6e-30, Identity=42%"; Hit description =carbonyl reductase 1-like [Danio rerio] gb|AAG23178.1| 20 beta -hydroxysteroid dehydrogenase
  misc_feature: Gene Ontology Annotation: Molecular function=carbonyl reductase (NADPH) activity; Cellular component=cellular_component unknown; Biological process=biological_process unknown
HGGLDLLINNAAIGFGRAATESPFVQASKTIEANYFGTLRVCEALFSLLRNNAKVVNLSSALGHLSKIPTENLRNEFSRKDLTISELSKLLEKFVKATENNTHVEDGWGNSTYAVSKVGVTALTIIQQRLFDEEQPNRNISINAVHPGYVKTDMTSHNVLLSIEEGARSALLAAFDAVLNEKYICKACT

SEQ ID NO: 38582 - protein, 61 aa, Diabrotica virgifera
  misc_feature: Coding regions on vcDNA: vcDNA=SeqID_18279; Strand=-; Position=146-331
SVFLTPHNVVFNDAIEDVKGDSVVIHHFCCRYLRRCRDYICLIFIFCRCVRPIIRGFYSSY

SEQ ID NO: 38583 - protein, 29 aa, Diabrotica virgifera
  misc_feature: Coding regions on vcDNA: vcDNA=SeqID_18280; Strand=-; Position=1-87
  misc_feature (1)..(29): Xaa can be any naturally occurring amino acid
XXXXXXXXXXXXXXXXXXXXXXXXXXXXX

SEQ ID NO: 38584 - protein, 85 aa, Diabrotica virgifera
  misc_feature: Coding regions on vcDNA: vcDNA=SeqID_18281; Strand=-; Position=1-255
  misc_feature (9)..(85): Xaa can be any naturally occurring amino acid
NSAVYPLRXXXXXXXXXXXXXXXXXXXXXXXXXXXXXXXXXXXXXXXXXXXXXXXXXXXXXXXXXXXXXXXXXXXXXXXXXXXXX

SEQ ID NO: 38585 - protein, 103 aa, Diabrotica virgifera
  misc_feature: Coding regions on vcDNA: vcDNA=SeqID_18282; Strand=+; Position=147-458
  misc_feature (6)..(12): Xaa can be any naturally occurring amino acid
SEERGXXXXXXXIILEGNAEDQEEDLEHDGQTKLRLWWENHNMKASIWHRIAAIGYSKLTIFRVSPRPDKGSRNEEERVFILKLIVKVRQDMLRMPYRTSSRT

SEQ ID NO: 38586 - protein, 67 aa, Diabrotica virgifera
  misc_feature: Coding regions on vcDNA: vcDNA=SeqID_18283; Strand=-; Position=2-202
  misc_feature (12)..(27): Xaa can be any naturally occurring amino acid
KPLMFIDHWVYXXXXXXXXXXXXXXXXPFFFLHLLPLQKNLMISPSRQNARPFQLISGRRRLILIQK

SEQ ID NO: 38587 - protein, 87 aa, Diabrotica virgifera
  misc_feature: Coding regions on vcDNA: vcDNA=SeqID_18284; Strand=+; Position=722-982
  misc_feature (73)..(85): Xaa can be any naturally occurring amino acid
VLVLLFILTISSDDDSFVESFLPKEKIINTHFDIPMYSLPKFISSGTKLITFLNNFYLCFKNKNPWAFLPTKXXXXXXXXXXXXXLE

SEQ ID NO: 38588 - protein, 231 aa, Diabrotica virgifera
  misc_feature: Coding regions on vcDNA: vcDNA=SeqID_18285; Strand=-; Position=0-692
  misc_feature (1)..(214): Xaa can be any naturally occurring amino acid
  misc_feature (217)..(229): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXXXXXXXXXXXXXKG

SEQ ID NO: 38589 - protein, 96 aa, Diabrotica virgifera
  misc_feature: Coding regions on vcDNA: vcDNA=SeqID_18286; Strand=-; Position=274-564
NRCSLSLLTTHKPAIGLSMYKTAYFWGYIYSDQEEAGEPQIHQINSVDLSFQMVSKPSGSDIHTTQYSRKTEKLNFENFGFSTITQHFNLRIAPIT

SEQ ID NO: 38590 - protein, 36 aa, Diabrotica virgifera
  misc_feature: Coding regions on vcDNA: vcDNA=SeqID_18287; Strand=-; Position=1-108
  misc_feature (7)..(36): Xaa can be any naturally occurring amino acid
IIYKLYXXXXXXXXXXXXXXXXXXXXXXXXXXXXXX

SEQ ID NO: 38591 - protein, 106 aa, Diabrotica virgifera
  misc_feature: Coding regions on vcDNA: vcDNA=SeqID_18288; Strand=+; Position=2-322
  misc_feature (74)..(81): Xaa can be any naturally occurring amino acid
SLFLTLLGHSFLFIVSSSFKPFSLNSSAHSSSIFLSVFFYFSYPQLLTALCYMYCSVEFKFRWIRFDLTFLDLXXXXXXXXKIDIDRTNDLSLVSRNLSLKMTFLM

SEQ ID NO: 38592 - protein, 82 aa, Diabrotica virgifera
  misc_feature: Coding regions on vcDNA: vcDNA=SeqID_18289; Strand=-; Position=2-247
  misc_feature (5)..(16): Xaa can be any naturally occurring amino acid
  misc_feature (19)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid
SGKKXXXXXXXXXXXXLSXXXXXXXXXXXTTWAHTGLNXXXXXXXXSNXXXXXXXXXXXXXXPTSRSXXXXXXXXXXXXXXV

SEQ ID NO: 38593 - protein, 312 aa, Diabrotica virgifera
  misc_feature: Coding regions on vcDNA: vcDNA=SeqID_18290; Strand=-; Position=2-936
  misc_feature: Homolog annotation: Hit_ID=NP_001004509.1; Match level="QueryCoverage= 95%, HitCoverage=21%, E-value=1e-44, Identity=34%"; Hit description =si:busm1-180o5.3 [Danio rerio] emb|CAD60788.1| novel protein similar to DNA polymerases [Danio
  misc_feature (48)..(48): Xaa can be any naturally occurring amino acid
REENQSYVGPMPDLKFYDPDNLKDDARDKLIAWHAERVDEGYVFDFKXEIVEYCISDVEILTKACLTFRKQLMDTSNVCPFFEATTVASTCNKVFRRNFLQPNTIALIPKGGYRFKDNQSKIALQWLLWEEKQRCIKIQHAARGLEALIGNCRVDGLYENTIFEFQGCYYHGCPTCYPTDRTAPLHDDPSDCMENRHDKTIAKVKHLRSIGYEVVEIWECQFRKMLTAEIKAYTEGHPLMASLPLNPRDALYGGRTGNTVEYYKCKDGEKIKYVDVCSLYPWVCKYGKFPIGHPKKIYIGQECTAVDITELS

SEQ ID NO: 38594 - protein, 36 aa, Diabrotica virgifera
  misc_feature: Coding regions on vcDNA: vcDNA=SeqID_18291; Strand=+; Position=3-113
  misc_feature (1)..(7): Xaa can be any naturally occurring amino acid
XXXXXXXKFFDPFFLLITMHYLRDSSVASLQRSNPQ

SEQ ID NO: 38595 - protein, 262 aa, Diabrotica virgifera
  misc_feature: Coding regions on vcDNA: vcDNA=SeqID_18292; Strand=-; Position=3-788
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(235): Xaa can be any naturally occurring amino acid
  misc_feature (237)..(262): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXX

SEQ ID NO: 38596 - protein, 154 aa, Diabrotica virgifera
  misc_feature: Coding regions on vcDNA: vcDNA=SeqID_18293; Strand=+; Position=185-649
  misc_feature (1)..(50): Xaa can be any naturally occurring amino acid
  misc_feature (58)..(71): Xaa can be any naturally occurring amino acid
  misc_feature (88)..(95): Xaa can be any naturally occurring amino acid
  misc_feature (103)..(120): Xaa can be any naturally occurring amino acid
  misc_feature (123)..(138): Xaa can be any naturally occurring amino acid
XXXXXXXXXXXXXXXXXXXXXXXXXXXXXXXXXXXXXXXXXXXXXXXXXXILSPLNIXXXXXXXXXXXXXXLQIQIRITTFHTLQYVXXXXXXXXFLFLIHFXXXXXXXXXXXXXXXXXXLKXXXXXXXXXXXXXXXXNIFFTCLYNHVFLSLI

SEQ ID NO: 38597 - protein, 25 aa, Diabrotica virgifera
  misc_feature: Coding regions on vcDNA: vcDNA=SeqID_18294; Strand=-; Position=1-75
  misc_feature (6)..(25): Xaa can be any naturally occurring amino acid
VKIPRXXXXXXXXXXXXXXXXXXXX

SEQ ID NO: 38598 - protein, 67 aa, Diabrotica virgifera
  misc_feature: Coding regions on vcDNA: vcDNA=SeqID_18295; Strand=-; Position=3-203
  misc_feature (4)..(13): Xaa can be any naturally occurring amino acid
  misc_feature (24)..(32): Xaa can be any naturally occurring amino acid
  misc_feature (34)..(47): Xaa can be any naturally occurring amino acid
  misc_feature (54)..(66): Xaa can be any naturally occurring amino acid
VLLXXXXXXXXXXETNLGSHRFKXXXXXXXXXEXXXXXXXXXXXXXXSNIEVAXXXXXXXXXXXXXC

SEQ ID NO: 38599 - protein, 35 aa, Diabrotica virgifera
  misc_feature: Coding regions on vcDNA: vcDNA=SeqID_18296; Strand=+; Position=76-180
  misc_feature (5)..(11): Xaa can be any naturally occurring amino acid
NIYIXXXXXXXNIVFTCLLQLCPVELNRTSRLPSD

SEQ ID NO: 38600 - protein, 154 aa, Diabrotica virgifera
  misc_feature: Coding regions on vcDNA: vcDNA=SeqID_18297; Strand=-; Position=5-469
NNLIYKRIQRVGCKLGFYHYLWFSDIVINIRQNSQDPSIKALIFHHMTDTPRSFIPSKQIIIATTFTTHDFSEINIFDDIITSSKKSVTNPVPYFQYYNLIIFFLLSCREIKISVKKYTFKNFFYFYNVNVWTKGKYIEHIYIYFWSIAAQKLL

SEQ ID NO: 38601 - protein, 77 aa, Diabrotica virgifera
  misc_feature: Coding regions on vcDNA: vcDNA=SeqID_18298; Strand=-; Position=40-273
  misc_feature (35)..(44): Xaa can be any naturally occurring amino acid
LTLWLGLNAQSHSKRTPPTNPHVGRTKRGSKILQXXXXXXXXXXPPCMEQSFSRSFGPFQTEKVSSDPSPKLIVSDI

SEQ ID NO: 38602 - protein, 44 aa, Diabrotica virgifera
  misc_feature: Coding regions on vcDNA: vcDNA=SeqID_18299; Strand=-; Position=2-133
  misc_feature (14)..(44): Xaa can be any naturally occurring amino acid
FELYNKITLLFLRXXXXXXXXXXXXXXXXXXXXXXXXXXXXXXX

SEQ ID NO: 38603 - protein, 158 aa, Diabrotica virgifera
  misc_feature: Coding regions on vcDNA: vcDNA=SeqID_18300; Strand=-; Position=328-804
  misc_feature (5)..(15): Xaa can be any naturally occurring amino acid
  misc_feature (30)..(37): Xaa can be any naturally occurring amino acid
  misc_feature (41)..(60): Xaa can be any naturally occurring amino acid
  misc_feature (63)..(93): Xaa can be any naturally occurring amino acid
  misc_feature (96)..(123): Xaa can be any naturally occurring amino acid
  misc_feature (126)..(133): Xaa can be any naturally occurring amino acid
  misc_feature (139)..(158): Xaa can be any naturally occurring amino acid
FTLNXXXXXXXXXXXFFSCNPSFKLSIKKXXXXXXXXGQYXXXXXXXXXXXXXXXXXXXXVFXXXXXXXXXXXXXXXXXXXXXXXXXXXXXXXPYXXXXXXXXXXXXXXXXXXXXXXXXXXXXVIXXXXXXXXFLLKTXXXXXXXXXXXXXXXXXXXX

SEQ ID NO: 38604 - protein, 69 aa, Diabrotica virgifera
  misc_feature: Coding regions on vcDNA: vcDNA=SeqID_18301; Strand=-; Position=124-333
NFQPITHCRKSNYATFMSVQIFSEVKTFKVVIIEKRRKMSNLSLISRHFDYLNNVPDPFKWEDNSIIII

SEQ ID NO: 38605 - protein, 97 aa, Diabrotica virgifera
  misc_feature: Coding regions on vcDNA: vcDNA=SeqID_18302; Strand=+; Position=35-328
  misc_feature: Homolog annotation: Hit_ID=EAL28778.1; Match level="QueryCoverage =80%, HitCoverage=9%, E-value=9e-15, Identity=54%"; Hit description =GA10732-PA [Drosophila pseudoobscura]
  misc_feature (7)..(9): Xaa can be any naturally occurring amino acid
  misc_feature (11)..(15): Xaa can be any naturally occurring amino acid
  misc_feature (18)..(18): Xaa can be any naturally occurring amino acid
  misc_feature (32)..(32): Xaa can be any naturally occurring amino acid
  misc_feature (34)..(34): Xaa can be any naturally occurring amino acid
  misc_feature (58)..(58): Xaa can be any naturally occurring amino acid
  misc_feature (89)..(89): Xaa can be any naturally occurring amino acid
  misc_feature (97)..(97): Xaa can be any naturally occurring amino acid
RIIHKSXXXLXXXXXGGXCYVGGGVCFVFKNXDXNDLEKRLLKVKGCRNIRVKEVNGXISFMNSGDWFILDVGRDIYVYVGSKVRRVEXVKGINGGX

SEQ ID NO: 38606 - protein, 69 aa, Diabrotica virgifera
  misc_feature: Coding regions on vcDNA: vcDNA=SeqID_18303; Strand=+; Position=1-210
  misc_feature: Pfam annotation: Pfam_ID=Collagen; Match level="Score=-11.6, E-value =0.00094, Copies=1"; Pfam description=Collagen triple helix repeat (20 copie
VQGPMGVPGVGVPGPMGERGEPGRQGTPGLRGAPGAQGPPGYCEFCNNYNAAAQNYQAYMASSGNNKGP

SEQ ID NO: 38607 - protein, 249 aa, Diabrotica virgifera
  misc_feature: Coding regions on vcDNA: vcDNA=SeqID_18304; Strand=+; Position=76-825
  misc_feature: Homolog annotation: Hit_ID=XP_214460.2; Match level="QueryCoverage =86%, HitCoverage=60%, E-value=2e-18, Identity=28%"; Hit description =similar to ribonuclease P1 [Rattus norvegicus]
MESPEVFNFSAPGYSFTIDKFKGKLPINHSVSIIASNSTVLDQVLDSSRDKSIFYKVYDFSLVDLVNVEFLSSFTQNGRLTLLSINTRIDCDNCVGITPNNKLHLNLNKESYQCLGVDGSSSHFTKKLENRYTATVDLSDGKLLTNKKKFERLRSCLQVLEKFTVLVSWEPPDEEICPSSIAKFFVDLGYRVKEYRATNYFHKINTKVFSPNLESDDEFDTLEFVEWLGMVMLGCNLKRDPNEPIYLVI

SEQ ID NO: 38608 - protein, 151 aa, Diabrotica virgifera
  misc_feature: Coding regions on vcDNA: vcDNA=SeqID_18305; Strand=-; Position=140-595
  misc_feature (61)..(134): Xaa can be any naturally occurring amino acid
PKKEKKREKKAATRGSFSLWLSLFKEGGISKPRLICDSPQLIILSFIYTQSLVSYFFLWPXXXXXXXXXXXXXXXXXXXXXXXXXXXXXXXXXXXXXXXXXXXXXXXXXXXXXXXXXXXXXXXXXXXXXXXXXXYKIRIFLFNIIKANTNV

SEQ ID NO: 38609 - protein, 20 aa, Diabrotica virgifera
  misc_feature: Coding regions on vcDNA: vcDNA=SeqID_18306; Strand=-; Position=1-60
  misc_feature (10)..(10): Xaa can be any naturally occurring amino acid
SQSLLSIDFXQLKLRCIPKG

SEQ ID NO: 38610 - protein, 68 aa, Diabrotica virgifera
  misc_feature: Coding regions on vcDNA: vcDNA=SeqID_18307; Strand=+; Position=37-243
YDIHGFYKSVLTAINHDVLLKKLSTYGLSNNFIKLIKSYLENRRFIVRHKGNVSGKFYVNSGDPAETS

SEQ ID NO: 38611 - protein, 82 aa, Diabrotica virgifera
  misc_feature: Coding regions on vcDNA: vcDNA=SeqID_18308; Strand=+; Position=76-324
  misc_feature: Homolog annotation: Hit_ID=AAP55852.1; Match level="QueryCoverage =80%, HitCoverage=60%, E-value=2e-15, Identity=61%"; Hit description =GBR5 [Panax ginseng]
  misc_feature: Pfam annotation: Pfam_ID=GRP; Match level="Score=-14.7, E-value =0.002, Copies=1"; Pfam description=Glycine rich protein family
MAAPAEEADHAAGLQPAAVDLEPADLETAASAYRGHGYHGGHGYHGGHGYHGGHGYHGGHGYHGGHGYHGGHGHHGGHGYHG

SEQ ID NO: 38612 - protein, 64 aa, Diabrotica virgifera
  misc_feature: Coding regions on vcDNA: vcDNA=SeqID_18309; Strand=+; Position=14-208
YMISIQETNHLLYLEYQQNINYRKIYSKIFELQLQLQDHNSLLVKDALYADFFMTETTFHLHSS

SEQ ID NO: 38613 - protein, 154 aa, Diabrotica virgifera
  misc_feature: Coding regions on vcDNA: vcDNA=SeqID_18310; Strand=-; Position=224-688
  misc_feature (19)..(32): Xaa can be any naturally occurring amino acid
  misc_feature (86)..(137): Xaa can be any naturally occurring amino acid
  misc_feature (140)..(147): Xaa can be any naturally occurring amino acid
NGPFQGGSLFPLGLANFWXXXXXXXXXXXXXXGKGGFLPRALIWVPPGFSPPPGFKTRPRELNLGAPLKKFCLPTPPSLNWVPLNXXXXXXXXXXXXXXXXXXXXXXXXXXXXXXXXXXXXXXXXXXXXXXXXXXXXYSXXXXXXXXTLINMQH

SEQ ID NO: 38614 - protein, 98 aa, Diabrotica virgifera
  misc_feature: Coding regions on vcDNA: vcDNA=SeqID_18311; Strand=-; Position=52-348
KLQCFEYNMSNSDHYRTYQSIISESKIEKLVEILKVKKCGYDHLHKYLLNSPRTKQWLQLQFNPHYFEVIAFSILPQNNVDRIIITTNARLWGYSAST

SEQ ID NO: 38615 - protein, 203 aa, Diabrotica virgifera
  misc_feature: Coding regions on vcDNA: vcDNA=SeqID_18312; Strand=+; Position=77-688
  misc_feature: Homolog annotation: Hit_ID=NP_003421.1; Match level="QueryCoverage =95%, HitCoverage=81%, E-value=2e-23, Identity=34%"; Hit description =zinc finger protein 91 (HPF7, HTF10) [Homo sapiens] sp|Q05481|ZN91 _HUMAN Zinc finger protein
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=80.3, E-value=5e- 21, Copies=5"; Pfam description=Zinc finger, C2H2 type
  misc_feature (123)..(128): Xaa can be any naturally occurring amino acid
MHFGETTTEELGKTSPIKNDLNKDSLELDTSQFENCDVAYRKKWLLEEHIRKHNKERPFVCTSPDCNKTFTKDSHLKRHKVMVHEKSCEQICDFEDCGKIFNNKYSLKKHKTKVHDKNYSFIXXXXXXGFLKRCHLTQHMFVHTGEPPFKCHTCNLGFLLSRDLAKHNRNHKTYTCECGEIFDRWSKLRAHKRGYLQTYRKEM

SEQ ID NO: 38616 - protein, 101 aa, Diabrotica virgifera
  misc_feature: Coding regions on vcDNA: vcDNA=SeqID_18313; Strand=+; Position=366-668
  misc_feature: Homolog annotation: Hit_ID=XP_540905.1; Match level="QueryCoverage =87%, HitCoverage=5%, E-value=2e-13, Identity=42%"; Hit description =PREDICTED: similar to glucosidase II alpha subunit [Canis familiaris]
  misc_feature: Gene Ontology Annotation: Molecular function=protein binding; Cellular component=alpha-glucosidase complex
EHLDLFVSLHIEYYHLDVFEYELDSAMFIYGELRVVYAHSPKRSIGAFWLIAAETWVVINNNKDGIVMFYIVILVSGYKFEIKVDVPFMSDSVVVELFIFV

SEQ ID NO: 38617 - protein, 180 aa, Diabrotica virgifera
  misc_feature: Coding regions on vcDNA: vcDNA=SeqID_18314; Strand=+; Position=3-545
  misc_feature: Homolog annotation: Hit_ID=XP_315489.1; Match level="QueryCoverage =88%, HitCoverage=64%, E-value=7e-30, Identity=40%"; Hit description =ENSANGP00000021853 [Anopheles gambiae]
AFLRHGVFKTGRVVSSKNVLLRSFATKAEKRKGIDRKVGPKIDSTAQSLASKGFLRQQRDYSPPEDVNSKLEAIFQTVVGSSDISTELTDLNQKFTLFMQCEQQLGHSIPNSLLHHMKTLKDVQIFYNMPVDTRTPLERMKSMDLPENLHVQYEYKRFNADTDTMFGKSSTIVTGCKIQR

SEQ ID NO: 38618 - protein, 67 aa, Diabrotica virgifera
  misc_feature: Coding regions on vcDNA: vcDNA=SeqID_18315; Strand=-; Position=265-468
SIMTYKQCIYSYYKLVISYYLICLYYQLISNMIVYHTGLFTLKISLYIMKHSNLYIGIGLISEYINT

SEQ ID NO: 38619 - protein, 278 aa, Diabrotica virgifera
  misc_feature: Coding regions on vcDNA: vcDNA=SeqID_18316; Strand=+; Position=31-865
  misc_feature: Homolog annotation: Hit_ID=XP_396580.1; Match level="QueryCoverage =75%, HitCoverage=31%, E-value=1e-50, Identity=46%"; Hit description =similar to RIKEN cDNA 4933437K13 [Apis mellifera]
  misc_feature (261)..(261): Xaa can be any naturally occurring amino acid
MVRKLSIENSGARDKYSTAVPGSLTPVTQEEIGELTPVSVEVNKNFESPDNSDEILELPTDISAVLSAVETKNKEEIDKREEKIEMLTKENDSLKDQVKKYLSAIQMLRNDDDEISDILEDLEIEAQPNYKVEAKMFEKKLVQVAEMHAELMDFNVMLQQNICQKESLLERLRGELEALRGPMPSDEMNSEGNFGSVNIWIPSAFLTGTGSNSHHVYQIFLRVGNDEWNIYRRYAQFHALHTDLKKLDPIVGTFDFPPKKXLRKKDSTLVEDRKKRLQ

SEQ ID NO: 38620 - protein, 54 aa, Diabrotica virgifera
  misc_feature: Coding regions on vcDNA: vcDNA=SeqID_18317; Strand=-; Position=209-373
LICRAWDVRDLNYICLLDICFINHHFKYICLVFYYGLLLSSRSITCILHSSSCL

SEQ ID NO: 38621 - protein, 143 aa, Diabrotica virgifera
  misc_feature: Coding regions on vcDNA: vcDNA=SeqID_18318; Strand=-; Position=242-673
  misc_feature (1)..(8): Xaa can be any naturally occurring amino acid
  misc_feature (43)..(50): Xaa can be any naturally occurring amino acid
  misc_feature (67)..(89): Xaa can be any naturally occurring amino acid
  misc_feature (91)..(102): Xaa can be any naturally occurring amino acid
  misc_feature (115)..(122): Xaa can be any naturally occurring amino acid
  misc_feature (125)..(136): Xaa can be any naturally occurring amino acid
XXXXXXXXQIGQWAGESGWLIQKDDVFNKRVRKMLPKAVITAXXXXXXXXFLIRILSSLVSVNNVSXXXXXXXXXXXXXXXXXXXXXXXRXXXXXXXXXXXXLNVNKILCLSSSXXXXXXXXYKXXXXXXXXXXXXLSYLLKS

SEQ ID NO: 38622 - protein, 88 aa, Diabrotica virgifera
  misc_feature: Coding regions on vcDNA: vcDNA=SeqID_18319; Strand=-; Position=464-730
  misc_feature (51)..(66): Xaa can be any naturally occurring amino acid
  misc_feature (72)..(87): Xaa can be any naturally occurring amino acid
KKLFAVILVLQKIWYRHGSGRGISGYYPGKDNQSLFYLKSGPRHYTIFGPXXXXXXXXXXXXXXXXNVVAPXXXXXXXXXXXXXXXXR

SEQ ID NO: 38623 - protein, 68 aa, Diabrotica virgifera
  misc_feature: Coding regions on vcDNA: vcDNA=SeqID_18320; Strand=-; Position=62-268
HSSIFFMNITIFISPLTVSLIKHFHNLCIIKFHIIYISTKTIQQKQSNYHYIYSSLLIINIHIFLYHN

SEQ ID NO: 38624 - protein, 73 aa, Diabrotica virgifera
  misc_feature: Coding regions on vcDNA: vcDNA=SeqID_18321; Strand=+; Position=1-219
  misc_feature (1)..(72): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXL

SEQ ID NO: 38625 - protein, 109 aa, Diabrotica virgifera
  misc_feature: Coding regions on vcDNA: vcDNA=SeqID_18322; Strand=+; Position=331-657
  misc_feature: Homolog annotation: Hit_ID=AAV52183.1; Match level="QueryCoverage =91%, HitCoverage=23%, E-value=8e-16, Identity=51%"; Hit description =elongation factor-1 alpha [Bicyclus funebris]
  misc_feature (30)..(30): Xaa can be any naturally occurring amino acid
  misc_feature (50)..(50): Xaa can be any naturally occurring amino acid
  misc_feature (78)..(78): Xaa can be any naturally occurring amino acid
  misc_feature (88)..(88): Xaa can be any naturally occurring amino acid
TYRNLKTPKYYVIMHVHAPEHEDIVTIMIXTETSQTDCAALIAAAETAVXALDITDNALAQKHDLLALTLEELQLIVXVDNMKSTDAXYNESPSKEILKKVSSYIMTSV

SEQ ID NO: 38626 - protein, 293 aa, Diabrotica virgifera
  misc_feature: Coding regions on vcDNA: vcDNA=SeqID_18323; Strand=-; Position=1-879
  misc_feature (9)..(9): Xaa can be any naturally occurring amino acid
  misc_feature (14)..(291): Xaa can be any naturally occurring amino acid
GNYFYIKKXWIKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKL

SEQ ID NO: 38627 - protein, 257 aa, Diabrotica virgifera
  misc_feature: Coding regions on vcDNA: vcDNA=SeqID_18324; Strand=-; Position=1-771
  misc_feature (4)..(22): Xaa can be any naturally occurring amino acid
  misc_feature (26)..(240): Xaa can be any naturally occurring amino acid
  misc_feature (244)..(252): Xaa can be any naturally occurring amino acid
FSSXXXXXXXXXXXXXXXXXXXKIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVERXXXXXXXXXGALWR

SEQ ID NO: 38628 - protein, 85 aa, Diabrotica virgifera
  misc_feature: Coding regions on vcDNA: vcDNA=SeqID_18325; Strand=-; Position=105-362
YDYVSVLCGYLSLMIVTTYYTLISFQATRSVLPFHLDGSTPYFCNLPIDSSLPFFRFTLAYLLFLRSGRFSYSFSLSLVDDPIYI

SEQ ID NO: 38629 - protein, 127 aa, Diabrotica virgifera
  misc_feature: Coding regions on vcDNA: vcDNA=SeqID_18326; Strand=+; Position=1-384
  misc_feature (1)..(15): Xaa can be any naturally occurring amino acid
  misc_feature (20)..(39): Xaa can be any naturally occurring amino acid
  misc_feature (41)..(58): Xaa can be any naturally occurring amino acid
  misc_feature (65)..(76): Xaa can be any naturally occurring amino acid
  misc_feature (92)..(112): Xaa can be any naturally occurring amino acid
  misc_feature (117)..(125): Xaa can be any naturally occurring amino acid
XXXXXXXXXXXXXXXAISIXXXXXXXXXXXXXXXXXXXXHXXXXXXXXXXXXXXXXXXHHFHWNXXXXXXXXXXXXHSLLNISHSLRNKLHXXXXXXXXXXXXXXXXXXXXXRMTSXXXXXXXXXLK

SEQ ID NO: 38630 - protein, 79 aa, Diabrotica virgifera
  misc_feature: Coding regions on vcDNA: vcDNA=SeqID_18327; Strand=-; Position=2-238
  misc_feature (2)..(12): Xaa can be any naturally occurring amino acid
  misc_feature (14)..(14): Xaa can be any naturally occurring amino acid
  misc_feature (16)..(26): Xaa can be any naturally occurring amino acid
  misc_feature (34)..(34): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
IXXXXXXXXXXXGXFXXXXXXXXXXXTNLAHTGXNXXXXXXXXSNXXXXXXXXXXXXXXPTSRSXXXXXXXXXXXXXXV

SEQ ID NO: 38631 - protein, 74 aa, Diabrotica virgifera
  misc_feature: Coding regions on vcDNA: vcDNA=SeqID_18328; Strand=-; Position=211-435
  misc_feature (45)..(51): Xaa can be any naturally occurring amino acid
NEYKISNESKKTETLVLTKKKYLTCIFAQYFTLNFLRFLKLVKRXXXXXXXHIFPFLALSIQFYTWCFKKGNTA

SEQ ID NO: 38632 - protein, 96 aa, Diabrotica virgifera
  misc_feature: Coding regions on vcDNA: vcDNA=SeqID_18329; Strand=+; Position=403-690
STGNNFAWLEVNCAGVEMFVASIGLRNFRRTGRTRSVGCRFLSEYQGIASHMVCRVDASFGTVCVFKLLRTANNKQIFDGRAVEFASQIVTTRSSK

SEQ ID NO: 38633 - protein, 201 aa, Diabrotica virgifera
  misc_feature: Coding regions on vcDNA: vcDNA=SeqID_18330; Strand=-; Position=203-808
  misc_feature (1)..(159): Xaa can be any naturally occurring amino acid
  misc_feature (166)..(172): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKYVIMXXXXXXXENIFLNKLDILNHECHIQANKFFNFCSLH

SEQ ID NO: 38634 - protein, 250 aa, Diabrotica virgifera
  misc_feature: Coding regions on vcDNA: vcDNA=SeqID_18331; Strand=+; Position=134-883
  misc_feature: Homolog annotation: Hit_ID=EAL32020.1; Match level="QueryCoverage =66%, HitCoverage=38%, E-value=4e-40, Identity=46%"; Hit description =GA12511-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=zf-MYND; Match level="Score=35.0, E-value =2.3e-07, Copies=1"; Pfam description=MYND finger
MKIINKKEIPQGGLILEEKPFAYILCEKFRTVRCDFCFQKGQLLKCSFCRYTYYCGRACQREGWTVHKLECKYLKQISPRILPDSGRLLARLIKVLEKGGHNTKSYYTDIRFRTFKDLMSHYPNLKNDSTRMEHFSSLYAVLYEFFRGESLPNSAELMGMYGRIYISYIDVMATKKERLQELEQAYYFLCRCVKCINPEPIIEMTGAACPNSDCNNCFDSFTIKPDDECSACGTIISGEFIVFQRCDGYD

SEQ ID NO: 38635 - protein, 208 aa, Diabrotica virgifera
  misc_feature: Coding regions on vcDNA: vcDNA=SeqID_18332; Strand=+; Position=2-628
  misc_feature: Homolog annotation: Hit_ID=AAH60482.1; Match level="QueryCoverage =72%, HitCoverage=33%, E-value=2e-27, Identity=43%"; Hit description =MGC68721 protein [Xenopus laevis]
  misc_feature: Gene Ontology Annotation: Molecular function=phospholipase A1 activity; Cellular component=extracellular space; Biological process= phosphatidylserine metabolism
  misc_feature: Pfam annotation: Pfam_ID=Lipase; Match level="Score=-40.1, E-value =1.1e-09, Copies=1"; Pfam description=Lipase
QYLSLLVLVAVFTATNCSTYLPERHWAKGAANFEKAAANTKKLGELIGKYIIDNEIELEDLQLVGFDIGAHAAGQAGKYIANLTGHYVSRITGLDPAAPKFELDSVPPENKLQKTDAIFVDVIHTNVQKLGYKVPIGHVDWYVNVGNEQPRCPTLMMSETDVCRHLRACYLYVESICYQVTSYECTGTIENDTSTVTLMPYWKTHRIW

SEQ ID NO: 38636 - protein, 146 aa, Diabrotica virgifera
  misc_feature: Coding regions on vcDNA: vcDNA=SeqID_18333; Strand=+; Position=362-799
  misc_feature (110)..(117): Xaa can be any naturally occurring amino acid
NQINMEIKQEASEETCKIRVEDTCVGSSFDVCKIEIIEEPKREPVYDAFDYLDSNEFSIDTKVEQDEYKFSLVEEKLTTNEESCPQENKINIMETSYSSHKGKYTGQDAXXXXXXXXMNVGTENRPYKCEFGFEQFTTKGIFGNSF

SEQ ID NO: 38637 - protein, 110 aa, Diabrotica virgifera
  misc_feature: Coding regions on vcDNA: vcDNA=SeqID_18334; Strand=+; Position=1-333
  misc_feature (23)..(33): Xaa can be any naturally occurring amino acid
  misc_feature (36)..(68): Xaa can be any naturally occurring amino acid
  misc_feature (73)..(85): Xaa can be any naturally occurring amino acid
  misc_feature (90)..(98): Xaa can be any naturally occurring amino acid
NIGRVRRLAVPAPRTSPFRFTRXXXXXXXXXXXLHXXXXXXXXXXXXXXXXXXXXXXXXXXXXXXXXXPCVSXXXXXXXXXXXXXHVQEXXXXXXXXXLNILSKYFGRKW

SEQ ID NO: 38638 - protein, 84 aa, Diabrotica virgifera
  misc_feature: Coding regions on vcDNA: vcDNA=SeqID_18335; Strand=-; Position=189-443
NKQLFHYYTLYHLKIVYCTTREKKDIFLTSTEVCWHKPRYEARAANQAREKYVVFSRVVHCTFSMDAFFSRVQTTKFNNLGAFM

SEQ ID NO: 38639 - protein, 154 aa, Diabrotica virgifera
  misc_feature: Coding regions on vcDNA: vcDNA=SeqID_18336; Strand=+; Position=25-489
  misc_feature (70)..(76): Xaa can be any naturally occurring amino acid
IKPKLKMAAKLAFFFTFFLVAVYITEAVNVRNKTEAAVKEATETVHLHTADIKNQTENAAKEVHVHTSDXXXXXXXVAKEVAQAAEIPKTQTTAAQDIDSTLDNLKAGFEEFVDKVKNNDIVKKATQGIKDLGDTIQQKGKEAYDKITSETKTR

SEQ ID NO: 38640 - protein, 66 aa, Diabrotica virgifera; identical to SEQ ID NO: 26808
  misc_feature: Coding regions on vcDNA: vcDNA=SeqID_18337; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38641 - protein, 24 aa, Diabrotica virgifera
  misc_feature: Coding regions on vcDNA: vcDNA=SeqID_18338; Strand=-; Position=0-71
  misc_feature (1)..(23): Xaa can be any naturally occurring amino acid
XXXXXXXXXXXXXXXXXXXXXXXP

SEQ ID NO: 38642 - protein, 68 aa, Diabrotica virgifera
  misc_feature: Coding regions on vcDNA: vcDNA=SeqID_18339; Strand=+; Position=241-444
  misc_feature (65)..(65): Xaa can be any naturally occurring amino acid
VMIKKIRYFYHSTHVRTRNVEKLFGTGASFEILFGGGQALYILYCIYDVMMNIDVFFVNFSHFFXAGG

SEQ ID NO: 38643 - protein, 64 aa, Diabrotica virgifera
  misc_feature: Coding regions on vcDNA: vcDNA=SeqID_18340; Strand=-; Position=319-513
YRINRITISRLGVLVVFIGVIIIYYRFRKIYRWHPHTFISHCIKYCSSSLTSSLTFSLSSCCLS

SEQ ID NO: 38644 - protein, 85 aa, Diabrotica virgifera
  misc_feature: Coding regions on vcDNA: vcDNA=SeqID_18341; Strand=-; Position=161-418
ICADSFACWFLIQCRLLILYKTIFSAFNPPCCYFLCNYLLQFCATFWYKVVSAGEEFREGKTLQNNVIKATQRILFQIKSVYSFY

SEQ ID NO: 38645 - protein, 46 aa, Diabrotica virgifera
  misc_feature: Coding regions on vcDNA: vcDNA=SeqID_18342; Strand=-; Position=353-493
ICYRLLRVIRSFFEEFRSFTISSTSDLVSFTDTIMTNELWTNDHEF

SEQ ID NO: 38646 - protein, 246 aa, Diabrotica virgifera
  misc_feature: Coding regions on vcDNA: vcDNA=SeqID_18343; Strand=+; Position=83-818
  misc_feature: Homolog annotation: Hit_ID=S13329; Match level="QueryCoverage=91%, HitCoverage=24%, E-value=1e-47, Identity=41%"; Hit description =hypothetical protein 2 - fruit fly (Drosophila melanogaster)
  misc_feature: Pfam annotation: Pfam_ID=Exo_endo_phos; Match level="Score=87.4, E -value=3.6e-23, Copies=1"; Pfam description =Endonuclease/Exonuclease/phosphatase f
  misc_feature (18)..(18): Xaa can be any naturally occurring amino acid
  misc_feature (151)..(151): Xaa can be any naturally occurring amino acid
  misc_feature (208)..(208): Xaa can be any naturally occurring amino acid
  misc_feature (218)..(218): Xaa can be any naturally occurring amino acid
KELRTLQLIRIAEWNANXLLKRRQEIEIFLATNKVDILLVSETHLFASAQFKITSYKVYNAERNPRGGAAIIIRNNLKHHELPKIEKDFRQAVSICIEDNFGPLCISAVYCPPNYQPNKNGFETLFKSLGPRFLAGGDYNSKHKCWGSRLXPPGRGRFLYDVVKEMQLQYLSTYKPTYWPTDRNRLPDLLDFFIYKGIPKEYLHTEPXSSDHSPIIAXIMIKPSEKCPPPRLTNETQTGIFSKKIY

SEQ ID NO: 38647 - protein, 96 aa, Diabrotica virgifera
  misc_feature: Coding regions on vcDNA: vcDNA=SeqID_18344; Strand=+; Position=118-408
  misc_feature: Homolog annotation: Hit_ID=CAA84814.1; Match level="QueryCoverage =100%, HitCoverage=85%, E-value=3e-11, Identity=35%"; Hit description= ubiquitin [Tetrahymena pyriformis]
  misc_feature (21)..(21): Xaa can be any naturally occurring amino acid
  misc_feature (40)..(40): Xaa can be any naturally occurring amino acid
  misc_feature (66)..(66): Xaa can be any naturally occurring amino acid
  misc_feature (79)..(86): Xaa can be any naturally occurring amino acid
RLMYDGMKIEDGRNIYDYKIXRNIDVIMVFRYERIMNMFXKILNDKMMILKVKNSDKIENEKKELXEKEGMIKNELRLXXXXXXXXDVRSVIEYKI

SEQ ID NO: 38648 - protein, 18 aa, Diabrotica virgifera
  misc_feature: Coding regions on vcDNA: vcDNA=SeqID_18345; Strand=-; Position=1-54
  misc_feature (1)..(6): Xaa can be any naturally occurring amino acid
  misc_feature (9)..(18): Xaa can be any naturally occurring amino acid
XXXXXXLYXXXXXXXXXX

SEQ ID NO: 38649 - protein, 49 aa, Diabrotica virgifera
  misc_feature: Coding regions on vcDNA: vcDNA=SeqID_18346; Strand=+; Position=2-148
  misc_feature (2)..(15): Xaa can be any naturally occurring amino acid
  misc_feature (28)..(34): Xaa can be any naturally occurring amino acid
NXXXXXXXXXXXXXXRPRCWIKVYNWCXXXXXXXDRLLKVYLNLCLNRC

SEQ ID NO: 38650 - protein, 263 aa, Diabrotica virgifera
  misc_feature: Coding regions on vcDNA: vcDNA=SeqID_18347; Strand=+; Position=1-789
  misc_feature (3)..(258): Xaa can be any naturally occurring amino acid
  misc_feature (260)..(260): Xaa can be any naturally occurring amino acid
LVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXVKA

SEQ ID NO: 38651 - protein, 46 aa, Diabrotica virgifera
  misc_feature: Coding regions on vcDNA: vcDNA=SeqID_18348; Strand=-; Position=1-138
  misc_feature (37)..(37): Xaa can be any naturally occurring amino acid
LIVYYKFIFLRDTPFYYLHRKYICILSFCIQGWPQKXKLPPRAGSG

SEQ ID NO: 38652 - protein, 251 aa, Diabrotica virgifera
  misc_feature: Coding regions on vcDNA: vcDNA=SeqID_18349; Strand=+; Position=3-758
  misc_feature: Homolog annotation: Hit_ID=XP_393433.1; Match level="QueryCoverage =98%, HitCoverage=49%, E-value=3e-68, Identity=47%"; Hit description =similar to mKIAA1589 protein [Apis mellifera]
  misc_feature (251)..(251): Xaa can be any naturally occurring amino acid
YIGVQTEGPETNFKDLKVAVLDKLDSTEIRTMRDAKYIYLTLKSLNDKFQTDIQDSTAPLYLPAFFTCTEKCQSCKTNCSLSMGHKEEGEPHQSTQDCTFQHQYQNYVYLCKACYKNGHRSVVKPSYQTMTDNSWSSYLNYVWAGYVIECPKCGEIFRSRQHWYGNKNPEDAAVRAEVVHMWPGNKPFFQERSLFGSLNSAQKVLDGVSMFTDVISHVGSQPKKLLSDWAADKIAPSYWRPNHEIKVCFLX

SEQ ID NO: 38653 - protein, 299 aa, Diabrotica virgifera
  misc_feature: Coding regions on vcDNA: vcDNA=SeqID_18350; Strand=+; Position=43-942
  misc_feature: Homolog annotation: Hit_ID=XP_312380.1; Match level="QueryCoverage =86%, HitCoverage=78%, E-value=1e-30, Identity=30%"; Hit description =ENSANGP00000012173 [Anopheles gambiae]
  misc_feature: Pfam annotation: Pfam_ID=CRAL_TRIO; Match level="Score=-22.3, E-value= 0.002, Copies=1"; Pfam description=CRAL/TRIO domain
  misc_feature (243)..(243): Xaa can be any naturally occurring amino acid
  misc_feature (257)..(257): Xaa can be any naturally occurring amino acid
  misc_feature (259)..(259): Xaa can be any naturally occurring amino acid
MPPNDVLITDRNEIRKIWGKSENDVYKDIQIIKEWLKIQKHLPEIPTDNMIEFFLVNCKFSIEKTKQTLDMYYTVPSLVPDIYKNIHPCTSDVDLAYETANFVCVPVLTPSLHRLTVIQYKDSENGSVAKMSAHGLKNIYEIRIHEDLSMGEIYLVDCERVKFSVAAGITPVTLKQIAFVLERVHSFRTHSIHFINAPAYYHHTITLFKTFLKKKLSDRVYSHRSLDEVLKHLPLDILPSGLXGANKKSCAELQELXKXKMFEYKDRFDKLETMQVNEKLRPEKLENDEILSYYVNFKK

SEQ ID NO: 38654 - protein, 284 aa, Diabrotica virgifera
  misc_feature: Coding regions on vcDNA: vcDNA=SeqID_18351; Strand=-; Position=1-852
  misc_feature (7)..(8): Xaa can be any naturally occurring amino acid
  misc_feature (16)..(16): Xaa can be any naturally occurring amino acid
  misc_feature (21)..(283): Xaa can be any naturally occurring amino acid
KITLYPXXYYFLYQKXLDQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 38655 - protein, 75 aa, Diabrotica virgifera
  misc_feature: Coding regions on vcDNA: vcDNA=SeqID_18352; Strand=-; Position=1-225
  misc_feature (5)..(32): Xaa can be any naturally occurring amino acid
  misc_feature (39)..(48): Xaa can be any naturally occurring amino acid
  misc_feature (54)..(54): Xaa can be any naturally occurring amino acid
  misc_feature (57)..(74): Xaa can be any naturally occurring amino acid
KKWIXXXXXXXXXXXXXXXXXXXXXXXXXXXXINLKKLXXXXXXXXXXSSLKNXSFXXXXXXXXXXXXXXXXXXL

SEQ ID NO: 38656 - protein, 90 aa, Diabrotica virgifera
  misc_feature: Coding regions on vcDNA: vcDNA=SeqID_18353; Strand=+; Position=518-787
  misc_feature (87)..(87): Xaa can be any naturally occurring amino acid
SICYIESPTPYIYLSFGVSFLDHHHQLMLQPESKIAKSSFVIQSHLLTTVINSSQQFSSGKHNKKSIEAGFGDQGCYSNTIPYSLYXRSS

SEQ ID NO: 38657 - protein, 322 aa, Diabrotica virgifera
  misc_feature: Coding regions on vcDNA: vcDNA=SeqID_18354; Strand=-; Position=3-968
  misc_feature (2)..(9): Xaa can be any naturally occurring amino acid
  misc_feature (11)..(19): Xaa can be any naturally occurring amino acid
  misc_feature (30)..(43): Xaa can be any naturally occurring amino acid
  misc_feature (50)..(322): Xaa can be any naturally occurring amino acid
TXXXXXXXXEXXXXXXXXXNYKLNSTSRSXXXXXXXXXXXXXXVSLRYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38658 - protein, 164 aa, Diabrotica virgifera
  misc_feature: Coding regions on vcDNA: vcDNA=SeqID_18355; Strand=+; Position=315-806
  misc_feature: Pfam annotation: Pfam_ID=zf-C2H2; Match level="Score=27.7, E-value =3.5e-05, Copies=1"; Pfam description=Zinc finger, C2H2 type
  misc_feature (139)..(139): Xaa can be any naturally occurring amino acid
MEIKQEVSGKTCKIEIDHVTCVGPLDTLKVEVKEEPKTETEYQAFEYVDLNEFPVKTEVEQGEDKFIPFDEKQTRNEESCPETPKEENKMNIVETLLSSHKGKYTGQHAEGKISNTNMKVGTGQLLYQCEICLKQFSRXDSLPHHMKIHTGEKTFSNATLETTL

SEQ ID NO: 38659 - protein, 71 aa, Diabrotica virgifera
  misc_feature: Coding regions on vcDNA: vcDNA=SeqID_18356; Strand=+; Position=216-431
RSRHSTPSIYTFHINVANVYIITIKNDVYNIKKQTLLLITQNSICELHLHPKTRIITFTSLYISITYDGLP

SEQ ID NO: 38660 - protein, 75 aa, Diabrotica virgifera
  misc_feature: Coding regions on vcDNA: vcDNA=SeqID_18357; Strand=-; Position=207-434
  misc_feature (61)..(68): Xaa can be any naturally occurring amino acid
VNIRFVPTRYKTVLERLRVCAVTKNVLLRITIRYCACARRFKNGFVLSWKKPIKLIQKDTXXXXXXXXPGPSVFL

SEQ ID NO: 38661 - protein, 24 aa, Diabrotica virgifera
  misc_feature: Coding regions on vcDNA: vcDNA=SeqID_18358; Strand=-; Position=1-72
  misc_feature (4)..(17): Xaa can be any naturally occurring amino acid
  misc_feature (19)..(24): Xaa can be any naturally occurring amino acid
IIYXXXXXXXXXXXXXXSXXXXXX

SEQ ID NO: 38662 - protein, 21 aa, Diabrotica virgifera
  misc_feature: Coding regions on vcDNA: vcDNA=SeqID_18359; Strand=+; Position=1-66
  misc_feature (4)..(15): Xaa can be any naturally occurring amino acid
  misc_feature (18)..(18): Xaa can be any naturally occurring amino acid
  misc_feature (21)..(21): Xaa can be any naturally occurring amino acid
MKGXXXXXXXXXXXXRIXFLX

SEQ ID NO: 38663 - protein, 22 aa, Diabrotica virgifera
  misc_feature: Coding regions on vcDNA: vcDNA=SeqID_18360; Strand=-; Position=0-65
  misc_feature (1)..(21): Xaa can be any naturally occurring amino acid
XXXXXXXXXXXXXXXXXXXXXP

SEQ ID NO: 38664 - protein, 115 aa, Diabrotica virgifera
  misc_feature: Coding regions on vcDNA: vcDNA=SeqID_18361; Strand=+; Position=168-515
  misc_feature (37)..(115): Xaa can be any naturally occurring amino acid
LSCLSQLSIIVDRYAVYECNIYVRIICFVEKCYSFLXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38665 - protein, 168 aa, Diabrotica virgifera
  misc_feature: Coding regions on vcDNA: vcDNA=SeqID_18362; Strand=-; Position=1-504
  misc_feature (3)..(168): Xaa can be any naturally occurring amino acid
ITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38666 - protein, 115 aa, Diabrotica virgifera
  misc_feature: Coding regions on vcDNA: vcDNA=SeqID_18363; Strand=-; Position=1-345
  misc_feature (8)..(33): Xaa can be any naturally occurring amino acid
  misc_feature (35)..(115): Xaa can be any naturally occurring amino acid
VIPKVIIXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38667 - protein, 58 aa, Diabrotica virgifera
  misc_feature: Coding regions on vcDNA: vcDNA=SeqID_18364; Strand=-; Position=1-174
  misc_feature (1)..(32): Xaa can be any naturally occurring amino acid
  misc_feature (34)..(58): Xaa can be any naturally occurring amino acid
XXXXXXXXXXXXXXXXXXXXXXXXXXXXXXXXPXXXXXXXXXXXXXXXXXXXXXXXXX

SEQ ID NO: 38668 - protein, 79 aa, Diabrotica virgifera
  misc_feature: Coding regions on vcDNA: vcDNA=SeqID_18365; Strand=-; Position=102-341
  misc_feature (5)..(11): Xaa can be any naturally occurring amino acid
CNNEXXXXXXXEQTYQQNAACHFRPYPHFPKAFNFLLFVRIFSLIYLRIILFHIIFFSECSLFSLCLHLSGFRFIYRNR

SEQ ID NO: 38669 - protein, 73 aa, Diabrotica virgifera
  misc_feature: Coding regions on vcDNA: vcDNA=SeqID_18366; Strand=-; Position=3-221
  misc_feature (66)..(73): Xaa can be any naturally occurring amino acid
EFGRGFVKNFFTHFLGVFFVLYKKFKPFLPLKRNILNQLNEGQFFFHPPLLSSFHKKPQDYAPLAXXXXXXXX

SEQ ID NO: 38670 - protein, 34 aa, Diabrotica virgifera
  misc_feature: Coding regions on vcDNA: vcDNA=SeqID_18367; Strand=-; Position=1-102
YYFFVKFIHLIKNCALSWAKLLFCLINNRTCYLL

SEQ ID NO: 38671 - protein, 125 aa, Diabrotica virgifera
  misc_feature: Coding regions on vcDNA: vcDNA=SeqID_18368; Strand=+; Position=16-393
HLMMSDNPDNYNGRIPFPKDNSQDKILTTIFVLVGLVVATQVFYIFFITHTAKAFRKEVIRRGRLISVLPIISTIGATMPVHVNVQQTVNVPNAPQQNTYPPNAYTAPDGSRMFDDKVAPPAYVP

SEQ ID NO: 38672 - protein, 156 aa, Diabrotica virgifera
  misc_feature: Coding regions on vcDNA: vcDNA=SeqID_18369; Strand=+; Position=359-826
  misc_feature: Homolog annotation: Hit_ID=XP_393129.1; Match level="QueryCoverage =96%, HitCoverage=12%, E-value=1e-29, Identity=43%"; Hit description =similar to ENSANGP00000018598 [Apis mellifera]
  misc_feature: Gene Ontology Annotation: Molecular function=ceramidase activity; Cellular component=membrane fraction
  misc_feature (138)..(138): Xaa can be any naturally occurring amino acid
MNALHIIVSFYTLFITYRTVEAVYNVGVGRADCTGPIADVTLMGYGDPFQLGCGLHLRQFARAFIFDDSVSRVLFVTVDAGMVNHPGKQACIEKLDVIYPGGIYTCKHTLISATHTHSAAGDQFKDILLDISAFGCVXESFTAIVAAIVRAVQSAH

SEQ ID NO: 38673 - protein, 24 aa, Diabrotica virgifera
  misc_feature: Coding regions on vcDNA: vcDNA=SeqID_18370; Strand=-; Position=0-71
  misc_feature (1)..(22): Xaa can be any naturally occurring amino acid
XXXXXXXXXXXXXXXXXXXXXXPP

SEQ ID NO: 38674 - protein, 84 aa, Diabrotica virgifera
  misc_feature: Coding regions on vcDNA: vcDNA=SeqID_18371; Strand=+; Position=377-631
PISYYCRSIIPGSIHDRLYLSICDRNPSENNYRDMIYFTHTDYLYMNTKHVNLFFMKFHSFILDTYCMLILYFYLFPCPIFLPI

SEQ ID NO: 38675 - protein, 295 aa, Diabrotica virgifera
  misc_feature: Coding regions on vcDNA: vcDNA=SeqID_18372; Strand=+; Position=2-885
  misc_feature: Homolog annotation: Hit_ID=XP_315349.1; Match level="QueryCoverage =100%, HitCoverage=56%, E-value=1e-144, Identity=86%"; Hit description=ENSANGP00000021019 [Anopheles gambiae]
  misc_feature: Gene Ontology Annotation: Molecular function=molecular_function unknown; Cellular component=chromatin remodeling complex; Biological process=chromatin modeling
  misc_feature: Pfam annotation: Pfam_ID=SWIB; Match level="Score=111.3, E-value=2.4e- 30, Copies=1"; Pfam description=SWIB/MDM2 domain
  misc_feature (19)..(19): Xaa can be any naturally occurring amino acid
  misc_feature (263)..(263): Xaa can be any naturally occurring amino acid
  misc_feature (281)..(281): Xaa can be any naturally occurring amino acid
  misc_feature (290)..(290): Xaa can be any naturally occurring amino acid
ESQAYMDLLAFERKLDSTXMRKRLDIQEALKRPMKQKRKLRIFISNTFYPAKEPQPEGPDGPCQEGTVASWELRVEGRLLEDPKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDAHEREFIVCDKYLEQIFNCTRMKFAEIPQRLNPLLHPPDPIVINHVISVEGGAESKQTACYDIDVEVDDTLXTQMNNFLLSTASQQEIQXLDAKDSRTXDTINQ

SEQ ID NO: 38676 - protein, 44 aa, Diabrotica virgifera
  misc_feature: Coding regions on vcDNA: vcDNA=SeqID_18373; Strand=-; Position=0-131
  misc_feature (2)..(43): Xaa can be any naturally occurring amino acid
YXXXXXXXXXXXXXXXXXXXXXXXXXXXXXXXXXXXXXXXXXXP

SEQ ID NO: 38677 - protein, 63 aa, Diabrotica virgifera
  misc_feature: Coding regions on vcDNA: vcDNA=SeqID_18374; Strand=-; Position=123-314
KNRHTCVHTIIAILKIIPRIRSLRNVFHTMISHYQAFFNGVSKVHTSMDLRYETHYLSSSHSL

SEQ ID NO: 38678 - protein, 51 aa, Diabrotica virgifera
  misc_feature: Coding regions on vcDNA: vcDNA=SeqID_18375; Strand=-; Position=1-153
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
FXXXXXXXXXXXNQPGSHRFKXXXXXXXXXEXXXXXXXXXXXXXXSNIEVA

SEQ ID NO: 38679 - protein, 67 aa, Diabrotica virgifera
  misc_feature: Coding regions on vcDNA: vcDNA=SeqID_18376; Strand=+; Position=1-204
  misc_feature (13)..(23): Xaa can be any naturally occurring amino acid
ALFAPGRVHDNGXXXXXXXXXXXVIEWQEPQLEKLLFIQHTPLVFGLRVLGIVILETYIFDFRLRQM

SEQ ID NO: 38680 - protein, 112 aa, Diabrotica virgifera
  misc_feature: Coding regions on vcDNA: vcDNA=SeqID_18377; Strand=+; Position=336-671
  misc_feature: Homolog annotation: Hit_ID=AAT02773.1; Match level="QueryCoverage =92%, HitCoverage=68%, E-value=3e-16, Identity=45%"; Hit description =cytochrome oxidase subunit I [Diabrotica virgifera virgifera]
AADPPLYPPLASDIAPGDPSIYISLLTVLSSVISAIIFVTTFITTRPIILPLDLIPLLVPLVVCTAILPLLPLLLSLPAITVSITELLSDPSLYASFVDPDAVLYPHLYRHL

SEQ ID NO: 38681 - protein, 140 aa, Diabrotica virgifera
  misc_feature: Coding regions on vcDNA: vcDNA=SeqID_18378; Strand=+; Position=3-425
  misc_feature: Homolog annotation: Hit_ID=AAU84930.1; Match level="QueryCoverage =99%, HitCoverage=49%, E-value=4e-67, Identity=94%"; Hit description =putative tropomyosin [Toxoptera citricida]
  misc_feature: Gene Ontology Annotation: Molecular function=molecular_function unknown; Cellular component=muscle thin filament tropomyosin; Biological process=pole plasm oskar mRNA localization
  misc_feature: Pfam annotation: Pfam_ID=Tropomyosin; Match level="Score=178.5, E -value=1.5e-50, Copies=1"; Pfam description=Tropomyosin
LENQLKEARFLAEEADKKYDEVARKLAMVEADLERAEERAESGESKIVELEEELRVVGNNLKSLEVSEEKANKREEEYKNQIKNLNNRLKEAEVRAEFAERAVQKLQKEVDRLEDELVQEKEKYKYICDDLDQTFTELVG

SEQ ID NO: 38682 - protein, 233 aa, Diabrotica virgifera
  misc_feature: Coding regions on vcDNA: vcDNA=SeqID_18379; Strand=+; Position=133-831
  misc_feature: Homolog annotation: Hit_ID=NP_730931.1; Match level="QueryCoverage =91%, HitCoverage=69%, E-value=7e-28, Identity=29%"; Hit description =CG2663-PA, isoform A [Drosophila melanogaster] gb|AAF52032.1| CG2663- PA, isoform A [Drosophila
MNPEKRKALMLSHFGKTNKDLEEDVKLIKEWLKTQPHLPEIPSDHMIASFIWINKFSLEKTKQRIDLYYTNRSTMPYVFQFANPKSQFMKTSAESSHFFVLPKLVDDSYRVTVKKIKDCIPNDFDVNGWLAEVLNSIEITLREDDNLVLGTILLCDQQYFKMDHLLRFTPTVIRDSILIIEKLLNSRIKQFHFFNCPSYVDLLFKLCKQFLKPKLYERIRIHKSTDTLLDYIP

SEQ ID NO: 38683 - protein, 44 aa, Diabrotica virgifera
  misc_feature: Coding regions on vcDNA: vcDNA=SeqID_18380; Strand=-; Position=1-132
  misc_feature (6)..(6): Xaa can be any naturally occurring amino acid
  misc_feature (11)..(23): Xaa can be any naturally occurring amino acid
SDHVNXKSRPXXXXXXXXXXXXXIQHRGRNLYYRFDSPNKITLL

SEQ ID NO: 38684 - protein, 62 aa, Diabrotica virgifera
  misc_feature: Coding regions on vcDNA: vcDNA=SeqID_18381; Strand=-; Position=0-185
  misc_feature (4)..(21): Xaa can be any naturally occurring amino acid
  misc_feature (25)..(60): Xaa can be any naturally occurring amino acid
SKNXXXXXXXXXXXXXXXXXXVITXXXXXXXXXXXXXXXXXXXXXXXXXXXXXXXXXXXXIT

SEQ ID NO: 38685 - protein, 66 aa, Diabrotica virgifera; identical to SEQ ID NO: 26808
  misc_feature: Coding regions on vcDNA: vcDNA=SeqID_18382; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38686 - protein, 57 aa, Diabrotica virgifera
  misc_feature: Coding regions on vcDNA: vcDNA=SeqID_18383; Strand=-; Position=1-171
  misc_feature (1)..(54): Xaa can be any naturally occurring amino acid
XXXXXXXXXXXXXXXXXXXXXXXXXXXXXXXXXXXXXXXXXXXXXXXXXXXXXXIGS

SEQ ID NO: 38687 - protein, 76 aa, Diabrotica virgifera
  misc_feature: Coding regions on vcDNA: vcDNA=SeqID_18384; Strand=-; Position=13-243
RYRSSSVVNGFQTRRTQITFPPELVRRHRCYVVINASNYTFFSISIMDRLYHLSISHMDSTFFTISDNAHGVRWIK

SEQ ID NO: 38688 - protein, 268 aa, Diabrotica virgifera
  misc_feature: Coding regions on vcDNA: vcDNA=SeqID_18385; Strand=-; Position=2-805
  misc_feature (2)..(266): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLN

SEQ ID NO: 38689 - protein, 69 aa, Diabrotica virgifera
  misc_feature: Coding regions on vcDNA: vcDNA=SeqID_18386; Strand=-; Position=395-604
  misc_feature (41)..(41): Xaa can be any naturally occurring amino acid
VIKAQRLRWLGHVQRMVLSRILRIILSGALQGKRRRGRQNXRWSNEVESDMRRLNVKNWEEKQLIKGTN

SEQ ID NO: 38690 - protein, 79 aa, Diabrotica virgifera
  misc_feature: Coding regions on vcDNA: vcDNA=SeqID_18387; Strand=-; Position=482-721
CHKLGESCTESPMLEAEITEDNTLIWTEAQLKRRTKVTFSTTVTIYVVLRGPVKARPQSQMNILKNYYQRAYYIMEWKV

SEQ ID NO: 38691 - protein, 92 aa, Diabrotica virgifera
  misc_feature: Coding regions on vcDNA: vcDNA=SeqID_18388; Strand=+; Position=477-755
SRVSGHAISHLSNRKCQLVRVLLLLMQSTNGCSRSRLTIFLYPLQYVLGLLCFLVLSIVRHYGAMTFSSCPLPFFLRSFLQLRFAETDIFHF

SEQ ID NO: 38692 - protein, 174 aa, Diabrotica virgifera
  misc_feature: Coding regions on vcDNA: vcDNA=SeqID_18389; Strand=+; Position=3-527
  misc_feature (1)..(9): Xaa can be any naturally occurring amino acid
  misc_feature (12)..(62): Xaa can be any naturally occurring amino acid
  misc_feature (64)..(77): Xaa can be any naturally occurring amino acid
  misc_feature (87)..(141): Xaa can be any naturally occurring amino acid
  misc_feature (152)..(164): Xaa can be any naturally occurring amino acid
XXXXXXXXXKDXXXXXXXXXXXXXXXXXXXXXXXXXXXXXXXXXXXXXXXXXXXXXXXXXXXKXXXXXXXXXXXXXXNVHIVKYVIXXXXXXXXXXXXXXXXXXXXXXXXXXXXXXXXXXXXXXXXXXXXXXXXXXXXXXXCVLTTCLYVLXXXXXXXXXXXXXTWYFDRVKKA

SEQ ID NO: 38693 - protein, 265 aa, Diabrotica virgifera
  misc_feature: Coding regions on vcDNA: vcDNA=SeqID_18390; Strand=+; Position=84-878
  misc_feature: Homolog annotation: Hit_ID=NP_573338.1; Match level="QueryCoverage =95%, HitCoverage=51%, E-value=8e-58, Identity=44%"; Hit description =CG7332-PA [Drosophila melanogaster] gb|AAF48903.1| CG7332-PA [Drosophila melanogaster]
  misc_feature (229)..(229): Xaa can be any naturally occurring amino acid
  misc_feature (254)..(254): Xaa can be any naturally occurring amino acid
MADTLPSAIEQELLGIKNLLWGNEIKLDIFKRWSQGFYFSKNEQSALEQTEGGPCAIIAPVQAFILKNLLLDYKDLSFREKVNLELQNHSLVSALCEILRQCNIRKYYVVYLNSEFSAAVNQAELKCEAESSKAVENLEIDPARFHDGLKVHSYQCLDEVKNYYCENITKLRAQYGILLFLYSVIASKGLEIVKSESDTQDPLIDETYGYGSQSLINLMITGRATTYVXDHHEDVGGLKLLGIERQSQIGFITXYEYHQYCTSWV

SEQ ID NO: 38694 - protein, 83 aa, Diabrotica virgifera
  misc_feature: Coding regions on vcDNA: vcDNA=SeqID_18391; Strand=+; Position=37-288
LIKRTTGKNNNRIIYYQCEQESSFLLYVPSPLPRLAIIIAILTFDTTARKNSIELHPNHSLRFFTQEFSELNKSVMSQIAIKS

SEQ ID NO: 38695 - protein, 143 aa, Diabrotica virgifera
  misc_feature: Coding regions on vcDNA: vcDNA=SeqID_18392; Strand=-; Position=290-721
  misc_feature (8)..(20): Xaa can be any naturally occurring amino acid
  misc_feature (41)..(59): Xaa can be any naturally occurring amino acid
  misc_feature (63)..(94): Xaa can be any naturally occurring amino acid
  misc_feature (100)..(109): Xaa can be any naturally occurring amino acid
  misc_feature (115)..(139): Xaa can be any naturally occurring amino acid
ARSRYREXXXXXXXXXXXXXNTKRHAFNKQVRKMFTHSDSXXXXXXXXXXXXXXXXXXXINLXXXXXXXXXXXXXXXXXXXXXXXXXXXXXXXXLIDNFXXXXXXXXXXIIKLMXXXXXXXXXXXXXXXXXXXXXXXXXLLKN

SEQ ID NO: 38696 - protein, 237 aa, Diabrotica virgifera
  misc_feature: Coding regions on vcDNA: vcDNA=SeqID_18393; Strand=+; Position=142-852
  misc_feature: Homolog annotation: Hit_ID=XP_310937.1; Match level="QueryCoverage =96%, HitCoverage=29%, E-value=1e-102, Identity=72%"; Hit description= ENSANGP00000019291 [Anopheles gambiae]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=202.2, E -value=1.1e-57, Copies=1"; Pfam description=Glycosyl hydrolases family 18
  misc_feature (97)..(102): Xaa can be any naturally occurring amino acid
MLSAGICRWLFLLVSLATWVSLTSSQEMRVVCYYTNWSIYRPGDAKFSPQNINPYLCTHLIYAFGGFTKENTLKPFDKYQDIEKGGYAKFTGLKTYXXXXXXMLAIGGWNEGSTRFSPMVANATRRKEFARNAIKFLRLNHFDGLDLDWEYPSFRDGGKPRDKTNYPLLVQDLREEFDREAEKTGRPKLLLTMAVPAGLEYINKGFNVPELNRYLDWMNILSYDYHSAFEPAVNHHA

SEQ ID NO: 38697 - protein, 20 aa, Diabrotica virgifera
  misc_feature: Coding regions on vcDNA: vcDNA=SeqID_18394; Strand=+; Position=2-61
FFFRFCRCIFVYYILINYNY

SEQ ID NO: 38698 - protein, 82 aa, Diabrotica virgifera
  misc_feature: Coding regions on vcDNA: vcDNA=SeqID_18395; Strand=-; Position=2-247
  misc_feature (76)..(76): Xaa can be any naturally occurring amino acid
  misc_feature (78)..(78): Xaa can be any naturally occurring amino acid
  misc_feature (80)..(80): Xaa can be any naturally occurring amino acid
WSIMIWSDAVVSLIDFSLCASDPTKIILAAVIPQSVTGVVYAIKISAMYQDLWDVLGWALSFLVSFGKMLVSVCAXSXRXRK

SEQ ID NO: 38699 - protein, 56 aa, Diabrotica virgifera
  misc_feature: Coding regions on vcDNA: vcDNA=SeqID_18396; Strand=-; Position=0-167
  misc_feature (3)..(10): Xaa can be any naturally occurring amino acid
  misc_feature (14)..(24): Xaa can be any naturally occurring amino acid
  misc_feature (39)..(46): Xaa can be any naturally occurring amino acid
IIXXXXXXXXLIQXXXXXXXXXXXLISLNITTFNHKLYXXXXXXXXHIFNLIPQNS

SEQ ID NO: 38700 - protein, 25 aa, Diabrotica virgifera
  misc_feature: Coding regions on vcDNA: vcDNA=SeqID_18397; Strand=-; Position=1-75
  misc_feature (3)..(16): Xaa can be any naturally occurring amino acid
  misc_feature (18)..(25): Xaa can be any naturally occurring amino acid
INXXXXXXXXXXXXXXYXXXXXXXX

SEQ ID NO: 38701 - protein, 85 aa, Diabrotica virgifera
  misc_feature: Coding regions on vcDNA: vcDNA=SeqID_18398; Strand=+; Position=2-256
  misc_feature (4)..(85): Xaa can be any naturally occurring amino acid
MKGXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38702 - protein, 102 aa, Diabrotica virgifera
  misc_feature: Coding regions on vcDNA: vcDNA=SeqID_18399; Strand=-; Position=1-306
  misc_feature (1)..(22): Xaa can be any naturally occurring amino acid
  misc_feature (24)..(102): Xaa can be any naturally occurring amino acid
XXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38703 - protein, 187 aa, Diabrotica virgifera
  misc_feature: Coding regions on vcDNA: vcDNA=SeqID_18400; Strand=+; Position=283-843
  misc_feature (184)..(184): Xaa can be any naturally occurring amino acid
KQKEDNMAQSGPKDDRNLLSNTVKTESLNDDVSTPDNNFSGKAIDFQFSIQPKVEQCEIKDEVEELEFVGEVIEFSENELSDLEESQEPESKESYLCEQCNVESCYKKHDLHADFIRITTKPLNQSNPYECAICSIKILNPTIALFHLSLHDKDSFRCYKCDCILLEFSDFLEHIEKLHSKDRXYYR

SEQ ID NO: 38704 - protein, 22 aa, Diabrotica virgifera
  misc_feature: Coding regions on vcDNA: vcDNA=SeqID_18401; Strand=-; Position=2-67
  misc_feature (16)..(17): Xaa can be any naturally occurring amino acid
NFNPHRGSQSYYRLTXXINYAV

SEQ ID NO: 38705 - protein, 248 aa, Diabrotica virgifera
  misc_feature: Coding regions on vcDNA: vcDNA=SeqID_18402; Strand=+; Position=1-744
  misc_feature (1)..(166): Xaa can be any naturally occurring amino acid
  misc_feature (170)..(219): Xaa can be any naturally occurring amino acid
  misc_feature (222)..(246): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAVXXXXXXXXXXXXXXXXXXXXXXXXXXXXXXXXXXXXXXXXXXXXXXXXXXTLXXXXXXXXXXXXXXXXXXXXXXXXXGG

SEQ ID NO: 38706 - protein, 222 aa, Diabrotica virgifera
  misc_feature: Coding regions on vcDNA: vcDNA=SeqID_18403; Strand=+; Position=138-806
  misc_feature: Homolog annotation: Hit_ID=XP_416063.1; Match level="QueryCoverage =98%, HitCoverage=52%, E-value=4e-25, Identity=29%"; Hit description =PREDICTED: hypothetical protein XP_416063 [Gallus gallus]
MESEDEFLHIYFTHVSQLCYEKAKEHKGCTTPWGVFLNYLQQLTLTEKSYMEIGFLQNKHKAFFRKDNSLRSVYETMKNDLKKLEDNTKQSAGDIRVQKGSKNIVQFLNARINLIDLYEKIYNMGVNKQIRYNEILTHIESVIEKNSEGFTDIGLTPVKAVFSLECEILEQLFKALTQLQTLEFLPPLALIHGAHTRLAAWESGNLYSKIVLFQRYFNGSKS

SEQ ID NO: 38707 - protein, 21 aa, Diabrotica virgifera
  misc_feature: Coding regions on vcDNA: vcDNA=SeqID_18404; Strand=-; Position=0-62
  misc_feature (1)..(20): Xaa can be any naturally occurring amino acid
XXXXXXXXXXXXXXXXXXXXT

SEQ ID NO: 38708 - protein, 50 aa, Diabrotica virgifera
  misc_feature: Coding regions on vcDNA: vcDNA=SeqID_18405; Strand=-; Position=187-339
LLKNLEIVNILFINAYIFFYEEMRDFLKRISLDNLNNYSNFFLNGNHDPI

SEQ ID NO: 38709 - protein, 113 aa, Diabrotica virgifera
  misc_feature: Coding regions on vcDNA: vcDNA=SeqID_18406; Strand=-; Position=45-386
  misc_feature (27)..(69): Xaa can be any naturally occurring amino acid
  misc_feature (72)..(82): Xaa can be any naturally occurring amino acid
  misc_feature (92)..(99): Xaa can be any naturally occurring amino acid
  misc_feature (102)..(108): Xaa can be any naturally occurring amino acid
PEIKFGGPFKKILPSHPPVVKLGSFKXXXXXXXXXXXXXXXXXXXXXXXXXXXXXXXXXXXXXXXXXXXPFXXXXXXXXXXXTNLAHTGLNXXXXXXXXSNXXXXXXXTSMLD

SEQ ID NO: 38710 - protein, 274 aa, Diabrotica virgifera
  misc_feature: Coding regions on vcDNA: vcDNA=SeqID_18407; Strand=-; Position=2-823
  misc_feature (5)..(15): Xaa can be any naturally occurring amino acid
  misc_feature (17)..(25): Xaa can be any naturally occurring amino acid
  misc_feature (37)..(44): Xaa can be any naturally occurring amino acid
  misc_feature (47)..(60): Xaa can be any naturally occurring amino acid
  misc_feature (66)..(79): Xaa can be any naturally occurring amino acid
  misc_feature (81)..(274): Xaa can be any naturally occurring amino acid
GKYLXXXXXXXXXXXFXXXXXXXXXIETNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38711 - protein, 178 aa, Diabrotica virgifera
  misc_feature: Coding regions on vcDNA: vcDNA=SeqID_18408; Strand=+; Position=3-537
  misc_feature: Homolog annotation: Hit_ID=XP_319708.1; Match level="QueryCoverage =97%, HitCoverage=63%, E-value=4e-75, Identity=76%"; Hit description =ENSANGP00000019464 [Anopheles gambiae]
  misc_feature: Gene Ontology Annotation: Molecular function=ubiquinol-cytochrome c reductase activity; Cellular component=respiratory chain complex III (sensu Eukarya); Biological process=electron transport
  misc_feature: Pfam annotation: Pfam_ID=Rieske; Match level="Score=56.5, E-value =7.7e-14, Copies=1"; Pfam description=Rieske [2Fe-2S] domain
  misc_feature (150)..(150): Xaa can be any naturally occurring amino acid
KDPAKSSHDSEDARKNFTYLMAGGLGVGAAYGAKSVVSQFISSMSASADVLALAKIEIKLSDIPEGKSVTFKWRGKPLFIRHRSASEIQAEQSVAVSSLRDPQHDNDRVQNPSFLIVIGVCTHLGCVPIANAGDFGGYYCPCHGSHYDAXGRIRKGPAPLNLEVPPYNFPSEDLLVVG

SEQ ID NO: 38712 - protein, 92 aa, Diabrotica virgifera
  misc_feature: Coding regions on vcDNA: vcDNA=SeqID_18409; Strand=-; Position=1-276
  misc_feature (2)..(92): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38713 - protein, 69 aa, Diabrotica virgifera
  misc_feature: Coding regions on vcDNA: vcDNA=SeqID_18410; Strand=+; Position=93-302
  misc_feature (12)..(22): Xaa can be any naturally occurring amino acid
  misc_feature (27)..(36): Xaa can be any naturally occurring amino acid
SITITTLLRTSXXXXXXXXXXXHHHHXXXXXXXXXXAYKLNCLPIPFFRINYDQCVLLATNVLVLIFIY

SEQ ID NO: 38714 - protein, 64 aa, Diabrotica virgifera
  misc_feature: Coding regions on vcDNA: vcDNA=SeqID_18411; Strand=+; Position=2-196
  misc_feature (1)..(5): Xaa can be any naturally occurring amino acid
  misc_feature (8)..(19): Xaa can be any naturally occurring amino acid
  misc_feature (22)..(28): Xaa can be any naturally occurring amino acid
  misc_feature (33)..(33): Xaa can be any naturally occurring amino acid
  misc_feature (61)..(62): Xaa can be any naturally occurring amino acid
XXXXXNLXXXXXXXXXXXXLIXXXXXXXIITLXDNSVIFIGEVKSIIKIADLRCWIKVYNXXYQ

SEQ ID NO: 38715 - protein, 33 aa, Diabrotica virgifera
  misc_feature: Coding regions on vcDNA: vcDNA=SeqID_18412; Strand=-; Position=78-179
  misc_feature (8)..(15): Xaa can be any naturally occurring amino acid
YFSLIIIXXXXXXXXHIINISIYLLLNITILYP

SEQ ID NO: 38716 - protein, 33 aa, Diabrotica virgifera
  misc_feature: Coding regions on vcDNA: vcDNA=SeqID_18413; Strand=-; Position=1-99
  misc_feature (1)..(32): Xaa can be any naturally occurring amino acid
XXXXXXXXXXXXXXXXXXXXXXXXXXXXXXXXD

SEQ ID NO: 38717 - protein, 254 aa, Diabrotica virgifera
  misc_feature: Coding regions on vcDNA: vcDNA=SeqID_18414; Strand=+; Position=3-767
  misc_feature: Homolog annotation: Hit_ID=XP_311076.1; Match level="QueryCoverage =98%, HitCoverage=30%, E-value=7e-67, Identity=54%"; Hit description =ENSANGP00000004709 [Anopheles gambiae]
  misc_feature: Gene Ontology Annotation: Molecular function=transcription factor activity; Cellular component=nucleus; Biological process=regulation of transcription
WILADQEAAILYKKIEMVPEPLVSLSDPLPKAIVAAFIARRDYLTQNSSISPKKILLQCDYASHLLTDSLTFTVCKKRDQTVMLAHLLVCDWLLETRTSLWEDCVDNGLKNPVSSCVLSSFQVDLASLRSLAEHIPSALSRVFLYEATARLMAGAAPGRTQQLLDRSLRQRHAKSSIICGKGDKNQHELGGQRQHATALYMACKHLPGPLLSSPGERAGMLVEAAKTLEKIGDKKRLQDCYELMKTLGTSAVNN

SEQ ID NO: 38718 - protein, 38 aa, Diabrotica virgifera
  misc_feature: Coding regions on vcDNA: vcDNA=SeqID_18415; Strand=-; Position=1-114
  misc_feature (30)..(38): Xaa can be any naturally occurring amino acid
TIALTPLDVDKNIFSFRIFKTFNFLCMHIXXXXXXXXX

SEQ ID NO: 38719 - protein, 95 aa, Diabrotica virgifera
  misc_feature: Coding regions on vcDNA: vcDNA=SeqID_18416; Strand=-; Position=243-530
RVCCSYSSTLCKQFHPTNWREPNHTYRQDIQHDNRKSCEAGYLTLFWDCNHRMTYNTARIKVGQHRLRCRKDPHRVRISYDQKCDLSLTSKELVA

SEQ ID NO: 38720 - protein, 262 aa, Diabrotica virgifera
  misc_feature: Coding regions on vcDNA: vcDNA=SeqID_18417; Strand=+; Position=1-786
  misc_feature (1)..(40): Xaa can be any naturally occurring amino acid
  misc_feature (47)..(66): Xaa can be any naturally occurring amino acid
  misc_feature (69)..(81): Xaa can be any naturally occurring amino acid
  misc_feature (84)..(184): Xaa can be any naturally occurring amino acid
  misc_feature (195)..(224): Xaa can be any naturally occurring amino acid
  misc_feature (226)..(245): Xaa can be any naturally occurring amino acid
  misc_feature (253)..(260): Xaa can be any naturally occurring amino acid
XXXXXXXXXXXXXXXXXXXXXXXXXXXXXXXXXXXXXXXXSAIINYXXXXXXXXXXXXXXXXXXXXPYXXXXXXXXXXXXXFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLYTSNKGTRXXXXXXXXXXXXXXXXXXXXXXXXXXXXXXVXXXXXXXXXXXXXXXXXXXXLDEITTVXXXXXXXXIF

SEQ ID NO: 38721 - protein, 66 aa, Diabrotica virgifera; identical to SEQ ID NO: 26808
  misc_feature: Coding regions on vcDNA: vcDNA=SeqID_18418; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38722 - protein, 125 aa, Diabrotica virgifera
  misc_feature: Coding regions on vcDNA: vcDNA=SeqID_18419; Strand=+; Position=2-379
  misc_feature (8)..(34): Xaa can be any naturally occurring amino acid
PRVRYFTXXXXXXXXXXXXXXXXXXXXXXXXXXXIGFSTGKMAYKSFLILHYVFKIVAFTQLDLYFLDMYLFGEKYLVYNNAKITSHHDIKDYIICNQKPICDIFLGFYTHAFFIFLLLFYVYFH

SEQ ID NO: 38723 - protein, 72 aa, Diabrotica virgifera
  misc_feature: Coding regions on vcDNA: vcDNA=SeqID_18420; Strand=+; Position=230-445
SIAETMIDPEHRELEDHRYKMERQESCIHSSQPSEKCRMISNIFSVYTSKERVESKAWVPPDVSPLSELSDE

SEQ ID NO: 38724 - protein, 51 aa, Diabrotica virgifera
  misc_feature: Coding regions on vcDNA: vcDNA=SeqID_18421; Strand=-; Position=116-271
FLHTSLSINKKILKSLLKHLIYQTTTFISFQTTSINLNNSPIQIATLIHLF

SEQ ID NO: 38725 - protein, 64 aa, Diabrotica virgifera
  misc_feature: Coding regions on vcDNA: vcDNA=SeqID_18422; Strand=-; Position=137-331
LNKFLSLPMDRKIRKGCEFESHQGQKFFVYYKLINENSFCPCEIGIHRRDRRRSDTISVSLQRQ

SEQ ID NO: 38726 - protein, 126 aa, Diabrotica virgifera
  misc_feature: Coding regions on vcDNA: vcDNA=SeqID_18423; Strand=+; Position=348-725
  misc_feature (22)..(33): Xaa can be any naturally occurring amino acid
  misc_feature (39)..(45): Xaa can be any naturally occurring amino acid
  misc_feature (49)..(57): Xaa can be any naturally occurring amino acid
  misc_feature (90)..(100): Xaa can be any naturally occurring amino acid
  misc_feature (105)..(114): Xaa can be any naturally occurring amino acid
HYIFPDLTLKITLYNTLVFKDXXXXXXXXXXXXLVIYFXXXXXXXFINXXXXXXXXXYKFSNADDIIIKEPSILRDHPIVANNRIQPHFXXXXXXXXXXXIKYKXXXXXXXXXXTALFSPCHLTSS

SEQ ID NO: 38727 - protein, 66 aa, Diabrotica virgifera; identical to SEQ ID NO: 26808
  misc_feature: Coding regions on vcDNA: vcDNA=SeqID_18424; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38728 - protein, 138 aa, Diabrotica virgifera
  misc_feature: Coding regions on vcDNA: vcDNA=SeqID_18425; Strand=-; Position=854 -1270
  misc_feature (10)..(20): Xaa can be any naturally occurring amino acid
  misc_feature (23)..(31): Xaa can be any naturally occurring amino acid
  misc_feature (41)..(49): Xaa can be any naturally occurring amino acid
  misc_feature (67)..(74): Xaa can be any naturally occurring amino acid
  misc_feature (76)..(82): Xaa can be any naturally occurring amino acid
  misc_feature (88)..(109): Xaa can be any naturally occurring amino acid
  misc_feature (113)..(130): Xaa can be any naturally occurring amino acid
FYSTPPTTPXXXXXXXXXXXHTXXXXXXXXXNPNPPPFIYXXXXXXXXXKDQTSLKLQNIKTLTIKXXXXXXXXRXXXXXXXPKNIQXXXXXXXXXXXXXXXXXXXXXXPPPXXXXXXXXXXXXXXXXXXLINLIKLL

SEQ ID NO: 38729 - protein, 151 aa, Diabrotica virgifera
  misc_feature: Coding regions on vcDNA: vcDNA=SeqID_18426; Strand=+; Position=10-465
DCNRVSTLLIIFNATDILTTNNMNSFSYTHLNLRLVTIPASLLAHDHAIAIALPIHSYPFLLHYLHSTAQFVPTMKLITPTQIHSHTKMKHSLPIIYFLQDYHYLHEIQYHFYIVIHILLLVTRLPPDDSLLPCQLPTYLTWMTSPFHLLV

SEQ ID NO: 38730 - protein, 30 aa, Diabrotica virgifera
  misc_feature: Coding regions on vcDNA: vcDNA=SeqID_18427; Strand=+; Position=1-90
  misc_feature (6)..(28): Xaa can be any naturally occurring amino acid
KDPIKXXXXXXXXXXXXXXXXXXXXXXXGG

SEQ ID NO: 38731 - protein, 138 aa, Diabrotica virgifera
  misc_feature: Coding regions on vcDNA: vcDNA=SeqID_18428; Strand=+; Position=212-628
  misc_feature (7)..(14): Xaa can be any naturally occurring amino acid
SVLVFIXXXXXXXXVQSLVGKKSVAQRTGDNDTTRRNLSLFYHLIMHNSLQKVRICKKMFLNTLSVGEWSVSNWVRKFKESQGQVENYNEEELKEEQQELIDTRKSAANKAKKDLLKSFFETLPKLESHYCKDTERCI

SEQ ID NO: 38732 - protein, 22 aa, Diabrotica virgifera
  misc_feature: Coding regions on vcDNA: vcDNA=SeqID_18429; Strand=-; Position=1-66
  misc_feature (8)..(22): Xaa can be any naturally occurring amino acid
ILKKLLIXXXXXXXXXXXXXXX

SEQ ID NO: 38733 - protein, 73 aa, Diabrotica virgifera
  misc_feature: Coding regions on vcDNA: vcDNA=SeqID_18430; Strand=-; Position=291-512
SVFHIDIIIHRSGKVRKIAYRGAVSGRWYIYISLKKVSFFSITYDARNLGVCVVSLLPVLGRCPHACSSHKDS

SEQ ID NO: 38734 - protein, 134 aa, Diabrotica virgifera
  misc_feature: Coding regions on vcDNA: vcDNA=SeqID_18431; Strand=+; Position=183-584
  misc_feature (13)..(59): Xaa can be any naturally occurring amino acid
  misc_feature (62)..(117): Xaa can be any naturally occurring amino acid
NYAVIPKVIYSYXXXXXXXXXXXXXXXXXXXXXXXXXXXXXXXXXXXXXXXXXXXXXXXRGXXXXXXXXXXXXXXXXXXXXXXXXXXXXXXXXXXXXXXXXXXXXXXXXXXXXXXXXDPPLQFFSIIFMYIINL

SEQ ID NO: 38735 - protein, 155 aa, Diabrotica virgifera
  misc_feature: Coding regions on vcDNA: vcDNA=SeqID_18432; Strand=-; Position=1-465
  misc_feature (24)..(155): Xaa can be any naturally occurring amino acid
ALIQHRGRNLYYRFELYNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38736 - protein, 274 aa, Diabrotica virgifera
  misc_feature: Coding regions on vcDNA: vcDNA=SeqID_18433; Strand=+; Position=1-825
  misc_feature: Homolog annotation: Hit_ID=XP_308624.1; Match level="QueryCoverage =93%, HitCoverage=30%, E-value=8e-51, Identity=38%"; Hit description =ENSANGP00000024486 [Anopheles gambiae]
  misc_feature: Pfam annotation: Pfam_ID=Peptidase_A17; Match level="Score=178.8, E -value=1.1e-50, Copies=1"; Pfam description=Pao retrotransposon peptidase
  misc_feature (237)..(237): Xaa can be any naturally occurring amino acid
GKKPISFDDNSCSSPLKILGLVWNAQLDCFSFEVTALDKSCTKRSMLSELARVFDPVGFLAPMTLFTKHLIQRLWLSGIDWDDSPPDSICKVWNQYKEQLLSLAQLEIPRCMFVSRYICCEVHGFCDSSEKGYAAVIYLRFVLPDGQVCVFFVCAKSKVAPIRTVSIPRLELSAAVLLSKLMQFVVRVLDPKLKTAKFVAWSDSQVALSWIKSSPHRWKTFVSNRVSYIQERLSPNXWFYVPSAQNPADLAFKGVLPALMLEESYWFAGSEFFE

SEQ ID NO: 38737 - protein, 86 aa, Diabrotica virgifera
  misc_feature: Coding regions on vcDNA: vcDNA=SeqID_18434; Strand=-; Position=91-351
  misc_feature (62)..(75): Xaa can be any naturally occurring amino acid
IFTKGILYTLYHKSLISNNLSSSLITLSSYTHSISLLLILYFLPHLNFYYNLFHTPSSLLIXXXXXXXXXXXXXXSNYFSQNSNNI

SEQ ID NO: 38738 - protein, 23 aa, Diabrotica virgifera
  misc_feature: Coding regions on vcDNA: vcDNA=SeqID_18435; Strand=-; Position=0-68
  misc_feature (7)..(12): Xaa can be any naturally occurring amino acid
FSLQYRXXXXXXLKSYSYELFLL

SEQ ID NO: 38739 - protein, 198 aa, Diabrotica virgifera
  misc_feature: Coding regions on vcDNA: vcDNA=SeqID_18436; Strand=+; Position=75-671
  misc_feature: Homolog annotation: Hit_ID=EAL27189.1; Match level="QueryCoverage =99%, HitCoverage=99%, E-value=4e-57, Identity=55%"; Hit description =GA17387-PA [Drosophila pseudoobscura]
MNTLFETSEQTEPRSLPKKISPAGKFFVAITGGVAIGLTVICAPFISPAFRKYCLPYIPATDHQVKNILAALKGRTGTLLDLGSGDGRIVLETAKNKFISHGVELNPWLVLFSKISALREGITNAKFYRRDLWKYSIHQYDNIVIFGVEQMMNDLEKKFIKECKSSCKIIACRFHLPNLTPIKTIGHGIDTVWVYGLK

SEQ ID NO: 38740 - protein, 273 aa, Diabrotica virgifera
  misc_feature: Coding regions on vcDNA: vcDNA=SeqID_18437; Strand=+; Position=51-870
  misc_feature: Homolog annotation: Hit_ID=NP_611363.2; Match level="QueryCoverage =99%, HitCoverage=36%, E-value=2e-82, Identity=56%"; Hit description =CG15087-PA [Drosophila melanogaster] gb|AAF57649.3| CG15087-PA [Drosophila melanogaster]
  misc_feature: Gene Ontology Annotation: Molecular function=molecular_function unknown; Cellular component=integral to membrane; Biological process= biological_process unknown
  misc_feature (231)..(231): Xaa can be any naturally occurring amino acid
  misc_feature (250)..(250): Xaa can be any naturally occurring amino acid
  misc_feature (252)..(252): Xaa can be any naturally occurring amino acid
  misc_feature (263)..(263): Xaa can be any naturally occurring amino acid
MSEKKPNPLDINGSNFNPNMYLEKVFKEYSLKQILDHEVEVVKDTQTLHSDMQTLVYENYNKFISATDTIKKMKNDFKKMETQMDLLASNMATITSFSDKINGTLQDTRQTISKLSGIHTLLQKLQFLFKLPTTLKARMEEKNYVQATQDYLHAQRVLHQYGDMPSFQGIKGDCELILIELKRELRKQFGNSDASAKELAEAVDLLLKLDEPAKELCMEFLSCAEKRLAEXVVMLKDQSEQRDIIEFVDXSXSGFLSDLCLNXASFHDMFINR

SEQ ID NO: 38741 - protein, 185 aa, Diabrotica virgifera
  misc_feature: Coding regions on vcDNA: vcDNA=SeqID_18438; Strand=-; Position=2-556
  misc_feature (10)..(17): Xaa can be any naturally occurring amino acid
  misc_feature (19)..(50): Xaa can be any naturally occurring amino acid
  misc_feature (53)..(76): Xaa can be any naturally occurring amino acid
  misc_feature (78)..(110): Xaa can be any naturally occurring amino acid
  misc_feature (113)..(124): Xaa can be any naturally occurring amino acid
  misc_feature (126)..(137): Xaa can be any naturally occurring amino acid
  misc_feature (140)..(150): Xaa can be any naturally occurring amino acid
  misc_feature (154)..(170): Xaa can be any naturally occurring amino acid
  misc_feature (176)..(184): Xaa can be any naturally occurring amino acid
IPLIFLYIIXXXXXXXXYXXXXXXXXXXXXXXXXXXXXXXXXXXXXXXXXHMXXXXXXXXXXXXXXXXXXXXXXXXHXXXXXXXXXXXXXXXXXXXXXXXXXXXXXXXXXNIXXXXXXXXXXXXIXXXXXXXXXXXXYIXXXXXXXXXXXLQDXXXXXXXXXXXXXXXXXSQFSLXXXXXXXXXK

SEQ ID NO: 38742 - protein, 112 aa, Diabrotica virgifera
  misc_feature: Coding regions on vcDNA: vcDNA=SeqID_18439; Strand=+; Position=208-546
  misc_feature (17)..(41): Xaa can be any naturally occurring amino acid
  misc_feature (43)..(64): Xaa can be any naturally occurring amino acid
  misc_feature (70)..(76): Xaa can be any naturally occurring amino acid
  misc_feature (79)..(97): Xaa can be any naturally occurring amino acid
  misc_feature (102)..(109): Xaa can be any naturally occurring amino acid
TLQKNYAVIPKEIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 38743 - protein, 313 aa, Diabrotica virgifera
  misc_feature: Coding regions on vcDNA: vcDNA=SeqID_18440; Strand=-; Position=316 -1257
  misc_feature (5)..(19): Xaa can be any naturally occurring amino acid
  misc_feature (37)..(43): Xaa can be any naturally occurring amino acid
  misc_feature (45)..(55): Xaa can be any naturally occurring amino acid
  misc_feature (64)..(78): Xaa can be any naturally occurring amino acid
  misc_feature (80)..(101): Xaa can be any naturally occurring amino acid
  misc_feature (104)..(124): Xaa can be any naturally occurring amino acid
  misc_feature (128)..(137): Xaa can be any naturally occurring amino acid
  misc_feature (141)..(173): Xaa can be any naturally occurring amino acid
  misc_feature (182)..(212): Xaa can be any naturally occurring amino acid
  misc_feature (216)..(223): Xaa can be any naturally occurring amino acid
  misc_feature (244)..(244): Xaa can be any naturally occurring amino acid
  misc_feature (255)..(256): Xaa can be any naturally occurring amino acid
  misc_feature (259)..(260): Xaa can be any naturally occurring amino acid
  misc_feature (266)..(266): Xaa can be any naturally occurring amino acid
  misc_feature (268)..(268): Xaa can be any naturally occurring amino acid
  misc_feature (270)..(270): Xaa can be any naturally occurring amino acid
  misc_feature (275)..(277): Xaa can be any naturally occurring amino acid
  misc_feature (279)..(280): Xaa can be any naturally occurring amino acid
  misc_feature (284)..(286): Xaa can be any naturally occurring amino acid
GGGVXXXXXXXXXXXXXXXWGGWVVLFSPTPPPQKNXXXXXXXVXXXXXXXXXXXGFCCVLCHXXXXXXXXXXXXXXXAXXXXXXXXXXXXXXXXXXXXXXWVXXXXXXXXXXXXXXXXXXXXXGGEXXXXXXXXXXPRGXXXXXXXXXXXXXXXXXXXXXXXXXXXXXXXXXGKGGVYFHXXXXXXXXXXXXXXXXXXXXXXXXXXXXXXXPFWXXXXXXXXPKRAFFFWPGEPRKKKEVSGXPPRGKNFSPGXXPGXXPWDRGXDXHXFFPPXXXGXXREFXXXDFIFHIWFAYVFSNIGLIELIFINCPT

SEQ ID NO: 38744 - protein, 104 aa, Diabrotica virgifera
  misc_feature: Coding regions on vcDNA: vcDNA=SeqID_18441; Strand=-; Position=693 -1007
  misc_feature (7)..(13): Xaa can be any naturally occurring amino acid
RPLLPFXXXXXXXPEIGKRGVGTPGGAKTPPKNGKTGGAPLSKRISEFNYFLTFFNPIPGHNRGTFLPLTGKFPLYAGGTAQTVFFFQSSRPPGEYPTPHKIPN

SEQ ID NO: 38745 - protein, 31 aa, Diabrotica virgifera
  misc_feature: Coding regions on vcDNA: vcDNA=SeqID_18442; Strand=-; Position=1-93
  misc_feature (4)..(28): Xaa can be any naturally occurring amino acid
FKLXXXXXXXXXXXXXXXXXXXXXXXXXEVG

SEQ ID NO: 38746 - protein, 139 aa, Diabrotica virgifera
  misc_feature: Coding regions on vcDNA: vcDNA=SeqID_18443; Strand=+; Position=1-420
  misc_feature: Homolog annotation: Hit_ID=AAK93406.1; Match level="QueryCoverage =95%, HitCoverage=27%, E-value=8e-43, Identity=64%"; Hit description =LD45279p [Drosophila melanogaster]
  misc_feature: Gene Ontology Annotation: Molecular function=chaperonin ATPase activity; Cellular component=mitochondrion
ARDLMDFGMIPEFVGRFPVLVPFHSLDQTLLVRILTEPKNALLLQYKRLLGMDNCDLIFTPEALNAIAHLAMERKTGARGLRAIMESLLLEPMFEIPGSNISEVHITEDYVKGKGKPSYIKNQVQTEEGEFNTSIRVKQ

SEQ ID NO: 38747 - protein, 34 aa, Diabrotica virgifera; identical to SEQ ID NO: 27603
  misc_feature: Coding regions on vcDNA: vcDNA=SeqID_18444; Strand=-; Position=80-184

SEQ ID NO: 38748 - protein, 108 aa, Diabrotica virgifera; identical to SEQ ID NO: 27732
  misc_feature: Coding regions on vcDNA: vcDNA=SeqID_18445; Strand=+; Position=229-555
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 38749 - protein, 66 aa, Diabrotica virgifera
  misc_feature: Coding regions on vcDNA: vcDNA=SeqID_18446; Strand=-; Position=200-400
  misc_feature (7)..(14): Xaa can be any naturally occurring amino acid
IVDKQLXXXXXXXXEKRSKCPFFKVKKSIRCFANRKISENCYLPLKLLLKLTWHFSVSPKVGHWGT

SEQ ID NO: 38750 - protein, 77 aa, Diabrotica virgifera
  misc_feature: Coding regions on vcDNA: vcDNA=SeqID_18447; Strand=-; Position=361-594
IGVEGCSCVRETVQLQLRDGAVEKLELNALGSAQTGFFNTCSVTSANSFCFRAHSVFIELLQASYRRPKFRYCNCFW

SEQ ID NO: 38751 - protein, 56 aa, Diabrotica virgifera
  misc_feature: Coding regions on vcDNA: vcDNA=SeqID_18448; Strand=-; Position=0-167
IAATTTDTSSMSLIILQKYSRTCVMVVVILTIVKLLNSKKLQNYYKVIISFNYDTP

SEQ ID NO: 38752 - protein, 92 aa, Diabrotica virgifera
  misc_feature: Coding regions on vcDNA: vcDNA=SeqID_18449; Strand=-; Position=2-277
  misc_feature (10)..(17): Xaa can be any naturally occurring amino acid
  misc_feature (19)..(50): Xaa can be any naturally occurring amino acid
TGVSQVGFYXXXXXXXXYXXXXXXXXXXXXXXXXXXXXXXXXXXXXXXXXQSFYCKKTVAYLQLNILMSRHTDLPYSDRVVGISSEQCLSIC

SEQ ID NO: 38753 - protein, 138 aa, Diabrotica virgifera
  misc_feature: Coding regions on vcDNA: vcDNA=SeqID_18450; Strand=+; Position=25-441
  misc_feature: Homolog annotation: Hit_ID=XP_395505.1; Match level="QueryCoverage =92%, HitCoverage=81%, E-value=6e-40, Identity=60%"; Hit description =similar to CG32951-PA [Apis mellifera]
  misc_feature: Gene Ontology Annotation: Molecular function=SNARE binding; Cellular component=synaptic vesicle; Biological process=synaptic vesicle priming
MDLDSESTATSLEDNTENFCDNPTRDTLAEGLMGLIKPTVDQLDERVRATRISQLELKQCIESLSEELKSISESQQHTQDLDIYVKKLINAKQRVTVLTNVLQNTQERLNKVHANLDKEVLKRKAVLETTEETQASAS

SEQ ID NO: 38754 - protein, 85 aa, Diabrotica virgifera
  misc_feature: Coding regions on vcDNA: vcDNA=SeqID_18451; Strand=+; Position=70-327
  misc_feature: Pfam annotation: Pfam_ID=Conotoxin; Match level="Score=3.1, E-value =0.08, Copies=1"; Pfam description=Conotoxin
MKYTWLMLASSLVLAYLEDDENYQPSEDDYGDNAIDRLFQKRACIRRGGNCDHRPNDCCYNSSCRCNLWGSNCRCQRMGLFQKWG

SEQ ID NO: 38755 - protein, 65 aa, Diabrotica virgifera
  misc_feature: Coding regions on vcDNA: vcDNA=SeqID_18452; Strand=-; Position=524-721
  misc_feature (55)..(61): Xaa can be any naturally occurring amino acid
HTHRFSFIRSFLSAFNRGLDAYIFLAWCNSECLILGHLVGCRENVYNATGDGNNXXXXXXXQNSK

SEQ ID NO: 38756 - protein, 19 aa, Diabrotica virgifera
  misc_feature: Coding regions on vcDNA: vcDNA=SeqID_18453; Strand=-; Position=1-57
  misc_feature (1)..(17): Xaa can be any naturally occurring amino acid
  misc_feature (19)..(19): Xaa can be any naturally occurring amino acid
XXXXXXXXXXXXXXXXXKX

SEQ ID NO: 38757 - protein, 280 aa, Diabrotica virgifera
  misc_feature: Coding regions on vcDNA: vcDNA=SeqID_18454; Strand=+; Position=1-840
  misc_feature: Homolog annotation: Hit_ID=XP_392476.1; Match level="QueryCoverage =93%, HitCoverage=10%, E-value=2e-31, Identity=31%"; Hit description =similar to Huntingtin (Huntingtons disease protein) (HD protein) [Apis mellifera]
  misc_feature: Gene Ontology Annotation: Molecular function=molecular_function unknown
  misc_feature (32)..(39): Xaa can be any naturally occurring amino acid
  misc_feature (247)..(247): Xaa can be any naturally occurring amino acid
NETLVSLLNKLSVQFYDLSPIEFEQRRVVNPXXXXXXXXDRKWYLTQIQNKYKDSNIGREMAELLSKLEYNEIVSFMSSSGFNKHNLKDCLRLGLMEVDKLKTNDSCDLLRASIDCLLKDISSVVCKIPEPHQVYSPIERIPSASESLYTKQMTELFDNQEFSSLLYSLAMSIPLFSKHILANSSYELSNNNLEDLAKFSVLCLEYMRFLESENVDFRVHLTDICLTCCDTILRNISTCNFLELDSXATWLCSSINSVYSLVNTLLRSDRPLFTVFKYNL

SEQ ID NO: 38758 - protein, 100 aa, Diabrotica virgifera
  misc_feature: Coding regions on vcDNA: vcDNA=SeqID_18455; Strand=-; Position=482-784
EEPSSCISDSFITVCPLTAMVNALHLYKKINNKKLDIIELKENIVEALVYQYLNTIQSKPFHIQDKTLLERIRWTKEGCQKKVQPMLQEYVSATKSSLCS

SEQ ID NO: 38759 - protein, 342 aa, Diabrotica virgifera
  misc_feature: Coding regions on vcDNA: vcDNA=SeqID_18456; Strand=-; Position=2-1027
  misc_feature (17)..(76): Xaa can be any naturally occurring amino acid
  misc_feature (78)..(342): Xaa can be any naturally occurring amino acid
VNFFQIKISACFSLKGXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38760 - protein, 149 aa, Diabrotica virgifera
  misc_feature: Coding regions on vcDNA: vcDNA=SeqID_18457; Strand=+; Position=129-575
  misc_feature: Homolog annotation: Hit_ID=XP_317666.1; Match level="QueryCoverage =100%, HitCoverage=30%, E-value=3e-49, Identity=66%"; Hit description= ENSANGP00000018515 [Anopheles gambiae]
  misc_feature: Gene Ontology Annotation: Molecular function=ATPase activity; Cellular component=plasma membrane; Biological process=protein kinase C activation
  misc_feature: Pfam annotation: Pfam_ID=PDZ; Match level="Score=27.4, E-value=4.4e -05, Copies=1"; Pfam description=PDZ domain (Also known as DHR or GLGF)
  misc_feature (99)..(105): Xaa can be any naturally occurring amino acid
SMLDLEFDYFFEEDKMGMTVTSVSVTIRKDDNNLIGISIGGGSPLCPCLYIVQIFDYTAAAKDGTLQSGDELVSVNGQSVKGKTNVEVAKMIQAAKDEXXXXXXXLHADPVQGRRLYIIIPKMKDLLDEYMSSSTTDALAICREILCTD

SEQ ID NO: 38761 - protein, 111 aa, Diabrotica virgifera
  misc_feature: Coding regions on vcDNA: vcDNA=SeqID_18458; Strand=-; Position=453-788
NCIDPSTTLHRYVYYDCNGLYMSKPEINYSFGPRTVKPRRDQVGQAKVKIQFYEIDQLLKCRNLPDQVQQNIIFHNVHYFYTVAIKTKKISVYSHMFKNYGTQTYTTRQIP

SEQ ID NO: 38762 - protein, 152 aa, Diabrotica virgifera
  misc_feature: Coding regions on vcDNA: vcDNA=SeqID_18459; Strand=+; Position=282-733
  misc_feature: Homolog annotation: Hit_ID=XP_393034.1; Match level="QueryCoverage =96%, HitCoverage=53%, E-value=3e-14, Identity=37%"; Hit description =similar to 60S ribosomal protein L7a (Surfeit locus protein 3) (PLA -X polypeptide) [Apis
  misc_feature (78)..(78): Xaa can be any naturally occurring amino acid
  misc_feature (95)..(95): Xaa can be any naturally occurring amino acid
  misc_feature (119)..(127): Xaa can be any naturally occurring amino acid
MHLNLFKDPIPTNILSPNSDKQTMMPIFMDSTKHPTKTDLPFNHILQDKADAKVAITEDMPAMKTHTLNHVTNTVTTXLIKQNEDHVNDIDLDVXDPIDVDQHLPILVQLMAVTYGVGXXXXXXXXXLRRENCSSVALTLVDSVDRSNFNKL

SEQ ID NO: 38763 - protein, 107 aa, Diabrotica virgifera
  misc_feature: Coding regions on vcDNA: vcDNA=SeqID_18460; Strand=-; Position=444-767
  misc_feature (5)..(5): Xaa can be any naturally occurring amino acid
  misc_feature (20)..(20): Xaa can be any naturally occurring amino acid
  misc_feature (25)..(31): Xaa can be any naturally occurring amino acid
LIREXPKLCKFNFLKLRQLXPCSCXXXXXXXQEIQFAVQKRIRMLLLSYYYFKIDRIHYSDLQIIYSFFSIPLPLLELIEYNFSLKLDKIHSCILEVVMIHSYLYFC

SEQ ID NO: 38764 - protein, 66 aa, Diabrotica virgifera
  misc_feature: Coding regions on vcDNA: vcDNA=SeqID_18461; Strand=-; Position=2-199
  misc_feature (6)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFVLGXXXXXXXXTNLAHTGLNXXXXXXXXSNXXXXXXXXXXXXXXPTSRSXXXXXXXXXXXXXXV

SEQ ID NO: 38765 - protein, 78 aa, Diabrotica virgifera
  misc_feature: Coding regions on vcDNA: vcDNA=SeqID_18462; Strand=-; Position=251-487
  misc_feature (72)..(78): Xaa can be any naturally occurring amino acid
FDHIIELEPKNHRHKQHGVLPVKCVHCILKTTTPLRLAPQWTQEAEKTPYHSRRQFLGSSSPSNRRTERIRXXXXXXX

SEQ ID NO: 38766 - protein, 111 aa, Diabrotica virgifera
  misc_feature: Coding regions on vcDNA: vcDNA=SeqID_18463; Strand=-; Position=816 -1151
  misc_feature (2)..(33): Xaa can be any naturally occurring amino acid
  misc_feature (42)..(50): Xaa can be any naturally occurring amino acid
  misc_feature (78)..(84): Xaa can be any naturally occurring amino acid
KXXXXXXXXXXXXXXXXXXXXXXXXXXXXXXXXDVKLLLLGXXXXXXXXXIRGKFRGNCFSGGGVHFHWDGFPYKLAXXXXXXXSEFETFELSRMRHKDAEIAYMEMGVQL

SEQ ID NO: 38767 - protein, 86 aa, Diabrotica virgifera
  misc_feature: Coding regions on vcDNA: vcDNA=SeqID_18464; Strand=-; Position=0-257
  misc_feature (21)..(83): Xaa can be any naturally occurring amino acid
EFGTFPPNKKIPALFFPLRVXXXXXXXXXXXXXXXXXXXXXXXXXXXXXXXXXXXXXXXXXXXXXXXXXXXXXXXXXXXXXXXVSR

SEQ ID NO: 38768 - protein, 94 aa, Diabrotica virgifera
  misc_feature: Coding regions on vcDNA: vcDNA=SeqID_18465; Strand=-; Position=2-283
  misc_feature (3)..(32): Xaa can be any naturally occurring amino acid
  misc_feature (36)..(47): Xaa can be any naturally occurring amino acid
  misc_feature (51)..(89): Xaa can be any naturally occurring amino acid
PLXXXXXXXXXXXXXXXXXXXXXXXXXXXXXXFPPXXXXXXXXXXXXLKNXXXXXXXXXXXXXXXXXXXXXXXXXXXXXXXXXXXXXXXTPSSQ

SEQ ID NO: 38769 - protein, 101 aa, Diabrotica virgifera
  misc_feature: Coding regions on vcDNA: vcDNA=SeqID_18466; Strand=+; Position=401-703
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLXVK

SEQ ID NO: 38770 - protein, 200 aa, Diabrotica virgifera
  misc_feature: Coding regions on vcDNA: vcDNA=SeqID_18467; Strand=+; Position=201-798
  misc_feature: Homolog annotation: Hit_ID=NP_724868.2; Match level="QueryCoverage =96%, HitCoverage=42%, E-value=1e-66, Identity=57%"; Hit description =CG1407-PA, isoform A [Drosophila melanogaster] gb|AAM71050.2| CG1407- PA, isoform A [Drosophila
  misc_feature: Gene Ontology Annotation: Molecular function=molecular_function unknown; Cellular component=integral to membrane; Biological process= protein targeting
  misc_feature: Pfam annotation: Pfam_ID=zf-DHHC; Match level="Score=114.5, E-value =2.7e-31, Copies=1"; Pfam description=DHHC zinc finger domain
  misc_feature (147)..(147): Xaa can be any naturally occurring amino acid
  misc_feature (150)..(150): Xaa can be any naturally occurring amino acid
  misc_feature (180)..(180): Xaa can be any naturally occurring amino acid
MAVPGGNNKGPCYWCFKAVKWIPVLFIVTIVVWSYYAYVIQLCLLTVDDLPRRIFYLIFFHMFFFMFFWSYWQTIFTDIGRVPSKFAIPDQIFDAYLSSSDNYENQNRILENLARRLPITNVTVTGGVRVCEKCRIVKPDRAHHCSXVCXVCVLKMDHHCPWINNCVSFTNYKYFLLFLXYALLYCIYVSLTSLTYFISF

SEQ ID NO: 38771 - protein, 75 aa, Diabrotica virgifera
  misc_feature: Coding regions on vcDNA: vcDNA=SeqID_18468; Strand=-; Position=100-327
  misc_feature: Pfam annotation: Pfam_ID=hATC; Match level="Score=38.8, E-value=1.6e -08, Copies=1"; Pfam description=hAT family dimerisation domain
ENILDWWRRHENIYSSLSKIAKDFLGTSATSVHAERLFSRATLIITKPRNRLRVDSIRSVICLNSWLINSDLKIC

SEQ ID NO: 38772 - protein, 47 aa, Diabrotica virgifera
  misc_feature: Coding regions on vcDNA: vcDNA=SeqID_18469; Strand=-; Position=22-165
LCHVRINVTNAYHHGLTLFSIICDALKNAYEKNHIILSPRNSQILLK

SEQ ID NO: 38773 - protein, 124 aa, Diabrotica virgifera
  misc_feature: Coding regions on vcDNA: vcDNA=SeqID_18470; Strand=+; Position=1-375
  misc_feature (3)..(13): Xaa can be any naturally occurring amino acid
  misc_feature (104)..(121): Xaa can be any naturally occurring amino acid
RTXXXXXXXXXXXEQQRLQSTVAGDSTVNMRKTVIRLRRTVPNVRTVPNVPRLQVQIKNNRVLATRFKLVLNEEIQSQLESLKDYYTGEINTNVKVVPEATITXXXXXXXXXXXXXXXXXXCYI

SEQ ID NO: 38774 - protein, 21 aa, Diabrotica virgifera
  misc_feature: Coding regions on vcDNA: vcDNA=SeqID_18471; Strand=-; Position=1-63
  misc_feature (1)..(1): Xaa can be any naturally occurring amino acid
  misc_feature (3)..(21): Xaa can be any naturally occurring amino acid
XNXXXXXXXXXXXXXXXXXXX

SEQ ID NO: 38775 - protein, 84 aa, Diabrotica virgifera
  misc_feature: Coding regions on vcDNA: vcDNA=SeqID_18472; Strand=-; Position=1-252
  misc_feature (5)..(19): Xaa can be any naturally occurring amino acid
  misc_feature (22)..(28): Xaa can be any naturally occurring amino acid
  misc_feature (30)..(30): Xaa can be any naturally occurring amino acid
  misc_feature (34)..(34): Xaa can be any naturally occurring amino acid
  misc_feature (40)..(48): Xaa can be any naturally occurring amino acid
  misc_feature (52)..(58): Xaa can be any naturally occurring amino acid
  misc_feature (64)..(64): Xaa can be any naturally occurring amino acid
  misc_feature (75)..(75): Xaa can be any naturally occurring amino acid
NIRFXXXXXXXXXXXXXXXSFXXXXXXXIXIETXLAHTVXXXXXXXXXSTDXXXXXXXPIITLXQHRGRNLYYRXDSPNKITLL

SEQ ID NO: 38776 - protein, 66 aa, Diabrotica virgifera; identical to SEQ ID NO: 26808
  misc_feature: Coding regions on vcDNA: vcDNA=SeqID_18473; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38777 - protein, 55 aa, Diabrotica virgifera
  misc_feature: Coding regions on vcDNA: vcDNA=SeqID_18474; Strand=-; Position=0-164
  misc_feature (3)..(9): Xaa can be any naturally occurring amino acid
  misc_feature (23)..(53): Xaa can be any naturally occurring amino acid
GGXXXXXXXFETLPKKNPPFFLXXXXXXXXXXXXXXXXXXXXXXXXXXXXXXXTP

SEQ ID NO: 38778 - protein, 275 aa, Diabrotica virgifera
  misc_feature: Coding regions on vcDNA: vcDNA=SeqID_18475; Strand=+; Position=7-834
  misc_feature: Homolog annotation: Hit_ID=BAB32480.1; Match level="QueryCoverage =98%, HitCoverage=100%, E-value=5e-49, Identity=43%"; Hit description= cuticle protein [Bombyx mori]
  misc_feature: Gene Ontology Annotation: Molecular function=structural constituent of eye lens
  misc_feature: Pfam annotation: Pfam_ID=Chitin_bind_4; Match level="Score=118.1, E -value=2.2e-32, Copies=1"; Pfam description=Insect cuticle protein
MATKFLVLAAFIAVAKAGSYGSGFGYAAPAVVAHGSHDAISTYSTVQHHAPAVHSYAAHAPLVHAPVTHSYAAPLVQAPVAHAYAAPVAHVHAEPSAPAHYDFAYGVSDPHTGDAKSQHESRRGDVVHGSYSLVESDGTKRTVDYTADPHHGFNAVVHKEPTVHAVAPVVAKIVAPVAHAAYAAPAVHAAYSAPAVHAAYSAPAVHAAYSAPVVHAAHAAPVAHAAYAGPVAHAAYAAPALHGYASSVAHGYTAPLAHGHHAYAAHAPVLSHNLW

SEQ ID NO: 38779 - protein, 63 aa, Diabrotica virgifera
  misc_feature: Coding regions on vcDNA: vcDNA=SeqID_18476; Strand=-; Position=0-188
  misc_feature (3)..(25): Xaa can be any naturally occurring amino acid
  misc_feature (27)..(46): Xaa can be any naturally occurring amino acid
  misc_feature (54)..(60): Xaa can be any naturally occurring amino acid
KLXXXXXXXXXXXXXXXXXXXXXXXPXXXXXXXXXXXXXXXXXXXXMKLYRVSXXXXXXXFLT

SEQ ID NO: 38780 - protein, 28 aa, Diabrotica virgifera
  misc_feature: Coding regions on vcDNA: vcDNA=SeqID_18477; Strand=-; Position=0-83
  misc_feature (1)..(25): Xaa can be any naturally occurring amino acid
  misc_feature (27)..(27): Xaa can be any naturally occurring amino acid
XXXXXXXXXXXXXXXXXXXXXXXXXLXT

SEQ ID NO: 38781 - protein, 62 aa, Diabrotica virgifera
  misc_feature: Coding regions on vcDNA: vcDNA=SeqID_18478; Strand=+; Position=184-372
LKRLKHNFCEDKISNIVGYIITSLFYSSHKAKQRFYENYARGPFYPIFPYHVAGAYYTIAKF

SEQ ID NO: 38782 - protein, 119 aa, Diabrotica virgifera
  misc_feature: Coding regions on vcDNA: vcDNA=SeqID_18479; Strand=-; Position=545-904
  misc_feature (6)..(6): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (22)..(23): Xaa can be any naturally occurring amino acid
  misc_feature (29)..(29): Xaa can be any naturally occurring amino acid
  misc_feature (32)..(32): Xaa can be any naturally occurring amino acid
  misc_feature (36)..(36): Xaa can be any naturally occurring amino acid
  misc_feature (42)..(42): Xaa can be any naturally occurring amino acid
EQNEAXVKEKQAVLXIXRXRAXXKRKVWXSYXNFHXRISSIXFYILPLFSIPRVIFFNFSRLYYLLYPFSSWSASFSFYYVLCFVDFSCNSIGLYLVSSSNACTGLFVSFLFYSLLVLG

SEQ ID NO: 38783 - protein, 92 aa, Diabrotica virgifera
  misc_feature: Coding regions on vcDNA: vcDNA=SeqID_18480; Strand=+; Position=323-598
  misc_feature: Homolog annotation: Hit_ID=XP_393507.1; Match level="QueryCoverage =96%, HitCoverage=33%, E-value=1e-13, Identity=44%"; Hit description =similar to ENSANGP00000005186 [Apis mellifera]
YSKDDEVISLSKTLMKNCKKFISGTNSNEKSSSSSSYKPKKEKEEKPSREEKDRDKDKGNLPKQYPDRSNTTDSVRLKRRLLLTAVIRTNSQ

SEQ ID NO: 38784 - protein, 42 aa, Diabrotica virgifera
  misc_feature: Coding regions on vcDNA: vcDNA=SeqID_18481; Strand=+; Position=2-129
  misc_feature: Homolog annotation: Hit_ID=NP_724844.1; Match level="QueryCoverage =95%, HitCoverage=3%, E-value=5e-11, Identity=82%"; Hit description =CG1516-PL, isoform L [Drosophila melanogaster] ref|NP_724843.1| CG1516-PK, isoform K [Drosophila
  misc_feature (27)..(27): Xaa can be any naturally occurring amino acid
ARHVGYENAGTVEFLCDEKGNFYFIEXNARLQWRYGTEEILD

SEQ ID NO: 38785 - protein, 66 aa, Diabrotica virgifera; identical to SEQ ID NO: 26808
  misc_feature: Coding regions on vcDNA: vcDNA=SeqID_18482; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38786 - protein, 21 aa, Diabrotica virgifera
  misc_feature: Coding regions on vcDNA: vcDNA=SeqID_18483; Strand=-; Position=1-63
  misc_feature (4)..(12): Xaa can be any naturally occurring amino acid
LSYXXXXXXXXXTNLAHTGLN

SEQ ID NO: 38787 - protein, 66 aa, Diabrotica virgifera
  misc_feature: Coding regions on vcDNA: vcDNA=SeqID_18484; Strand=-; Position=274-474
ELDTYYIIHKQKWNCRKRLTDTVISNCQKNHHSLLFKSLWIEISNLFSSKIFTQKWKFSIAESKYG

SEQ ID NO: 38788 - protein, 72 aa, Diabrotica virgifera
  misc_feature: Coding regions on vcDNA: vcDNA=SeqID_18485; Strand=+; Position=293-511
YFMDKKNAVPFWEHFLLLDFLSDFIKMFLVVAFFYSLFQIFIHKLLVVVGDRILLKRVRHLPVVFWLIVPSF

SEQ ID NO: 38789 - protein, 67 aa, Diabrotica virgifera
  misc_feature: Coding regions on vcDNA: vcDNA=SeqID_18486; Strand=+; Position=369-572
  misc_feature (25)..(25): Xaa can be any naturally occurring amino acid
  misc_feature (43)..(43): Xaa can be any naturally occurring amino acid
ETIIDDPVHIKYKKNMITVTSQNEXAVIIVAIVTEEFITRITXNVLTRERRFYAFTLDGIQIIDVDD

SEQ ID NO: 38790 - protein, 283 aa, Diabrotica virgifera
  misc_feature: Coding regions on vcDNA: vcDNA=SeqID_18487; Strand=+; Position=26-874
  misc_feature: Homolog annotation: Hit_ID=BAB78533.1; Match level="QueryCoverage =99%, HitCoverage=56%, E-value=6e-52, Identity=44%"; Hit description =annexin B13a [Bombyx mori]
  misc_feature: Gene Ontology Annotation: Molecular function=anticoagulant activity; Cellular component=nuclear membrane
  misc_feature: Pfam annotation: Pfam_ID=Annexin; Match level="Score=126.5, E-value =6.4e-35, Copies=2"; Pfam description=Annexin
  misc_feature (99)..(107): Xaa can be any naturally occurring amino acid
  misc_feature (251)..(251): Xaa can be any naturally occurring amino acid
MSYPGYNPYQQGSAPGAPSPYPQHPQGGAPSYPPLNPNAFGYPSNMPMQMPQPMQMPTYPPSMPGYPPAVPGGYPPPQSSGGYPPSSGGYHSGGGGASXXXXXXXXXPQQPYSSAPGAPPGGHGHQGSQGPYGGFSYTQHSAPQSYAAPRRTQRTPTVRPAQPFNPNDDAQVLRTAMKGFGTDEKAIINCLARRTNEQRLHIAAAFKTMYGKDLIKDLKSELSGNFENCIVAMMTPLPEYYAKELHDAMSXVGTDEDVLIEVMCTMSNRENMVIREAYHKLYY

SEQ ID NO: 38791 - protein, 244 aa, Diabrotica virgifera
  misc_feature: Coding regions on vcDNA: vcDNA=SeqID_18488; Strand=-; Position=2-733
  misc_feature (3)..(13): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(238): Xaa can be any naturally occurring amino acid
  misc_feature (240)..(244): Xaa can be any naturally occurring amino acid
PFXXXXXXXXXXXTHPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 38792 - protein, 45 aa, Diabrotica virgifera
  misc_feature: Coding regions on vcDNA: vcDNA=SeqID_18489; Strand=+; Position=1-135
  misc_feature (2)..(10): Xaa can be any naturally occurring amino acid
  misc_feature (22)..(22): Xaa can be any naturally occurring amino acid
PXXXXXXXXXSLETTTTTNHQXSRKGAGKNPGNSSNVKIRRDQNL

SEQ ID NO: 38793 - protein, 268 aa, Diabrotica virgifera
  misc_feature: Coding regions on vcDNA: vcDNA=SeqID_18490; Strand=+; Position=65-871
  misc_feature: Homolog annotation: Hit_ID=EAL33308.1; Match level="QueryCoverage =98%, HitCoverage=98%, E-value=9e-76, Identity=52%"; Hit description =GA20608-PA [Drosophila pseudoobscura]
  misc_feature: Gene Ontology Annotation: Molecular function=zinc ion binding; Cellular component=mitochondrial matrix; Biological process=one -carbon compound metabolism
  misc_feature: Pfam annotation: Pfam_ID=Carb_anhydrase; Match level="Score=296.1, E -value=5.5e-86, Copies=1"; Pfam description=Eukaryotic-type carbonic anhydrase
  misc_feature (242)..(242): Xaa can be any naturally occurring amino acid
  misc_feature (245)..(245): Xaa can be any naturally occurring amino acid
  misc_feature (259)..(259): Xaa can be any naturally occurring amino acid
MAVDWGYCEINGPHSWVSKFPDAAGERQSPIDISPVSVTKFHTEERLQWKYEPESSTKLENTGAAWKVGVKGKGSELKGGPLDDEYVLDQFHCHWGETNDKGSEHTINGEPFAGELHMVHWNSAKYADINEAASNPDGLSVLGVFLKPGKKNDELEKVVKYLDQITHKGDVVEIPESIDPKLLIPKDTGGYYTYHGSLTTPPCSECVIWVVFKEPIEVSDEQLNAFRQIRKYNKNDEICCDXNCXWYVKKNFRPTVPIXGERSKRNAT

SEQ ID NO: 38794 - protein, 106 aa, Diabrotica virgifera
  misc_feature: Coding regions on vcDNA: vcDNA=SeqID_18491; Strand=+; Position=115-435
VSWTAGTTITHKKVCHFAQFYITKCHFLLQTLKFFSSHFVRYIIDMLYFYRKTSLQLKFKLKSGLDWFSFTGVLASSAEEVCKTKTAIQGLCIPLNRKQVFFLTKI

SEQ ID NO: 38795 - protein, 126 aa, Diabrotica virgifera
  misc_feature: Coding regions on vcDNA: vcDNA=SeqID_18492; Strand=-; Position=2-382
  misc_feature (5)..(11): Xaa can be any naturally occurring amino acid
  misc_feature (15)..(22): Xaa can be any naturally occurring amino acid
  misc_feature (27)..(38): Xaa can be any naturally occurring amino acid
  misc_feature (48)..(62): Xaa can be any naturally occurring amino acid
  misc_feature (69)..(102): Xaa can be any naturally occurring amino acid
  misc_feature (111)..(125): Xaa can be any naturally occurring amino acid
LKKVXXXXXXXCRSXXXXXXXXLSFLXXXXXXXXXXXXHFIFHQLVPXXXXXXXXXXXXXXXRVKIPGXXXXXXXXXXXXXXXXXXXXXXXXXXXXXXXXXXNLYIFTKYXXXXXXXXXXXXXXXI

SEQ ID NO: 38796 - protein, 17 aa, Diabrotica virgifera
  misc_feature: Coding regions on vcDNA: vcDNA=SeqID_18493; Strand=-; Position=1-51
  misc_feature (1)..(14): Xaa can be any naturally occurring amino acid
XXXXXXXXXXXXXXAIK

SEQ ID NO: 38797 - protein, 242 aa, Diabrotica virgifera
  misc_feature: Coding regions on vcDNA: vcDNA=SeqID_18494; Strand=+; Position=84-810
  misc_feature: Homolog annotation: Hit_ID=XP_317033.1; Match level="QueryCoverage =100%, HitCoverage=60%, E-value=2e-86, Identity=62%"; Hit description= ENSANGP00000019280 [Anopheles gambiae]
  misc_feature: Gene Ontology Annotation: Molecular function=alpha-methylacyl-CoA racemase activity; Biological process=isoprenoid catabolism
  misc_feature: Pfam annotation: Pfam_ID=CoA_transf_3; Match level="Score=227.0, E -value=3.6e-65, Copies=1"; Pfam description=CoA-transferase family III
  misc_feature (121)..(121): Xaa can be any naturally occurring amino acid
  misc_feature (235)..(235): Xaa can be any naturally occurring amino acid
MALKGLKVIEFSGLLPVPYCGMVLAEFGASVIRIDKIGYNSNLDCLGNGKQSMSLNLKHSKAINIIKSLTRESDVLIEPFRKGIMEKLGLGPKVLMKENPRLIYARLTGYGQNGSFSSNAXHDINYVALSGLLSLFGRYEENPLPPVNVLADIGGGGLTCAMGILLALIERSTSGKGQIVDTSMVEGTAYLGTWFYRGKNTLPIWGQGRGQNVLDSGTHFYEVYKTKDDRYMSVXALEPSFY

SEQ ID NO: 38798 - protein, 88 aa, Diabrotica virgifera
  misc_feature: Coding regions on vcDNA: vcDNA=SeqID_18495; Strand=+; Position=25-291
  misc_feature: Pfam annotation: Pfam_ID=COX7a; Match level="Score=23.8, E-value=2.3e- 05, Copies=1"; Pfam description=Cytochrome c oxidase subunit VIIa
KGCNHTRQLFALGRAINNQVVRNASVDVGPRTARLKELQKKLQVDDGVPVHLKGGVKDKLLYQFTLLLTVVGLGMSAEAIYRIMTGKK

SEQ ID NO: 38799 - protein, 91 aa, Diabrotica virgifera
  misc_feature: Coding regions on vcDNA: vcDNA=SeqID_18496; Strand=-; Position=39-314
LFPTYHYRNLLSVSRVIYNAYIIFGCFKFPIKLSQSYITSSNKKSNVFEYSNDFCHCSLRSGTLEGERQEDTFDNSNSFVNFIFTNSKFFR

SEQ ID NO: 38800 - protein, 73 aa, Diabrotica virgifera
  misc_feature: Coding regions on vcDNA: vcDNA=SeqID_18497; Strand=-; Position=2-220
  misc_feature (5)..(19): Xaa can be any naturally occurring amino acid
  misc_feature (21)..(73): Xaa can be any naturally occurring amino acid
ILKNXXXXXXXXXXXXXXXKXXXXXXXXXXXXXXXXXXXXXXXXXXXXXXXXXXXXXXXXXXXXXXXXXXXXX

SEQ ID NO: 38801 - protein, 220 aa, Diabrotica virgifera
  misc_feature: Coding regions on vcDNA: vcDNA=SeqID_18498; Strand=+; Position=77-739
  misc_feature: Homolog annotation: Hit_ID=XP_321335.1; Match level="QueryCoverage =86%, HitCoverage=83%, E-value=6e-74, Identity=66%"; Hit description =ENSANGP00000013320 [Anopheles gambiae]
  misc_feature: Gene Ontology Annotation: Molecular function=dolichyl-phosphate -mannose-protein mannosyltransferase activity; Cellular component =extracellular space; Biological process=protein amino acid glycosylation
  misc_feature: Pfam annotation: Pfam_ID=MIR; Match level="Score=144.6, E-value=2.2e -40, Copies=3"; Pfam description=MIR domain
MLHLRKGVLLTLFIYVIHGFREIHASSQKYVTCGSVVKLLNTDYRVRLHSHDVKYGTGSGQQSVTGTEVQEDINSHWLVKPATGKSLERGTPIKCGSTIRLEHVDTKKNLHSHHFSSPLSSNQEISCYGDNGERDSGDNWMVICSGDSWQRDESIMFKHVDTDMYLSVSGRTFGRPINGQMEVIGVRSSTGSVHWQTAEGVFLHAPDLSARHMHSVHSEL

SEQ ID NO: 38802 - protein, 54 aa, Diabrotica virgifera
  misc_feature: Coding regions on vcDNA: vcDNA=SeqID_18499; Strand=-; Position=0-161
  misc_feature (7)..(53): Xaa can be any naturally occurring amino acid
PCFPLRXXXXXXXXXXXXXXXXXXXXXXXXXXXXXXXXXXXXXXXXXXXXXXXA

SEQ ID NO: 38803 - protein, 103 aa, Diabrotica virgifera
  misc_feature: Coding regions on vcDNA: vcDNA=SeqID_18500; Strand=-; Position=3-311
  misc_feature (26)..(38): Xaa can be any naturally occurring amino acid
  misc_feature (40)..(50): Xaa can be any naturally occurring amino acid
  misc_feature (60)..(68): Xaa can be any naturally occurring amino acid
  misc_feature (70)..(83): Xaa can be any naturally occurring amino acid
  misc_feature (90)..(102): Xaa can be any naturally occurring amino acid
AGSVSIVFSDPISTPKRTLRVVNPNXXXXXXXXXXXXXFXXXXXXXXXXXNQPGSHRFKXXXXXXXXXEXXXXXXXXXXXXXXSNIEVAXXXXXXXXXXXXXC

SEQ ID NO: 38804 - protein, 167 aa, Diabrotica virgifera
  misc_feature: Coding regions on vcDNA: vcDNA=SeqID_18501; Strand=-; Position=109-612
  misc_feature (76)..(92): Xaa can be any naturally occurring amino acid
DPLSETDSSYFEESIKDPKVDDSSSTVSGGTIKEQVGLFEKINKLNKRLLKEEENLVRLEANLKKYQKNEKNKEEXXXXXXXXXXXXXXXXXCEMQHNEIVLEETLEKLETRRVFLENLHRELVNEDQEHEMLQALLFTKMQQFDLEKRKSKTQYVYQTKELLDTLV

SEQ ID NO: 38805 - protein, 287 aa, Diabrotica virgifera
  misc_feature: Coding regions on vcDNA: vcDNA=SeqID_18502; Strand=+; Position=1-861
  misc_feature: Pfam annotation: Pfam_ID=zf-AD; Match level="Score=22.2, E-value =0.00033, Copies=1"; Pfam description=Zinc-finger associated domain (zf-AD)
ILCGRQDLLEEKKPENLFKSHRVCAAHFEPICFVNDLRNRLQPCAAPTILPVSTVNSPLDHAAYCAFVLEKRFGKPVSPVNDNDGGDDVIDNDGGDVVIDNDFYLDENDVDEVPSQDTGQNIQKEAEGVERHHVAQKSEIINVSKMTTETVLLSENKSLLQKRLEESKVLQVEKEREKRQSTDQIKCDNTTITQKNEASNKENISNRFIITKEQLEQKCRTCFVRSGTNNVWIKYHDGMIFRDILKNFSLVEIHRSDGLPQSICYVCTNYIIKLCTLKMNIDRPLKN

SEQ ID NO: 38806 - protein, 109 aa, Diabrotica virgifera
  misc_feature: Coding regions on vcDNA: vcDNA=SeqID_18503; Strand=+; Position=1-330
  misc_feature (93)..(109): Xaa can be any naturally occurring amino acid
EQLQSGVYRLTCGDCPKAYIGRTGRTFDKRMAEHKGAFNSGRADTSTCALRLLDHDHSFNEEFGILHIQNRGLELSFLESMEIDKLRNTDVIXXXXXXXXXXXXXXXXX

SEQ ID NO: 38807 - protein, 99 aa, Diabrotica virgifera
  misc_feature: Coding regions on vcDNA: vcDNA=SeqID_18504; Strand=+; Position=588-884
RIIEKTVNRTLKKVKIDNTTLKFYLFVMFDNTIRGICVRVNIVEFGLKYSEIFVCFTDASHFARAEFFNRRKIMQSTLLDSSCREYHLMNGCMCDAASL

SEQ ID NO: 38808 - protein, 62 aa, Diabrotica virgifera
  misc_feature: Coding regions on vcDNA: vcDNA=SeqID_18505; Strand=-; Position=0-185
  misc_feature (1)..(59): Xaa can be any naturally occurring amino acid
XXXXXXXXXXXXXXXXXXXXXXXXXXXXXXXXXXXXXXXXXXXXXXXXXXXXXXXXXXXIPA

SEQ ID NO: 38809 - protein, 274 aa, Diabrotica virgifera
  misc_feature: Coding regions on vcDNA: vcDNA=SeqID_18506; Strand=+; Position=1-822
  misc_feature: Homolog annotation: Hit_ID=AAF87760.1; Match level="QueryCoverage =100%, HitCoverage=62%, E-value=1e-100, Identity=70%"; Hit description=cytochrome oxidase subunit I [Diabrotica virgifera zeae]
  misc_feature: Pfam annotation: Pfam_ID=COX1; Match level="Score=-81.6, E-value=1.8e- 08, Copies=1"; Pfam description=Cytochrome C and Quinol oxidase polyp
  misc_feature (5)..(11): Xaa can be any naturally occurring amino acid
  misc_feature (22)..(29): Xaa can be any naturally occurring amino acid
  misc_feature (50)..(50): Xaa can be any naturally occurring amino acid
  misc_feature (85)..(85): Xaa can be any naturally occurring amino acid
  misc_feature (102)..(102): Xaa can be any naturally occurring amino acid
  misc_feature (105)..(111): Xaa can be any naturally occurring amino acid
  misc_feature (138)..(144): Xaa can be any naturally occurring amino acid
  misc_feature (158)..(158): Xaa can be any naturally occurring amino acid
  misc_feature (166)..(182): Xaa can be any naturally occurring amino acid
  misc_feature (212)..(212): Xaa can be any naturally occurring amino acid
  misc_feature (226)..(226): Xaa can be any naturally occurring amino acid
  misc_feature (228)..(235): Xaa can be any naturally occurring amino acid
  misc_feature (256)..(256): Xaa can be any naturally occurring amino acid
GHPEXXXXXXXGFGLISHIVRXXXXXXXXFGTLGIIYAMIAIGLLGFIVXAHHIFTVGMDVDTRAYFTSATIIIAVPTGIKVFRXLATYHGTTITYSPLTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIXVXXXXXXXXEAFSFQRKRLRPLRITSSIEXLQFNPPAEHRYSELPILS

SEQ ID NO: 38810 - protein, 255 aa, Diabrotica virgifera
  misc_feature: Coding regions on vcDNA: vcDNA=SeqID_18507; Strand=-; Position=1-765
  misc_feature (3)..(11): Xaa can be any naturally occurring amino acid
  misc_feature (27)..(255): Xaa can be any naturally occurring amino acid
KNXXXXXXXXXQFIFHPILHSSSQYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38811 - protein, 66 aa, Diabrotica virgifera
  misc_feature: Coding regions on vcDNA: vcDNA=SeqID_18508; Strand=+; Position=347-547
  misc_feature (7)..(13): Xaa can be any naturally occurring amino acid
DCFFNFXXXXXXXLIKLSFIKRRTHVARLRRAAWHERQTWYLPRAVHPHDFILNQLVPRASFPKVS

SEQ ID NO: 38812 - protein, 119 aa, Diabrotica virgifera
  misc_feature: Coding regions on vcDNA: vcDNA=SeqID_18509; Strand=-; Position=59-418
SYKYTFHSFHNDLSMLSIFRVIYPDISALITVYINFHYTTGKNNNVQPASFCSDSTSQRPSASPNAQKVPPSGNFWHLFVGYTLKINHKSWRRTTKILNRNNKTCPDPNLIKNPTLYPK

SEQ ID NO: 38813 - protein, 304 aa, Diabrotica virgifera
  misc_feature: Coding regions on vcDNA: vcDNA=SeqID_18510; Strand=+; Position=1-912
  misc_feature: Homolog annotation: Hit_ID=EAL41511.1; Match level="QueryCoverage =74%, HitCoverage=12%, E-value=8e-23, Identity=35%"; Hit description =ENSANGP00000029226 [Anopheles gambiae str. PEST] ref|XP_560046.1| ENSANGP00000029226 [Anopheles gambiae st
  misc_feature: Gene Ontology Annotation: Cellular component=adherens junction; Biological process=regulation of JNK cascade
AAEFLQRTTSIVTLEVAKAGAVYHGLATLLQQPSPTPHRGPRRMSERDLPSRVDSERSIPSSKSVPALHQIHSPLVNEQQPLRPNQTSASDVYSRTSSNNSINNNQNGQVLMNGGSVAANTALRSRSTHNLHQQDGGFYQNLSVYRNKIPSPQQLGDRTSALRSSQNSLHSSIANSQRPSSAYYPPASSITSRPNNLHQSIPNLKNPPNMYRLQNDEASRTGSFPNVQYSPNYFPAYSKNSYPSPEETKVPYNNTYMQNQSYPSPTNSSTQGYPNSVQQPLHINHNLRPEERNQDVRYNNGRFI

SEQ ID NO: 38814 - protein, 75 aa, Diabrotica virgifera
  misc_feature: Coding regions on vcDNA: vcDNA=SeqID_18511; Strand=-; Position=10-237
TQGYNHWLGQKPLNVQKITFNVPSTKWLPFSQTAPTDNIQKRQAADGNNSSRLDYLICQINISFSFLTVVTCILN

SEQ ID NO: 38815 - protein, 234 aa, Diabrotica virgifera
  misc_feature: Coding regions on vcDNA: vcDNA=SeqID_18512; Strand=-; Position=3-704
  misc_feature (12)..(19): Xaa can be any naturally occurring amino acid
  misc_feature (31)..(43): Xaa can be any naturally occurring amino acid
  misc_feature (46)..(234): Xaa can be any naturally occurring amino acid
PQIRYNFKSRTXXXXXXXXQLYTLIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38816 - protein, 43 aa, Diabrotica virgifera
  misc_feature: Coding regions on vcDNA: vcDNA=SeqID_18513; Strand=+; Position=3-134
PSSVRPCADDVRRDLKIPDLFTYYCILLVELRKMCKVLTSLCT

SEQ ID NO: 38817 - protein, 38 aa, Diabrotica virgifera
  misc_feature: Coding regions on vcDNA: vcDNA=SeqID_18514; Strand=+; Position=1-114
  misc_feature (5)..(11): Xaa can be any naturally occurring amino acid
  misc_feature (14)..(32): Xaa can be any naturally occurring amino acid
IGSSXXXXXXXLFXXXXXXXXXXXXXXXXXXXPSFQLS

SEQ ID NO: 38818 - protein, 56 aa, Diabrotica virgifera; identical to SEQ ID NO: 30140
  misc_feature: Coding regions on vcDNA: vcDNA=SeqID_18515; Strand=-; Position=1-168
  misc_feature (1)..(56): Xaa can be any naturally occurring amino acid

SEQ ID NO: 38819 - protein, 182 aa, Diabrotica virgifera
  misc_feature: Coding regions on vcDNA: vcDNA=SeqID_18516; Strand=+; Position=2-550
  misc_feature (5)..(136): Xaa can be any naturally occurring amino acid
  misc_feature (145)..(154): Xaa can be any naturally occurring amino acid
  misc_feature (160)..(173): Xaa can be any naturally occurring amino acid
FFSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTDNSAILXXXXXXXXXXRPRCWXXXXXXXXXXXXXXVRLLPFYMI

SEQ ID NO: 38820 - protein, 133 aa, Diabrotica virgifera
  misc_feature: Coding regions on vcDNA: vcDNA=SeqID_18517; Strand=+; Position=79-480
  misc_feature: Homolog annotation: Hit_ID=A32713; Match level="QueryCoverage=90%, HitCoverage=14%, E-value=2e-25, Identity=46%"; Hit description =reverse transcriptase homolog - fruit fly (Drosophila melanogaster)
  misc_feature (114)..(119): Xaa can be any naturally occurring amino acid
NGSIVEYLGLHMGKGLTWKTHIWKKRKHLDTIYRKYYWLLGRKSQLLRNKLLAYNAILKPIWTYGIQLWGTASKSNLAIMYRFQNKVLLAITDAPWFVSNKDILQYLQVPTVSXXXXXXSDKYLQRRKLPKMC

SEQ ID NO: 38821 - protein, 135 aa, Diabrotica virgifera
  misc_feature: Coding regions on vcDNA: vcDNA=SeqID_18518; Strand=-; Position=1-405
  misc_feature: Homolog annotation: Hit_ID=XP_319693.1; Match level="QueryCoverage =84%, HitCoverage=9%, E-value=1e-09, Identity=35%"; Hit description =ENSANGP00000021368 [Anopheles gambiae]
  misc_feature (21)..(29): Xaa can be any naturally occurring amino acid
  misc_feature (31)..(38): Xaa can be any naturally occurring amino acid
  misc_feature (47)..(53): Xaa can be any naturally occurring amino acid
MRTTGVAGQSVHNNNLQNISXXXXXXXXXVXXXXXXXXIETIRDTFXXXXXXXIGLTIFAQQKFGWIIKKTEEILNPIIKRLEENHSQKSIKDYFKTKFKVDSLNIEGKVSKRVKSAIDRFGKTQDELIAEEMVQ

SEQ ID NO: 38822 - protein, 60 aa, Diabrotica virgifera
  misc_feature: Coding regions on vcDNA: vcDNA=SeqID_18519; Strand=-; Position=1-180
  misc_feature (2)..(60): Xaa can be any naturally occurring amino acid
PXXXXXXXXXXXXXXXXXXXXXXXXXXXXXXXXXXXXXXXXXXXXXXXXXXXXXXXXXXX

SEQ ID NO: 38823 - protein, 225 aa, Diabrotica virgifera
  misc_feature: Coding regions on vcDNA: vcDNA=SeqID_18520; Strand=+; Position=232-905
  misc_feature: Homolog annotation: Hit_ID=CAG11797.1; Match level="QueryCoverage =96%, HitCoverage=22%, E-value=2e-26, Identity=33%"; Hit description =unnamed protein product [Tetraodon nigroviridis]
  misc_feature: Gene Ontology Annotation: Molecular function=magnesium ion binding; Cellular component=intracellular; Biological process=negative regulation of cell cycle
  misc_feature (175)..(175): Xaa can be any naturally occurring amino acid
  misc_feature (185)..(185): Xaa can be any naturally occurring amino acid
  misc_feature (198)..(198): Xaa can be any naturally occurring amino acid
  misc_feature (203)..(203): Xaa can be any naturally occurring amino acid
  misc_feature (209)..(210): Xaa can be any naturally occurring amino acid
MRVPVLYKTISNILEITPGIDQNNYFTKLEKLLHVEENQLRIDIRNYDTLSTLKVVKGKSLYELEVPGLAEARPSLLRNDKVYIKEKKSDSVKYEGCIHVVLERSVHIGLNHRFNKIFIPNKKFHIEFGFNRRSIRVEKQALFLAHTHGIIPTLYPKEIGIGLLTEVNLAMSNRXLNEEQVLAVXNIVKHRSYPFIIXGPPGXGKTVTXXGSVYQIWKNIPQSEF

SEQ ID NO: 38824 - protein, 73 aa, Diabrotica virgifera
  misc_feature: Coding regions on vcDNA: vcDNA=SeqID_18521; Strand=-; Position=62-283
VRLFICLQVTSRSKVSLQIFVMIKIECQNLCRFTDLSYVARFDIQLNLLFKFYRYYLTLKTKNFYTARYEKCY

SEQ ID NO: 38825 - protein, 296 aa, Diabrotica virgifera
  misc_feature: Coding regions on vcDNA: vcDNA=SeqID_18522; Strand=+; Position=2-892
  misc_feature: Homolog annotation: Hit_ID=CAG17501.1; Match level="QueryCoverage =79%, HitCoverage=34%, E-value=3e-37, Identity=36%"; Hit description =hypothetical protein [Cotesia congregata virus] ref|YP_184879.1| hypothetical protein CcBV_30.5 [Cotesia c
AAALGHDPSELPLSRSTIQRERKEARKTIFQTIKESTSFDNPVIVHWDGKILPDILGSDKVDRLPVIVSCPADNTDKLLGVPKLVGGTGENSANAVYKKLTEWGLGKKVVGMCFDTTSVNTGLKNGACVLIEHLVEGELLWLACRHHVLEIVLSKVFTFCFGPSSSPDIPIFKRFKAAWQYIRQDSYQSLGNIPGSEDFKQSAVDVLQVALKGKNQPRDDYMELIELALIALGHTPAKIHWRAPGAVHHARWMAKLLYGIKIYLFRDDSGFVTTQREKAQLERFVIWSSCLRQVLG

SEQ ID NO: 38826 - protein, 25 aa, Diabrotica virgifera
  misc_feature: Coding regions on vcDNA: vcDNA=SeqID_18523; Strand=-; Position=0-74
  misc_feature (5)..(22): Xaa can be any naturally occurring amino acid
  misc_feature (24)..(24): Xaa can be any naturally occurring amino acid
LKKLXXXXXXXXXXXXXXXXXXLXT

SEQ ID NO: 38827 - protein, 182 aa, Diabrotica virgifera
  misc_feature: Coding regions on vcDNA: vcDNA=SeqID_18524; Strand=+; Position=203-751
  misc_feature: Homolog annotation: Hit_ID=AAR09774.1; Match level="QueryCoverage =94%, HitCoverage=84%, E-value=1e-28, Identity=49%"; Hit description =similar to Drosophila melanogaster Mhc [Drosophila yakuba]
  misc_feature: Gene Ontology Annotation: Molecular function=structural constituent of muscle; Cellular component=muscle myosin; Biological process =striated muscle contraction
  misc_feature (31)..(31): Xaa can be any naturally occurring amino acid
  misc_feature (81)..(81): Xaa can be any naturally occurring amino acid
  misc_feature (91)..(91): Xaa can be any naturally occurring amino acid
  misc_feature (96)..(96): Xaa can be any naturally occurring amino acid
  misc_feature (106)..(106): Xaa can be any naturally occurring amino acid
  misc_feature (139)..(139): Xaa can be any naturally occurring amino acid
  misc_feature (152)..(152): Xaa can be any naturally occurring amino acid
MVALTLHTRSELRSATRRVEKTEKDVLPAAXLDYDDTALVEQQYDELRIQLELSHCPFEIDRDVQETEKKFEYTRKNHLLXLDSMQVSLVXEMKGXAEALLMKNRXEADITELEYSLDLPSQATADAQNIVWTSHQLQXIDTTHLLLNIDYXARDEGRERLEISHRRADGRHYGRVESRTRL

SEQ ID NO: 38828 - protein, 301 aa, Diabrotica virgifera
  misc_feature: Coding regions on vcDNA: vcDNA=SeqID_18525; Strand=+; Position=83-989
  misc_feature: Homolog annotation: Hit_ID=XP_312380.1; Match level="QueryCoverage =74%, HitCoverage=67%, E-value=3e-35, Identity=36%"; Hit description =ENSANGP00000012173 [Anopheles gambiae]
  misc_feature: Pfam annotation: Pfam_ID=CRAL_TRIO; Match level="Score=-7.8, E-value =0.00016, Copies=1"; Pfam description=CRAL/TRIO domain
  misc_feature (180)..(180): Xaa can be any naturally occurring amino acid
  misc_feature (184)..(184): Xaa can be any naturally occurring amino acid
MDSKHLLITDRKKIREAWGKSDEDVMQDIQIIRVWLGTQKHLPEIPTDAMIEFFLTNCKYSIEKTKQNLDMYYTARDLVPDVYRNINPTIPSQVEAAYATACLVILPNLTPNLHRVSIIRFRNDMLQKADINKFNANSLSNFYEVRIHEDLTMGDVTVIDYEHCSFSVMAKLSLVAMKQXCVCXEKVQSSRLKQLHLLNPPAFVDKILTLLKSFMKSKLKERIYIHKSIEDVYHYIPQDTLPSDYGGKENLWQNRRYMKKEILESKTGLIFDKIQKMSFETEKLKMMNGRLLREFLEIQIV

SEQ ID NO: 38829 - protein, 69 aa, Diabrotica virgifera
  misc_feature: Coding regions on vcDNA: vcDNA=SeqID_18526; Strand=+; Position=3-209
  misc_feature (2)..(14): Xaa can be any naturally occurring amino acid
  misc_feature (21)..(34): Xaa can be any naturally occurring amino acid
  misc_feature (36)..(43): Xaa can be any naturally occurring amino acid
  misc_feature (59)..(59): Xaa can be any naturally occurring amino acid
TXXXXXXXXXXXXXCDLDVGXXXXXXXXXXXXXXFXXXXXXXXSLNRCEPGWFLSFIYXIYLVRKGPIY

SEQ ID NO: 38830 - protein, 153 aa, Diabrotica virgifera
  misc_feature: Coding regions on vcDNA: vcDNA=SeqID_18527; Strand=+; Position=179-644
  misc_feature: Homolog annotation: Hit_ID=XP_316385.1; Match level="QueryCoverage =80%, HitCoverage=5%, E-value=2e-21, Identity=41%"; Hit description =ENSANGP00000013025 [Anopheles gambiae]
  misc_feature (42)..(42): Xaa can be any naturally occurring amino acid
  misc_feature (57)..(57): Xaa can be any naturally occurring amino acid
  misc_feature (74)..(74): Xaa can be any naturally occurring amino acid
  misc_feature (100)..(100): Xaa can be any naturally occurring amino acid
  misc_feature (114)..(114): Xaa can be any naturally occurring amino acid
MDLIPIKMDPITDPADQRMNNWNEIYNVTHVTTSLRTQPDHXMKSKIPFCQSNSHEXPLNKYDSDMTASDVPGXWIQHVNHHLHTNNFPDYTGRIENTPXEAARVLEISAPIAXICNIECSISDHTCKNVCIEPHIPTHLTERCVWEEVYCSC

SEQ ID NO: 38831 - protein, 297 aa, Diabrotica virgifera
  misc_feature: Coding regions on vcDNA: vcDNA=SeqID_18528; Strand=-; Position=1-891
  misc_feature (13)..(14): Xaa can be any naturally occurring amino acid
  misc_feature (30)..(30): Xaa can be any naturally occurring amino acid
  misc_feature (36)..(42): Xaa can be any naturally occurring amino acid
  misc_feature (52)..(296): Xaa can be any naturally occurring amino acid
SSRRALSHCRVYXXHRRCPQIALRDDAILXVVHKLXXXXXXXYLRLRKHGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 38832 - protein, 264 aa, Diabrotica virgifera
  misc_feature: Coding regions on vcDNA: vcDNA=SeqID_18529; Strand=+; Position=81-871
  misc_feature: Homolog annotation: Hit_ID=EAL41567.1; Match level="QueryCoverage =85%, HitCoverage=44%, E-value=8e-85, Identity=67%"; Hit description =ENSANGP00000028794 [Anopheles gambiae str. PEST] ref|XP_564290.1| ENSANGP00000028794 [Anopheles gambiae st
  misc_feature: Gene Ontology Annotation: Molecular function=hexokinase activity; Cellular component=soluble fraction; Biological process=glycolysis
  misc_feature: Pfam annotation: Pfam_ID=Hexokinase_1; Match level="Score=337.1, E -value=2.6e-98, Copies=1"; Pfam description=Hexokinase
  misc_feature (238)..(238): Xaa can be any naturally occurring amino acid
  misc_feature (244)..(244): Xaa can be any naturally occurring amino acid
MAPEISHKTNIHPPEEHPPSSESLASKDIRDKCRELILTNEKLHKLMKVFLENVHRGLKKETHPTSIVKCFPTYVQDLPNGTENGKFLALDLGGTNFRVLLIELSGEHFEMKSKIFAIPQHIMLGSGEQLFDHIAECLAIFVKEEQVADQKLPLGFTFSFPLSQKGLTVGYLERWTKGFNCSNVVGNDVVQMLNEAIERRGDFEISVMAILNDSTGTLMSCAWLNRQCRIGAIVGTGXNTCYVXKQANAETRRHGLWKRADQPG

SEQ ID NO: 38833 - protein, 28 aa, Diabrotica virgifera
  misc_feature: Coding regions on vcDNA: vcDNA=SeqID_18530; Strand=-; Position=1-84
  misc_feature (1)..(26): Xaa can be any naturally occurring amino acid
XXXXXXXXXXXXXXXXXXXXXXXXXXSL

SEQ ID NO: 38834 - protein, 64 aa, Diabrotica virgifera
  misc_feature: Coding regions on vcDNA: vcDNA=SeqID_18531; Strand=+; Position=243-437
  misc_feature (22)..(28): Xaa can be any naturally occurring amino acid
  misc_feature (32)..(38): Xaa can be any naturally occurring amino acid
NAIRIVIISNLRRNKLNRFMNXXXXXXXMLSXXXXXXXGMSIRIKIYVQLNYFVKITIKKSSYA

SEQ ID NO: 38835 - protein, 228 aa, Diabrotica virgifera
  misc_feature: Coding regions on vcDNA: vcDNA=SeqID_18532; Strand=+; Position=3-689
  misc_feature: Homolog annotation: Hit_ID=XP_392232.1; Match level="QueryCoverage =96%, HitCoverage=21%, E-value=4e-77, Identity=64%"; Hit description =similar to CG10249-PA [Apis mellifera]
  misc_feature: Gene Ontology Annotation: Molecular function=structural constituent of cytoskeleton; Cellular component=membrane; Biological process =mechanosensory behavior
  misc_feature: Pfam annotation: Pfam_ID=Ank; Match level="Score=115.5, E-value=1.3e -31, Copies=5"; Pfam description=Ankyrin repeat
  misc_feature (195)..(204): Xaa can be any naturally occurring amino acid
YLDAFEDVSCLLLEYIVNMSDYSGNTAMHYAVSHGNFDVVSILLDSKVCDINKQNKAGYTSVMLVSLAEVRSQTHANVVRRLFQLADVNIRAKEHGQTALMLAVSHNRLNMVKMLLEAGADINIQDEDGSTALMCGAEHGHIEIVKHFLSQPDCNSTIMDMDGSTALAIAMEAGHRHIGVLLYAHERNSQKSHNXXXXXXXXXXSPKTPSSPLAARSSHRALTDTKPK

SEQ ID NO: 38836 - protein, 46 aa, Diabrotica virgifera
  misc_feature: Coding regions on vcDNA: vcDNA=SeqID_18533; Strand=+; Position=135-275
RIALKKNYSTVIHFIIVSLLELIWYNNDCQEYFIGRGCSMCNITVT

SEQ ID NO: 38837 - protein, 76 aa, Diabrotica virgifera
  misc_feature: Coding regions on vcDNA: vcDNA=SeqID_18534; Strand=+; Position=1-231
RNLKQLSLKSNYLKQFNTQDVLEDLGSLQILSLAINDLKCADLRNIDRELKRKRVDLEEGINKQNPNTYRGIKCTN

SEQ ID NO: 38838 - protein, 67 aa, Diabrotica virgifera
  misc_feature: Coding regions on vcDNA: vcDNA=SeqID_18535; Strand=-; Position=2-202
  misc_feature (8)..(8): Xaa can be any naturally occurring amino acid
  misc_feature (24)..(31): Xaa can be any naturally occurring amino acid
  misc_feature (34)..(41): Xaa can be any naturally occurring amino acid
  misc_feature (46)..(46): Xaa can be any naturally occurring amino acid
  misc_feature (53)..(66): Xaa can be any naturally occurring amino acid
GPFVLNIXNKLKIETNLAHTGLNXXXXXXXXSNXXXXXXXXPIINXNPTSRSXXXXXXXXXXXXXXV

SEQ ID NO: 38839 - protein, 19 aa, Diabrotica virgifera
  misc_feature: Coding regions on vcDNA: vcDNA=SeqID_18536; Strand=-; Position=1-57
  misc_feature (2)..(17): Xaa can be any naturally occurring amino acid
PXXXXXXXXXXXXXXXXLL

SEQ ID NO: 38840 - protein, 164 aa, Diabrotica virgifera
  misc_feature: Coding regions on vcDNA: vcDNA=SeqID_18537; Strand=-; Position=1-492
  misc_feature (1)..(28): Xaa can be any naturally occurring amino acid
  misc_feature (30)..(164): Xaa can be any naturally occurring amino acid
XXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38841 - protein, 108 aa, Diabrotica virgifera; identical to SEQ ID NO: 27732
  misc_feature: Coding regions on vcDNA: vcDNA=SeqID_18538; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 38842 - protein, 66 aa, Diabrotica virgifera
  misc_feature: Coding regions on vcDNA: vcDNA=SeqID_18539; Strand=+; Position=597-797
QVFNTNKYLNTHKLLTIFLNVYPSYCSLNLHIPRQRNNEVIPQIFRPTTVFRHSQFSSKHFIKEIL

SEQ ID NO: 38843 - protein, 73 aa, Diabrotica virgifera
  misc_feature: Coding regions on vcDNA: vcDNA=SeqID_18540; Strand=+; Position=179-400
  misc_feature (47)..(54): Xaa can be any naturally occurring amino acid
CGWQQLPKKSTQYNTPLLMNEHTFMTHPLHCNYEKMKIPSIHIDSVXXXXXXXXVFLINSYLNRNRFLKLNHS

SEQ ID NO: 38844 - protein, 69 aa, Diabrotica virgifera
  misc_feature: Coding regions on vcDNA: vcDNA=SeqID_18541; Strand=+; Position=7-213
  misc_feature (3)..(11): Xaa can be any naturally occurring amino acid
GSXXXXXXXXXCNEGPADKKNAFINFIKSFSFSLTVSILFKEAKPPFSCLFYLSTSVPFHLFSSSSPPP

SEQ ID NO: 38845 - protein, 228 aa, Diabrotica virgifera
  misc_feature: Coding regions on vcDNA: vcDNA=SeqID_18542; Strand=+; Position=63-749
  misc_feature: Homolog annotation: Hit_ID=XP_316159.1; Match level="QueryCoverage =97%, HitCoverage=93%, E-value=4e-35, Identity=40%"; Hit description =ENSANGP00000020345 [Anopheles gambiae]
  misc_feature: Pfam annotation: Pfam_ID=SNARE; Match level="Score=51.6, E-value=2.3e- 12, Copies=1"; Pfam description=SNARE domain
  misc_feature (214)..(221): Xaa can be any naturally occurring amino acid
MSFLDVDPWLYEYECCEKLYRDIMELLTQREKYPRISDNYSKASAVVRLRLKQYNEEVSQLHLKLENKSGTGSITPAEFERRTRQIETLHSKSIQMKKIFDEQVVSKSQEDRKDLIGFGTANLDGPSTSYSVNDLKEAQKRMIGQQNEGLENLSKIISRQKDIATTITNEVDYHNDLLDDLGNQMDHTDTILGTATRHIEVVDRKDKTCVYWVXXXXXXXXIVTVSAI

SEQ ID NO: 38846 - protein, 313 aa, Diabrotica virgifera
  misc_feature: Coding regions on vcDNA: vcDNA=SeqID_18543; Strand=-; Position=1-939
  misc_feature (2)..(313): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38847 - protein, 76 aa, Diabrotica virgifera
  misc_feature: Coding regions on vcDNA: vcDNA=SeqID_18544; Strand=+; Position=269-499
  misc_feature (1)..(8): Xaa can be any naturally occurring amino acid
  misc_feature (24)..(33): Xaa can be any naturally occurring amino acid
  misc_feature (68)..(74): Xaa can be any naturally occurring amino acid
XXXXXXXXNHIQILFKTINIKVVXXXXXXXXXXRNCDQKKIWESDENNGRKHVKLIYDFLKSSKDYDXXXXXXXYS

SEQ ID NO: 38848 - protein, 156 aa, Diabrotica virgifera
  misc_feature: Coding regions on vcDNA: vcDNA=SeqID_18545; Strand=+; Position=74-595
  misc_feature: Homolog annotation: Hit_ID=AAF87760.1; Match level="QueryCoverage =97%, HitCoverage=45%, E-value=8e-62, Identity=69%"; Hit description =cytochrome oxidase subunit I [Diabrotica virgifera zeae]
  misc_feature: Pfam annotation: Pfam_ID=COX1; Match level="Score=-158.4, E-value =7.4e-06, Copies=1"; Pfam description=Cytochrome C and Quinol oxidase polyp
  misc_feature (73)..(73): Xaa can be any naturally occurring amino acid
  misc_feature (108)..(108): Xaa can be any naturally occurring amino acid
LTRPLLSLPVLAGAITILLTDRNLNTSFFDPAGGGDPILHPEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 38849 - protein, 34 aa, Diabrotica virgifera
  misc_feature: Coding regions on vcDNA: vcDNA=SeqID_18546; Strand=-; Position=1-102
  misc_feature (3)..(10): Xaa can be any naturally occurring amino acid
  misc_feature (12)..(34): Xaa can be any naturally occurring amino acid
KKXXXXXXXXPXXXXXXXXXXXXXXXXXXXXXXX

SEQ ID NO: 38850 - protein, 66 aa, Diabrotica virgifera; identical to SEQ ID NO: 26808
  misc_feature: Coding regions on vcDNA: vcDNA=SeqID_18547; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38851 - protein, 65 aa, Diabrotica virgifera
  misc_feature: Coding regions on vcDNA: vcDNA=SeqID_18548; Strand=-; Position=1-195
  misc_feature (2)..(64): Xaa can be any naturally occurring amino acid
PXXXXXXXXXXXXXXXXXXXXXXXXXXXXXXXXXXXXXXXXXXXXXXXXXXXXXXXXXXXXXXXE

SEQ ID NO: 38852 - protein, 67 aa, Diabrotica virgifera
  misc_feature: Coding regions on vcDNA: vcDNA=SeqID_18549; Strand=+; Position=144-344
  misc_feature (53)..(67): Xaa can be any naturally occurring amino acid
KKSRLSTIAAAPVICFNATSGYESILSNDTLQYDYACHPYRKLNIPTKDVQPXXXXXXXXXXXXXXX

SEQ ID NO: 38853 - protein, 305 aa, Diabrotica virgifera
  misc_feature: Coding regions on vcDNA: vcDNA=SeqID_18550; Strand=-; Position=1-915
  misc_feature (3)..(305): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38854 - protein, 232 aa, Diabrotica virgifera
  misc_feature: Coding regions on vcDNA: vcDNA=SeqID_18551; Strand=+; Position=236-931
  misc_feature: Homolog annotation: Hit_ID=XP_314074.1; Match level="QueryCoverage =77%, HitCoverage=46%, E-value=4e-37, Identity=43%"; Hit description =ENSANGP00000015636 [Anopheles gambiae]
MYYNHLKNGGQPQNSKTNAVASAQRFIDSLLNEGKRTYVESSVCKKCQLPTYYDEALYKRGQQFFFRHIFAMLFAKLNGLLAVLSIPTILNILVLTQKSSSDFTAYIRYISTIFHMVIWYKEDLNPGSKLWGSIQEVNKKHTAASKKGSTYGLCRISQADMAFTQFGFMGFQVARPGMVGLHNVTEEEWKAFIHVWRVVGYLMGIEERFNICRESVEEPKKYGNLLIDRSFF

SEQ ID NO: 38855 - protein, 38 aa, Diabrotica virgifera
  misc_feature: Coding regions on vcDNA: vcDNA=SeqID_18552; Strand=-; Position=0-113
  misc_feature (2)..(37): Xaa can be any naturally occurring amino acid
NXXXXXXXXXXXXXXXXXXXXXXXXXXXXXXXXXXXXP

SEQ ID NO: 38856 - protein, 288 aa, Diabrotica virgifera
  misc_feature: Coding regions on vcDNA: vcDNA=SeqID_18553; Strand=-; Position=1-864
  misc_feature (1)..(285): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRE

SEQ ID NO: 38857 - protein, 51 aa, Diabrotica virgifera
  misc_feature: Coding regions on vcDNA: vcDNA=SeqID_18554; Strand=-; Position=1-153
  misc_feature (7)..(14): Xaa can be any naturally occurring amino acid
  misc_feature (17)..(51): Xaa can be any naturally occurring amino acid
NKFNAKXXXXXXXXAQXXXXXXXXXXXXXXXXXXXXXXXXXXXXXXXXXXX

SEQ ID NO: 38858 - protein, 232 aa, Diabrotica virgifera
  misc_feature: Coding regions on vcDNA: vcDNA=SeqID_18555; Strand=+; Position=253-948
FYPGTIPNLKALQVSDNPLVYPSRPVIVSGTKTIINFLKAQYESDRVKKQREDDDTDKTTATDSSIINEEEFRRDEQLVKVTEIGSYKSYNNMETSAKPSKETNRPSSKNSVVRTIRKKVSDGQTLNPDLKIKQLLSPEIVRCKRDTDKTKIVHKVSRTGSKLFLKSYFNKPLCGGDGKKFNNLKEGWLNELRILLTDQGTDIATKKKTSETISRWKDEEKDKKVKMIPKIF

SEQ ID NO: 38859 - protein, 66 aa, Diabrotica virgifera; identical to SEQ ID NO: 26808
  misc_feature: Coding regions on vcDNA: vcDNA=SeqID_18556; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38860 - protein, 270 aa, Diabrotica virgifera
  misc_feature: Coding regions on vcDNA: vcDNA=SeqID_18557; Strand=+; Position=82-893
  misc_feature: Homolog annotation: Hit_ID=XP_319829.1; Match level="QueryCoverage =88%, HitCoverage=47%, E-value=4e-48, Identity=39%"; Hit description =ENSANGP00000015949 [Anopheles gambiae]
  misc_feature: Pfam annotation: Pfam_ID=DAO; Match level="Score=33.4, E-value=3.1e -07, Copies=1"; Pfam description=FAD dependent oxidoreductase
  misc_feature (147)..(158): Xaa can be any naturally occurring amino acid
  misc_feature (224)..(224): Xaa can be any naturally occurring amino acid
  misc_feature (250)..(250): Xaa can be any naturally occurring amino acid
MNSRSLCTICNKVFQNKRYLHRSIQLNKRQHENPFWRTIRILGDDFKKFKQHKEPTEEEQQWLLRRHFPRHADIVIVGGGAVGSAIAYYLKLKSNYDGLRVLVLDKDPTFKKCTTAISMGALTQQFSLSENIQLASYGAEFLRNIKXXXXXXXXXXXXPSGYLVLASENGASQLEDNIKLQQEFGAINMLLTPQELKRRFPYLDVTNVAAGSIGLEREGWFNAXDMLTALRKKSMDLGAQYITAEVVDFXIEDRTDIRIEGVDVRNTRVQ

SEQ ID NO: 38861 - protein, 172 aa, Diabrotica virgifera
  misc_feature: Coding regions on vcDNA: vcDNA=SeqID_18558; Strand=-; Position=310-827
  misc_feature: Homolog annotation: Hit_ID=XP_318561.1; Match level="QueryCoverage =92%, HitCoverage=3%, E-value=9e-82, Identity=89%"; Hit description =ENSANGP00000019607 [Anopheles gambiae]
  misc_feature: Gene Ontology Annotation: Molecular function=ryanodine-sensitive calcium-release channel activity; Cellular component=integral to membrane; Biological process=calcium ion transport
  misc_feature (61)..(61): Xaa can be any naturally occurring amino acid
RNYKKSPRYVIVFVFHLYKGVRAGVGIGAEIEPSDGDDYEGYRIMFDITFFFFVIVISVGXIFRGLIIDAFGELRDQLESVKEDMESNCFICGIGKDYFDKVPHGFDTHVQQEHNLANYMFFLMHLINKPDTEHTGQETYVWNMYQQRCWDFFPVGDCFRKQYEDELGGGGG

SEQ ID NO: 38862 - protein, 253 aa, Diabrotica virgifera
  misc_feature: Coding regions on vcDNA: vcDNA=SeqID_18559; Strand=+; Position=1-762
  misc_feature (1)..(209): Xaa can be any naturally occurring amino acid
  misc_feature (211)..(231): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXFFGYKNKITLGIPGKFIGEPKS

SEQ ID NO: 38863 - protein, 151 aa, Diabrotica virgifera
  misc_feature: Coding regions on vcDNA: vcDNA=SeqID_18560; Strand=+; Position=3-455
  misc_feature: Homolog annotation: Hit_ID=CAE67072.1; Match level="QueryCoverage =96%, HitCoverage=25%, E-value=1e-23, Identity=38%"; Hit description =Hypothetical protein CBG12481 [Caenorhabditis briggsae]
  misc_feature: Gene Ontology Annotation: Molecular function=transporter activity; Cellular component=mitochondrion; Biological process=transport
  misc_feature (107)..(107): Xaa can be any naturally occurring amino acid
HGVRTKFASAWFGLDEVSTACALAVLGTQLGAAVGAIIPPFMVVKGETKDEIGDGIFNMTLYNTIGAAVILILIILFFRARPKLPPSQSQLQLLTLDEEKTNFWKDXKLLMKDKNYILLLMSFGIINGLWNAFGIAISSVLCTYFPNRGTD
